United States Patent 7,820,380 (GENETIC POLYMORPHISMS ASSOCIATED WITH LIVER FIBROSIS) - sequence listing, part 3

SEQ ID NO: 5097 - DNA, 95604 bp, Homo sapiens
  misc_feature 354, 355, 356, 357, 358, 359, 360, 361, 362, 363, 364, 365,366, 367, 368, 369, 370, 371, 372, 373, 374, 375, 376, 377,378, 379, 380, 381, 382, 383, 384, 385, 386, 387, 388, 389,390, 391, 392, 393, 394, 395, 396, 397, 398, 399, 400: n = A,T,C or G
  misc_feature 401, 402, 403, 404, 405, 406, 407, 408, 409, 410, 411, 412,413, 414, 415, 416, 417, 418, 419, 420, 421, 422, 423, 424,425, 426, 427, 428, 429, 430, 431, 432, 433, 434, 435, 436,437, 438, 439, 440, 441, 442, 443, 444, 445, 446, 447: n = A,T,C or G
  misc_feature 448, 449, 450, 451, 452, 453, 454, 455, 456, 457, 458, 459,460, 461, 462, 463, 464, 465, 466, 467, 468, 469, 470, 471,472, 473, 474, 475, 476, 477, 478, 479, 480, 481, 482, 483,484, 485, 486, 487, 488, 489, 490, 491, 492, 493, 494: n = A,T,C or G
  misc_feature 495, 496, 497, 498, 499, 500, 501, 502, 503, 504, 505, 506,507, 508, 509, 510, 511, 512, 513, 514, 515, 516, 517, 518,519, 520, 521, 522, 523, 524, 525, 526, 527, 528, 529, 530,531, 532, 533, 534, 535, 536, 537, 538, 539, 540, 541: n = A,T,C or G
  misc_feature 542, 543, 544, 545, 546, 547, 548, 549, 550, 551, 552, 553,554, 555, 556, 557, 89347, 89348, 89349, 89350, 89351, 89352,89353, 89354, 89355, 89356, 89357, 89358, 89359, 89360,89361, 89362, 89363, 89364, 89365, 89366, 89367, 89368: n = A,T,C or G
  misc_feature 89369, 89370, 89371, 89372, 89373, 89374, 89375, 89376, 89377,89378, 89379, 89380, 89381, 89382, 89383, 89384, 89385,89386, 89387, 89388, 89389, 89390, 89391, 89392, 89393,89394, 89395, 89396, 89397, 89398, 89399, 89400, 89401: n = A,T,C or G
ggcccttgcagtcggcgcccagcgcggggttgaacgcgtgcaggacgggttccttggggccgccgggcccaggtacgcttctttgaagacgtggaactcgtcctcctcgtacttcacggggccttcaggccgatgttctccgaagcgaacggaccctcggggcttaagagctccgtcccatcgcatcctcggggctgggcagcccgcccggcagagggccctcctccatggcgcaggcggcggggcgggatggcgggggccgcgcacctgcaacacgcggccaggtgagaggcagcagaggagaggacgaggggaggggcggccagaaaggggacagccaagggaggggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtcattcctcctcggaggacgcacctgggccgccggggctgccgcatcgtggatcgagcgggatggggcgtgggccgggcctcatgcgatgcggccgttggcggttggagaagggggaagggtgagggacaggaacctggggggagggaagaggcgcccgggcagtgggcggggcctgggcgtggggcggagtcgaggtcggggcgggaggtaaaggcggggccagggaggtgtggtgggcgtggtctggggcgggaggagacaggtcgcgaggggcggggcctggactgccgctgttgccagagcgggtcaggggaggcactccaggttcagccgatccaggctcaggtggggaaactgaggtccccatcaactcgggcagcctaagtgggactgcctagcttggcttctgaccttgggcttcagttatatttttctggccggcgtggttgctcacgcctgtagtcccagcactttgggaggccgaggcaggcggattactgaggtcaggagttcaaaaccagcctgggcaacatggtgaaaccccgtctctactaaaatacaaaaattagctggccgtggtggcacgcgcctgtaatcccagctacttggaaggctgggcaggagaatcgcttgagcccgggaggtggaggttgcagtgagccgagatcccgccacgcactccagcctgtgccacagagctagactccgtctcaaaaaaataaataaaataaaataaacatttttctacactcgagctctcaagacagatcccggcctgggacgctgcgggtggcagagggcaggggcttgcaccgcacgttcccagccttgcacccactcccggtccttggtacgcagcttacaggtgcaactgatggagttggtcccgaaatagaagtaacaaatacggcgggcgtggtggctcacgtctgtaatcccagcactttgggaggccgaggcgggtggatcactgaggtcaggagttcgagaccagcctggccaacatatagtgaaactccgtctctactaaaaatacaaaaactagctgggcgtagtggcgcacgcctgtagtcccagctacatagaagctgaggcttgaacctgggagatgggggttgcagtgagctgagattgtgtcactgtactcagcctgaccaacagagaaaggctccctctcagaaaaaaaaaaaaaaactcacaaatacatgaaagtctcaaattttgggtggggaatgagctatttcatctttaaggagtcaatagattcactgtttaatcaagaggaggtgaaagtttaattcaagtgatggcgaaaactgcaaaggtgtagagggactggtgggagtgggtgctggggagacagcctcaggtactgtctactcagtactgttttggtaaaaataaagaatgtaaaacatcagctttctaatctcacttttaaaattaaatacttttctaaatttttaaagggtagtacccaaggcacagcaacaccgtgtacatttagttgtacatttaacattcaaaaatcaagaaaattttgcctggggctgggcgtggggctcatgcctgtaatcccagcactctgggaggccaaggtggtcagatcacttgaagtcggagttcaagaccagcctgactaacatggtgaaaccctgtctctactaaaaatacaaaatagctaggcatggtggtgcacacctgcaatcccagctatttgtgaggctgaggcaggagattgcttgaacctgggaggcggaggttgcagtgagctgagattgcaccattgtactttacctgggcaaaaagattgaaactccatctcaaaaatcaaacaaacaaaaacaacaacaacaaaaacactcacagaagcagaaaaaataataaaaataataaatcgaagagcccaagaatatgcatagcttgagtggcccaagcgagagagtaacccacaaggttgcaccgttcattcgttactaatcagaatcagacgtctactgagtagcatcatgccaggcatacacagccaccttgggggtcacccacgggttgcaatcaagcctggaggctctgcacctgctgctcctagatcttgctgccctgctgcactggccgggctggctccgtcgagtctctcaggtctcagctcacccactctaagtgggtcaacctccctgccagctaccaccccctcccaatgatcctcttattgcctcagaacacttaaaatccttcaactggttggcttgttctctttttcctctgtgaatggtttggctctgtgtccccacccaaatctcatcttgaattgtaatccctctgtgtcagggaggggcctggtgggaggtgattggatcaaggaggcggttcccctacgctgttcttgaataagaagtgagttctcacaagatctgatggcttaaaagtgttcggcaattccccctcctctctctcctctgctgccatgtaacaggtttcttgcttccccttcaccttctgccatgttataagtttcctgaggcctccccagccatgctgaactgtgagtcaattgactgtctttctttatacttacccagtctcaagaagttctttacagcaatgtaaaaatggactaatgagcagccagaacctggtggggtcactgctgtctccccagtgcctagaacaggcgctgatatgtttggatgtgtgtccccacccaaatctcaggttcagtggtaatccctaatgttggaggggggcctgatgggaagtgactggatcatgggcgtgcatttctcatgaacagcaccatcctcttgctactgtcctcaccatagagtgcgtgagttcctgtgagatctggttgttcgcaatgtgtaagagagcacctcctctctctctctcagatctggttgtttgcaaatgtgtaagaagcacctcctctctttctctctctgtctcctttcaccatgtagaatgcctgctcccccttgccttccaccatgagtaaaaagctgtttgaggcctccccagaagcagatgcctccatgttcctgtatagcctgcagaactgagagccaattaaacctcttataaattacccagtctcgctatttctttacagcaatgtgagaatggcctaatacaggtgctcaagaaaaacagaaaatggaattcatgcattacttttaacatatttattgagcatcttttatgtgtcaggcactttctcagcattgaggcaatggaatggatgaataaatgcacagcaagtgaaaatcaacagcttttctttccagcccagcacatgaacttggtgatgtccatggtctcctccaaggcctttttccatatgctgagactttccactttgtctcaagtatctgaacttggtccttgacttaaatccccttaatataacaaaagagacagaaacaaatcttgtagtagactggggttaatgtttattaatgataacctacattcacactgcatttctaagatttacatccaaagagcatatgtatttacatgcaccggtcagcccaagataacaaattcaaaccatggctgcgttaagaaatggtttgttccaattaaattaaacagataatactcttatcaccccccttggacatgtcaataagacccctctttctcccctcaaggaatataaaattgcattgataactgcactgagagcaacaattacatttgaaacatttaaaacctgagagagaaacccaaatatgtttaagactcacgtctacactcaaaatgccctgtgaactctagtgtaacacagattgctcagtggcaacagtgcatgatctagctggctctgatagggactgacgccggctgctggcttttaacggaagtgctattcttgcccagggcagagagagctacatccccgctgcctgcttgacggaagtcaggggcttttgttgttggtttgtttttgcttttttttttagacggagtctcgctcgtcgcccaggctggagtgcagtggagcgatctcggctcactgcaagctccgcctcccggttcacgccattctcctgcctcagcctcctgagtagctgggactacaggcgcccgccacccgcccggctcattttttgaatttttagtagagacggggtttcaccgtgttagccaggatgtctccatctcctgacctcgtgatccgcccgccttggcctcccaaagtgctgggattaccgcatgagccaccgcgcctggacgcttttttttttttttttgtcttttgttttcatttttcttgctttcaggagaaaaaaaatctttggcccataaaggtgggatttttacatcatgagtatacatacataaaacatgcatgtgggccgcgcatggtggctcatgcctgtaatcccacactttgggaggctgaggcaggtggatcacctgaggtcaggagttcgagaccagcctgacaatatgatgaaaccccgtctctactaaaaatacaaaaattagcagggcatggtgttggcgtgtaatcccagctacttgggaggctgagacaggagaatcgcttgaacctgcaaggcaatgctgcagtgagccgagattgcaccactgcactccagcctgggcaacaagagtgaaacccatctcaaaaaaaaaaaaaaaaaaaaaaggcacgtgttctccggcaagcaccttccatgactccaacagttcagccatcgctgttgtactatcggggtgcagcactctgaaggagtcggcccaactagaaccaagtggtcaaaaaaataaatacacaatttaaaacaatggacagcaagcttgtcatgacagacagtgggaatttcattccatgatgcttcatttttgcattaaaactgaagatgactcagtgcataattgctttgtggtccatgagacgctttcgtgaaggcatcctatctgaaggacaggctgggtgaacacctagcactgtcacttgagacatcttggctgtcaccaaggtgagccggcatactgtctccatcaccctctggtgagtctttcccctcacgggtgggaggagaaggccatcccttggggtcgtggagccactctctcctcaccacggtggctgccctccccttcctcacttgctagtccccgcttggtggccgatgccctgccctcctgctgtcactttgggaaagagatcctcctgaggcacgtgtcatgttttattcttgagtgattatctgaccatcacggcccttgctccccttttatgacatgtgcctgttatttcttttgtgcttatgatgacaagaaggcagtcccgggaggggagtctggcacagctgcccttgggaggaactggtgtttctgagggggagggggctggtggggtgtagcaaatgcttatgtacggtatccatactcagtcaattgtgaagggaacagtatacccacaattccacccaaagactcacaaaataaatctttctctccatctcccttacatttagggcctttcatttttaaggcacgggttgtgaagacttgaagacatacaaggtcagtaaaactgaagaccttgcatcctgctgcttcaaatgtggagaggcaaacacaggctactggaccagacgggaacggttacccacgtgacaaaagcaggtctccaaagcacagcattttggttagtgcattccagatgtgttagcacaactggggacaccaacttgaataacacatttttcttttaacaaaacaaaagtttacctgcttggatgatgctaaatgcccttaagcactaggccttcggttgccactgagaaagcaaccatttccattccactgtgtgtgaagccacaaccctactaattccttcattaactcaaaagatttgcatcccttaataaatccaagccgatgcggagacatcaggggagactttatcgatgtcccccaagggagggcaagtctggaagtagtggggttatgcttcacaggggagagtactgttctaggaaaaaaaaacacccacattttctggaaggaaaactgagtttttttaaagcagtgtttcatcccgagctaaggtcaggattaatgcctatttttcatttggtttgcacagaagagctcgttttccttcccagcagctccagtggaattactttttggaattagaacgagaccaaacaaagtgatgatgtcagtcattgcttctttcaggtgccttccaaagcgatagaatcctttcatgtaaaaacaaaaaccaaaaacctattaaaacgtggccatccccacattcaagctttttcatttgcaatctgacccaatgtttcattgaaattcctttctgccagtctctaagatctgaccaacgtcttaaagcttaacttagacattccagagaaatgctgaggtaaagagatgacagctgatgtgtttgtgcgggtgtgttgtcgatctaagccttcccctatgccaatgcgtttatcccacggaaaacacaatgaccatcctgagcatggtggctcatgctgtaatcccagcactttggaatcgcttgagcccaggagttcaagaccagcctgggaaactggtgaaaccacatttctacaaaaaatacaaaaatcagccaggtgtggtggcactccccatagtcccagctactcaggaggctgaagtaggaggatcccctgagcccaggaggctgaactgcagtgagccgagatcacaccactgcactctagcctgggtggcagagtgagaccctgctaaaacaaacaaacaaacaaacaacaaaagaaaaccgcagtgaacaaataaaccccaattcctctgttaacagcgacagtggcatgggttgccaggctatgtacgacaaggaaagcaaatataaataagggcaatgtgccatgctagggaggaggtcccttgttccatccacagagaagccgggggtcccctgctctgtatgcagatttcttagtgtgtacccattatttttagtcatcttccaagtgctaaagagtctgaaagttacagcagcactccaacgttaagcttcaaaccattgctgccaacagaggtaaacatgttaaaccaaattagatacatttcctttttttttttttttttctgagacggagtctcactccatcacccaggctggagtgcagtggcatgacctggctcactacaacctccacctcccgggttcaagcgattctcctacctcagcctcctagtagctgggattacaggcgtgtgccaccacaccagctaagttttgtatttttagtagagcggggtttcaccatgttggccaggatggtttcaaactcctcacctcaagtgattggccgcctcagcctcccaaagtgctgagattataggtgtgagccaccgtgcctggctgagataatttgtttaaaactaggtaaagagaattttgaaattcacttatggctgggcacagtggcgaagcctgtaatcccaacactgggaggctgaggtaagaggatcgcgtgagcccaggagtcaagacttgcctgggaaatgtggggagaccctgtctgtacaaacaattttttaattaaaaaatttaggccaggcgcggtggctcatgcctgtaatctcagcactttgggaggtcgaggaggtggatcatctgaggtcaggagtttgagaccagcctgcccaacatggtgaaaccctgctctactaaaaatacaaaaaaattagccggggtagtggcgggtgcctgtagtcccagctcttgggaggctgaggcaggagaatcacttgagcccgggaggcagaggttacagtgagccagatctcgcccctgcactccagcctgggcgacagagtgagactgtgtctccaaaaaaaaaaaatttttttttaaaagcagtccatttatgtgaaaattcccgaaatcaagtaaaagcagcagttgaattgactttttctgtcaaattaaagatgtgtttccttaaaaagaataaagcaaaataccccatcttcagaaaaaggaacttcttttcatacataccgtctcagggcaagaaacttggaagaaatgtggaaattgatgaggttctctcccacaaggatgtacgacacacctagccgtcatcagcaacctggaggacaagggaatttgaatttgttgctgggaaatgagaaacgtgaaaaagggactttctaatgttctaaatgcaacactggcggggctcggtggctttccttgtaatcccagcattttgggaggctgaggcaggcgggtcacttgagcccaggggtcgagaccagcccggacaacatggtgaaaccctgtctctacaaaaaaatacacacacacaacaaattagctgggcatggtggcatgcatctgtagtcccagctactcaggaggtggagggggaggatcacctgagatgggggagattcaggctgccatgagccatgatcatgcttactcactccagcctgggtgacagagcgagaccttgtctcaaaaaaataaaaaataagtgcaaactgccaaggacatccatagcaatgatcagcagtaattcctttacggcggtagaaccgcaggtaacaggggcacccagcacggagatgggcccatcacaccccattacccatcccatcccacgccccactgcgcctcgcccagccccgccgcactcaccggtccaaagccccctccgtggacacgtactctgggttattctccaagtcaaacagctccacttgctgctgaggggtcggcttgttgataatctccaaggctcagataaaacctattgagtgaaacagggaaatgttcctaatcccctcctctaccgtccctcaggagtcgctttgggaagacgagaaaagcctggttggtcttttgattgttccacacaccacaagtctatgtctccaaaggcctcactggcttggcagcgtatctgcagagagcatgcggggtgggtggggcccccagactggggcagggaggcagggtgggggtgggggcataccagcaaatagcatctcagacagtgaaggtaacagattatggagtaagattcggaacggggacagaggtgtcagacttgtaccaactcccacgagcagctgccatattttcagagaattttcaagctggctgttaaatacagccactattaaaaataaatttgccaggcgcaatggttcatgtctgtaatctcagcactttgggaacccgacgcggtggattgcctgagctcaggagttcgagaccagcctgggcaacacggtgaaaccccgttctactaaaatacaacaacaaaaaaaattagccaggcatggcagcgtgtgcctgtaatccagctacttgggaggctgaggcaggagaatagcttgaacccgggaggcggaggtttcaggagccaagatggcgccactgcactccagcctgggtgacagagcgagactccatctccaaaaataaaaaataaataaataaataaataaaacttaaattaaatttgagctgggcacagtgtgcacatcagctactcagcaggctaaggacgaagaattgcttgtgtctaggagtttgacccagcctgggcaacactgtaagaccctgtctcaaaaaacaataataatatatttcataacttacaataaaataaaggatttttaaaacaaaggtggtacgcgctcacagctcatcacccctagttacttccgtgcgtcttactgtgacgtaagctctcgaggtcttcgggtctattagtcaggggctacatgtgacagcgaagtttttgaagaaatgcagtactaaacgcgctgccacattttccattttatgacagctacacccacagacccgtttttttcaaatgcccattcgacattaaaatatgttcatgcaaggctgtagtaatttactaagttttggtctagccaatcaactgacggaagaagtggaagagacttacttccttaaggaaaggggactccacagcgaatatttagacaccacgtaaaggcagaagaggtgacgatcgatcccagagccggtcatgggaggcgatacatatgctgatgcttctcagacgccaacttgaacaacttcagcctctgttcacctgagtgacaaaaggtgggaaggacatatgttgcatgtctcaagttgagcagttacgatctaagttagccaccgcacccggctaatattttttgttatttttagtagagacggggttcaacatgttgcccagggtggtttcgaactcctgagctcaggcaatccgcccacctcacctcccaaagtactgggattacaggtgtgagtcaccgcgcccggtgtgacagcctttccgaatgaagtttgtctcggaaaaaaagagccctggccagtgtctcctctggggatcagcgaaagcacctgcacgctctggggatcagcagaaagcacctgcacgctggagtcaggcggaccagtggcctgggtctgacctcggccattagtgagcagaatggcccagcagctgctgaatcatctaggcctctgtttctttatctatggaaatgaactgatgacacttctcaggaccatgctaagaaaatttaaaggacaatgtacagaaaacccccaggccccagcctggcacttgggcccagcgtggcaatggctctaataaccaatggaaggtcccgtgcgacagtcacagctacctaccctgacaccaaccacctgttcagttccaaagcagccacctgctatgcctttcccattgtgtgtcctggcctaatttaaagactctcaggaagtagaatatgatttggagaagatcatttgtaacatgcgtctctgtccttgtccctacctttaccttttaatattttaatacttctgtacccttgaaaggggcagaggaaagaagctgaattgagcacccctaaagaagaggtacaggaatgatgagatcagagaagctggagtgatggcctccagaagccttttagggagtgtgacaagcacgttgtgtcctcagcctgatggcacattaccgtctgggccgggtccccatggcccgcacgaagtcgcatgactcagtggtgcaggagcgcacggtctccgtcctccctctcggaagagccgggtcatggaggcctcgtatgtgaggcaaaacttgcccatgtccggggaaagagaagtacttcagtgcacggcagggcatgctgatatgtctaaaacgtaaggaggattgggtaagattggcaaggagaagtggacttcattgtcaacatttttttgagacgggtcttgctgttgcccaggctggcatgcagtagcatgatcacagctcactgcagcttcacctccccctgctccggtgatccccccacctcagcctcctgagtagctgggactacaggtcatgctaatttttttaaaattttttttgtagagacagggtttcaccacattgcccaggcggtcttaaactcctggctcaagcgatccacccgccttggcttcccaaagtgctgggattcaggtgtgagccactgtgcccagcctattgtcgaatcatattttcagtctctggccgctttacatgtgggtagtgacgtggcagcagacaggtgtcactggcttcaggaagggcctggggaggtgggtcagtttctaggttaaccaggtttctgtttcaagatgcaactgatactatacaccccccccacccccgagtccaacacacctctgctgcattcccttcaggctaaggtgagcctgcagcagtgtacagaaggaatgccgtgcacagcaggggatctgtgtttgaaatgtttaaagacacaacgtattgcctggagcaattccactgcgtctggaagatggtgagaatatctgggagagactgtgctggggtgcaggaagaatgtctagcaggagggcgggaagtggtggggccggagcctgaagcacagccactgccccattagacaggaagcctcgggtgggctgcagatgcacagggaaggtctcttccaaaagctcctgttttctgggtgaagcagaagaagcgggcctgctgagggccaggctggagaggaggtgctggcagcgggagaggggtgtgattggcattcaggggcatggaaacatggtgcctggcccactgcggtcagcgctcactcgtgggaggggagacgagccagctgttgaatgctttttttccagctaggctggtgccttgggacagaatcacagcagctggagagctgggctgaacccgggagcctctgcaggctccccaggaagttcagggggaccagggagtcaaggtaagggatgatcccaaagaaccatggaacccaacccagagaatagaaaagggagggcagggagggacaaggggatggggtcaaggaacgtggcatctgggcctagagaggacagcacggcaggaggggctgatgcccctgaggctgagcctggtggagatgacgggatagtgcagcaagggcccctgctgggaatagcagatggtggataggacagagactgagtccaaggcagcacgcggctgtgggaggaacagcatctgcgtgctccccaagaaggggcccggggccaccaggccagctcaaagaggaccaggttccaagtgggacgagaaggtgataagcagcagtttatggacccaaatgattcctgaccagacacatcccgcacattagtgtgcaccctggcacaggccctggtggccccagggtggcagacccacccactgcaaaggacaccatgtggcaggctgatactgtcaaatgaacccagaagagggtgccaaggcaaggctgggctgagcacagggcctgctcagcctggggaaggggaagccggacagacacaggacccactcagctggggaacggggagccggacagagcacaggacccactcagctgggaacggagagtcagacagagcacaggacccgctcagccggggaaggcctggcacctgacacaggcccagctgaagtcaggctcctcacagtgcagccaagatctctggaggagaggggcccctgaaaggcagaaggtagcgtccaggaccagggcccctgaaaggcagaaggaaggtccagaaccagtgaaatgagagtgcatcagccagcagaaaaaggaaactgaaggcgtcacaagagcagcggctttgcagagggaagcgtctagagaccgtgggagcacgctggacacagcgctaagcagcacttgcagtgaggacctggctgagcccccaggatccccccaacatactggccgccttggggagctctcttccccaacccacagatgccaccaaccctggtggcatacacgacactcaagattcccttgggagcgggggtcacaggcctggggcctgccatgaggcacggggcctcctgcttcccatgctgatagcaaacgcgcctttcagagcccttcccgcactcctcactacagagcacttcataggcgctcacgatgaagaagtggggagagggagagagcagataaaagggaaagcggaaatgtggcattttagttatttaataaaggtaaacttgactatatgatgcaatgattcatttgaaatcaatgttccaatatcaaactttaattgtgtagttatgagaacagtcatgccttgtgcccacagtttaaaagacagccatctaaaaaacttttggcaaatgcattgaatattagtgtgcaagccccactggagctcagacgccatcaaaggccaaaccaggttacaactgcagcacccttgacccactgtgaccagccgccatcaggagatggcccttcgctgccaccaaaacatctccagtttctaagaagcaggattcaaagacagctatagatatactgacatatatggcatcacacactagcactgttactatggggctaatgttcaggttggtagggcttccaaagcaggaggcaaataactgctgcagactagaattaatccactgtctagtgtcagcattcaatccatattcaatattcaatactgatttactgatgccccggcacaggcaatactgttgtaagacagatcatgcctttgccctcaatgagcaaacatctagcaggagacagggatgaacaaaaaaattctatcacatcaagtcaggccactgaatgaaataacacaggaacagggaactagggaacagaacaatgcgggaggggctaccttttttttttttggagacagtctcactctgtcgcccaggctggagtgcagtggtgtgatcttggttactgcaacctctgcctaccgggttcaagcaattctcatgcctcagcctcctgagtagtgggattagagatgcgtgctgccatacctggataatttttgtatttttagtagagacgctttccccatgttggccaggctggtcacaaactcctgacctcaagtgatccacctgtctcgcctcccaaagtgctggggttatgctttataaaatgaaatacacaaggttattgtgcataccttgaaggaccccttcaaggggtcaatataacacaaggttatattgtgtataaccttaaggacccctgagaaggggtccccaggctctcctaggctgcccaaggggtccagggcagaaaaaggttcagaagcttagaagagacccacagggccacagcaaggttctggatttatgaaaaccacagggaggctctgcagctcccagctgggttgagatcggtctgaatgttaattttgaatgaataaatctgatgtatacttttaatagatcactttaatggatctgtcattttattttattttttatttttttgagacagagtctcactctatcgcccatgccggagtgcagggtgcgatctcagctcactataacctccgcctcccaggttcaagggattctcctgcctcgcctcccaagcagctgggattacaggtacctgccaccacgcccagctaattttttgcatttttggtagaggcagggtttcaccatgatggccaggctggtttcgaacttctgacctcagtgatccatccgcctcggcctcccaaactgctgggattacaggcgtcaactaccacgccggcactccagcctgggtgacagagtgacactctatcaaggaggaaaaaaaaaaaaaagaaagaaaaaggaaacttcacaacatcacctgctaatattttgcatttatcctttctagacttgcatgtaacaaagcaagagttgggaaacttctgtaaaatgcagaacaggctgtgcggccaggtgctctctgtggcgactactccgctctcccactggagtgagaacagcacagacacatgtgaaagccgggcatggccgtgcccagaacgcttcactgatgaacactgagacttccgtaattttcacatgtcacaaagtattggtcgcctgttgactgcttttcaactactaaaatgtgaagccattcttagctttctaagccatgaaaacaaaaatgaaaacaaaaacattgagggccaggtttggcctatgagccacagtctgcagatcattgtaagaaacacctgacttcacaaactgttttatgactaaatatttttccgtataatatgccatagatggctgggcgtgtggctcacacctgtaatcccagcactttgggaggccaaggattgcttgagcctaggagttgagaccagcctgggaaacaaggtgaaaccccatctctacaaaaaacataaaaattagcgggcctggtggtaaatgcctatagtcccagctacctgggagactgaggtgggaggatcccagcacccagggaggtcgaggatgcagtaagccgtgattgtgctactgcattccagccgggcaagagtaagaccctgtctcaaaaatatatatacacatatatatgccttagacatccttaatagctatataatattccgctgtgtgaaaataccctattttaatttagtatcatgaaggaagattcactctgccgaaaggaaaggattacactgaaagcttcgtgcaagaagctcctttttcttttgttcccaagcacagagtgacggataaaaggcgaaatgtctccactctggttcaccgggttttgtgtaacaaatatgtaactgacgattcccctaccgccccttttccttgcatcatgggaattccgtaacgtggccacgccctcccttccttcccctcctgcctgttttccttttaaatactgaagccctcaaaaccacctttggaggaaggcacaggcctgtccccaggcacgcatctttaaccttggcaaaatcaacttctaaataaattgagacctgtctagacactttctagtttccagtcttttttttttttttttttttttttttttgagagggagctcgctctgtcacccaggctggagtgcagtggtgcgatctcggctcactggaagctccgctcccgggttcacgccattctcctgcctcagcctcccgagtagctgggagtacaggcgcccccaccgcgcccggctaattttttgtatttttagtagagacggggtttcatcgtgttaccaggatggtctcgatcttctgacctcatgatccgcccacctcagcctcccaaagtgctggattacaggcatgacccactgtgcccggcctgccagcattaacttttaagatttcttctcttctttttttattttttgagacggagttttgttcttattgctcaggttggagtgcagggcgtggtcttggcggctcactgcaacctccacctcccacgttcaagtgattctcccgctcagcctctcaagtagctgggattacaggtgtgcaccaccacccagctaatcttgtattttagcagagatggggttttaccatgttgtccaggctggtctcgaactcctgacctcaaggatccacctgcctaggcctcccaaagtgctgggtttacaggcacgagccactgcgcctgccagatttcctcacatttttacagtaagcttgctcacacgtgttttttgtgtacctacctttttcatggatcatgtgcagggtcaaagttattcttccccgatgcatgtttccaactggtggtctgtgctgctcccagtcctgccatggggcccctaaatttattaaaactattcccgctgctctatgaacatccctgcctcagtccaccctcaccaacatgaaaaaaagcctttacaaccccgtaggcaaaaatctagtcttgtttaagttgtacttgttagattcttggtaagttaagcttattacctacactcattgaccgtatttttcctctcttgtgaaccacagtttcggtctgactccttatttctcttggattatttttttccaaaggcaaccacttagccagattcccagctccatttactcaccagctccccgtcccctactgatgtcaaatgctccctccatacacgttatttcccaggcctgcttttgtacgaggactgcagcattttatttttattaaaacaatttttttaaagatagggtctcactgtcatccaggctgtagtgcagtggcacgatacggctcactgcagcctccacctccggggctcaagtgatcctcccaccttagcctccgggtaccttggactacaggcatgcgccaccatgctgggctaattttttttttttttttttttattttttgtacagatagagtctccccatattgcccagtctggtctcaaactcctggaccaagtgatccacctgcctcagccacccaaagtgctaggattataggactgagaccacttaatcacaacagtcttctaactcctacactttaagttttaggatttgaaaaagtacatgtcacctccccgtgtcctgcctccgcctgattgcttttcttttcaaaaatgttacaggtgatctcaaatgttagccttttcaagcctcaagatcaactgggcaagctcctctcctgaagccctgcctgacctctcactgtgttcatattaaatgtgtgaactaagccaggcatggtggccaggcttgtaatcccagcactttgggaggctgaggcaggcggatcacttgaggtcaggactcgagaccagcctggccaacgtggtgaaactccgtctctactaaagatacaaaaattaccaggtgtggtggcaggcacctgtagtttcagctactcgaggggctgaggcaggagaatacttgaacctgggagccgagtgagcagccgaggctgcagtgagccgagatcgtgccactcactccagcctgggcaacagagtaaggctccgtctcaaaaaaaaaaaaaacagtgtgaatgggaacatcccttcctctatggttctgaagttttttttcatccaaaatcatggcttttctccctctccctggggaggagttggggggcgagtgctcctcggccttcttcccagagtcagtctgctttatacacgtatgcctggaaggtggggccccagattctcgtttctattacatctcttattatatttcccacttggccatcatccttgtgcaagaaagctggtggtctttggcaactctgcgctgggccggctcactgggtgtgcctcttaatcgtcaaagcctttctgcgttccatctcctgaacagacataaatgttcttcctgcccaattaccctgtcatctgctaaggcatcctcatctttcttgttttaaggggactgcctcccacacttttactttgaagcatagctagctattaatacacgatgccacttatcctgttaaggaaagagccctattactaaccccttgaccaagagctcttatcaggaatggatgttaaacgtgaaacgtcttcttaggactgtgaaactcactatctaggctcttctctgacccaacagtatggtttagtgtatgactgatttactgacacaaaaccagcctctcaccgctggtgtacgccactgtgggtgactattttttcctacagtgctggattctagttgctaagattttatggagggtctctgcacttccatcatgcgggaagctggtctgtgcttcctttttctgcgtttagctgcagcacagtgatgaagccacaggttctcgaacaagcctgcctgcttccgatctcagtcctgctgcgtacgagcggagccctcaggcaagatgcttcacctccgagtgtggagggcagagatgaagagatgcctcctcggggccgtcctgaagtttcgctcgctcctgccaagtacatggcacagtggctgggccccttgcagctcattcccacacctgggccacgtgggttctggggagcagatggggtgcttcctttgtggagtctctgagctgcaagctctttggagtcacaagggtggctccctgaaacctctcactttggtccctggaccagagaccttttcaggttttctaccttgagtcaactcaccaatttgtactgcttgcagaatagtcatttcagcatgtttcaaaatgtactaaacggagcgtggcatttccttactaaactcctaagtcctgcgcttacttgcagggaattctttaaaaaagaaaaaaatttaaaaagataaaataacatcctttctgtaggtaaggtatcaatgcttgcatgccctcatactgcacgtttacgggcaaaatctgctcatcaattctcaaaaccagctcattgattctgagatgcgatgcctctattccatgtcaccttttaatcacatgactttagtcaatgatctgtcacagacaggagcttgtcactgtgctcctggtactctgcccgctgcttctggtttacgcatagtgagcatgttacttgggaaagcaaggcttcataactggacagtctttacagactgtattagcatgcattttaaatacgattttggcccattcattcagttcatctgatattaacactgcctcttacttctctgtaactgttttcttaactttaggggagagagcatagactctggagccgctggcccgctttatccctgcctagtgccaccctgcaagcacctggcctctctgcacctgtttcctcacctgtaaaatgggaaaacaagatttttgaggcataatggggacttgtaaatttttaaaaatgggataacaagagtgcctcccagggcagagacagtgaagcatgaggtacatgatgcaccaagcaaaattcaacaatggcacaacgttaccaaggttgggggggcagtgccacacgctgcatatgtgtacagcactcaagtttaatacaaggctgggcacggtggctcacgcctataatcccagcactttgggaggccaagggggtggatcacctgaagccaggagctcgagaccagcctgctcaacatggtgaaaccccactctactaaaaatacaaaaaattagctgggcatgggggcgcacacctgtaatcccagctctcgggaggctgaggcaggagaactgcttgaacccgggaggtggaggttgcagtgagccagatcatgccattacactccagcctgggtaacaagagtgagattctgtctcaaaaaaaagttgggaatatctcaagccaatgccacgatgacttgtgttgcccccagaaaccaagggcccctgtctgggatggaatgctccctccaatggacaagaagacccatttatgtccctgctggggtgcaggctgctcctccaaaaggggttggccaggtgcaagccaaaatatggccagtctcagaaaagggagatggaaatgccatgtgtatacaggggatccagcccatggcacctcaagtggctggagtttctccttttatggaaggagatgtcaaaggccagagacgttaagtatttgcccaaagacatcacttaatagctatataatattccactgtatgaaaataccaaaattaatttagtatggtgaaaggaagatttactctgccaaaaggaaaggattaagctgaaactaagtcatgcaagaagctttttattttgttcccaagcagagagcgacagatgaaacgtgaccatgttcacctgacctgtgtgaagtgcagatttaccgagcgccagacgaatacgtactgactattcccctacctgcccacactatttccactttagcaaatgctaggattcggggttattatggggcttaactctccctctgtagagtgatgagatctcactttgtcctcatccccagactctccctctcccgtgtcagctgggaatctacgcctgctggagggggatttgcgactttgcccgcgtgcgtggtgaaacacccaacgccacccggcccccggagaccggggtcgggggagctgtgcttctcctatgccgggtttcgggccttccctccccactgggtgaacatcttgggcaggtgtaggaacccccaaagtgctcacgacaaaaccctaggcggtcagttctaccttgtagtgcgccagctggagggccagctgcacaaaggcgtctgggctcgtgcgactttcttgatgattcctttaccaaaggctacgaatgggaaggaatggaaatccacgtcgttgccagaagatttgcggtgttcagggaggtctctataacctcttgacacttgagagaaaaagaaaaaggttttacggaacgaggggagaaaagtactgacgcacacccagaaggaaatggaggctggtttttagtgcagctataaactcggtactgggaagtacacaaacgttttccgacccagaagccctagtaagttaggggcatggctccctgaccccggaggagcagctgcatgttatagcaggtagcgggtctgacatgagcaggccaggagagggcttcctccgacacaactgggaatatcacgcgaccatcagtgatggtcaggtggttgtgaactgtctctctaaataataataggtcacagccggtgccagggaaaggcagtctctcagtagatagaaatggagtggtgaccagcagcttcccgataagatctcaagcgttgggcgagtgggctgaagcatgccactgagaggcaaaatggcggcgtctaactggactatgagcttcctccagcagtgctagcaggcaagggcagaacacctcaagtgagcatgcgcacaactccagtaaacatactgcgctgctcccttcccaagcgctggagccactgtgcatgcggacagcccacaacaagggaggattgggagaagtaacacaagaccctggacgcatgccaatgtataaaacctcaagtcaagagtcaaacctcgcacttaatctcccaagttggccgcttggccctcttccaaatgtactttcttcctttcgttcctaaagtttttaaaataaactttcccgcttttaaacttggtctctctgccttctgccccacagtcaaattcgttctgagaaggcaagaattgaggttgctgcagaccgtacagatatgttctgacgctaacaggaacatgggtaggggacgggggcaccctggctccagtgagaccccaaagggtgtttcaaatagtcacacgtcatcttatgatgacgtcatacacagtggcaatcaagaaacacatttttttactttttattattaatttttatttatttagatagggtgtccctctgttgcccaggctggagtgcagtggcaccatcgctgctcactgaccttctgcctccctggttcaagccattctcctgcctcagcctccggagtagctgggacacaggcacttaccactatgcccggctaatttttgtatttttagtagagacggggtttcacatggtggcaggcacctgtaatcctagctacttgggaggctgaagcaggagaatcgtttaacctgggaggcagaggttgcagtgagctgagatcgcgccattgcactccagcctgggtacagtgcgagactacatctcaaaaaaaaaaaaaaaaaagaaaaagaaaatggtatcttgactccagggaatttctccttggattaagtgaactaggatttggtatttgcaaccctaaattccttcccaaaagggctcctgtgaatgggctgcctctgagcatgtttaagaggtgccaaatgaattaaactttgagaagtataaatgagcaatttagaggctttcagctctaacctagtgattttggcttttagtttttgattatgagcattctgtagatgtctagttaagtttaactggaaatagcgctgacagtcttagccaggagcttcaaacagaagaagaaatatttaccaggcttccgaggcaacaggagctgtgacagccccgcagacccacggaactccctgagcaacaactttcagcctcagtggtcttcaactgagctcatgatagggcaggaactacggttgaaaattcatctgtaagacttcaaatgtgtttcccatcccaggtaagtaacaatggttggtaatccggacttacttcccccgggatgtcccactgcagcctggtggggtacggaatgttggattgatgtcgcctttgcagtgcccatcctccgcatagcccagctggaggctgtcaatgacatgacgtactgtcaaaaatagaacaaaattattaaaactaacagtggtacataaaaacattaacctccaacatgaagagagggttgttctttgcagagatgttacaaagtttgaacacagctgttaaggcttccagtatgctcagcacctaatgaggtggatctgatctccatgcagatgtgacagagagaggacagacgagggctaagggcttgctcaagtttgtgacgctccctttcactggcaagtaaacctaagccaatttattcaacggtgtttattgggcacctacatgggttggaaccactgtagcatcagcggcatccaagccctggtgacagcgcagacaagactgtgttttgtgaacaaaacagacaagaattcttgcccttccttaaaaagtgaaatatcctgtatgacccagcagttccactcctaggtacatactcactgaaatgaaatgaatagagctcacacaaaaacttgtacagaatgttcagagcagcattattcataatagccaaagagggaaacaacacaaatgcccatcaactgatgaagagataaacaaagtgtggtcaatccatcaatgagatattatccagccctagaaaggaatgaattccaggtatgtgttacaacgtacgaaccttgaaaacattatgctgagtgaaaagaagcaggcaggcgcgctgcctcacttcataatcccagcactttgggaggccaaggtgggaggattgctggaggccaggagttccaaacagctgggcaacatagtgagatcttatctctacaagaaattttaaaaattagccaggtgggtggcacatggctgtagtcccagttactgaggaggctgaggtgggaagatcacctgagccaggaggtcatggtttcaatgagtcatgactgtgccactgcactccagcctgagcgacgagcaagaccctgtctctagaaaagaaagaaaagaaagcgaaagaaaagaaaaaagaagcagacatagaagaccacatattgtatgattctatctatataagatgtccaaaataggcaatacatacacacagaaagattagtggtcatcaggaacctgggggagaaaggaatgagggtttcttttggaggtgataaaaatagtacagaattaggctgggctctgtgactcacgacttaatcctagcacgttgggaggccaaggcgggtagatcactttaggtcaggagttcgagacaagctggccaacaaggggaaaccccgcctctaccaaaaatacaaaaattaggtgggtgggcgatgcacgcctgtaatcccagctactcgggaggctaagcagtgactgttgcacaagacctcgtgaatatactaaaaaccactgaattgtacacttttaaagggtggattttaaggatgtgacttatatctcaactaaaaaaattaagtttttttaaaagaggaatccctgtgctaggaagcttacattctagtgagggaggtaaaaacaacaacacaaggtcggggtgactgtggctggcgaggcggcggggcgggtggaaggtgccgctaatacgtgggggtcacaatccagctgacctgagccagcgaacgaacagacttgatcaggttccacctgctctgggtcagagtccagaagagcctgacacagaaacatcagaaataaatcaagagcaagaccgggtgtggtgctcatgttagtaatcccagcatgttgggaggctgaggcaggcagattgtttgaagccagagttcgagaccagcctgggcaatgtggcaaaaccccgtctctacaaaaaatacaaaaacagctgggcgtggtggcgcacacctgtggtcccagctactcgggaggctgaggtgggaaattacttgaacccaggagttggaggttgcagtgagctgagattgcaccactgccctccacctgggtggcagagcaagaccctgtctcaaaaaataaaaaataaaaatagaacaagaacagaacaaacagactcaagtttgactagatctgtctttaagggactgcactgggcccccagtgagactaggtcagtccccatctgtgtatggatcacataagcccccagccaggggtcctggagtcaggccatcctgtctgctggacgctaacaactaaacaccactacttctacgtgccaccctggtctaagataaaatccctttatccttatccagagaactttaaaaaacaagctgatcttgtaaatatccagtagatttctctacttgataaatgtaccctgtgtgatccagtgcctatggtcccgactctttttcttttgccaaacaacagctcttaggcatataggactgggaagtccttggcctggggtataacaagcccgggctattatgctgtgcagagatttataaagcgtgccttcttgctacgtccagagacactgaaggcagcttgatcttcaatgcgcttgtagctaaaaggctctctcagcttttgtcgacatcgccaaagaaccctggtggtggtgaaagcccttttaatattggctgctttttatcaggtattaatgtcctagggtcatactgggtcttaaagcctagagcactatgtttttttttttcctttttatcctttttcctacatagaaacctcccttggctgaaggagtggctggaggttttgccaagactccaaccagaagtaaacaattaaaagaggtagaggaagatgagacaggagcccctaacctagtcttgggagaggtagcagggcagtgccattcctaggggaagtgaggtcagctgagacctaaggaagacctgcggggccaggagccaggggaagccagggggaaaagccttccaggcagagaggagagtgatgcgaagactttgcaagaaaaaactggcaccagaatttgtttatctctaggggaaaaaaagacagacacaatattataaaaagaaacgtcaaggccaggcgtggtggctcatgccatatcccagcactttgagaggccaaggcgggtggatcacttgaggtcaggtttatatatataaaaaattatccgggcatggtggcatgtgcctataatcccagctactcgggaggctgaggaggagaatcacttgaaccggggaggcagaggtggcagtgagctgaaatcgcaccactgccaccagcctgggtgacagaacaagacgccatctcaaaaaaaaaagtcaaaattcaaaacttcacagaagtttaaagaaaaaagaaggtcatacattatgatgtcttcacaagtttactctaatttctttcttttttttttgagatggagtctcactctttcgtccaggctggagtgcgtggcgtgatctcggctcactgcaagctctgcctcccgggttcacgccattctcctgcccagcctcctgagtagctgggactacaggtgccagccaccacgcccggctaatttttgtattttagtagagacggggtttcaccgtgttagccaggatggtctcgttctcctgacctcggatccgcctgcctcggcctcccaaagggctgggattacaggcgtgagccaccgcgcctgccactactaatttctaatttcagacacacaaacccggctccatgccctatcaagaacaggaggtgctcagcctgcagctgggccctgtctcccacacacgccgtgactttcaggtcatttattccacttcatttattaggccagcaggaaaatttaaaacactgcaaaaagatggtcttatagtcaatgtgaatctcaaaggggcttgttgctttaaaagaaaaagatctcaagtccatcacaacaagtgaccacagtattttctgtgtcaagtctacggatgatgatcctagaattagcaactttaaacaagaacctgaccggtgagttaaggaaacaaaactttcatttaattctcatgccaaacacggaacaggtcaaacagttcagagtaacgaattattaaaaaaaaaaaaaaaaaaaaaaaggctgagtgtggtggctcccatctgtaatcccagcactttgggagcccaggcaggcagatcccctgtgcccaggagttcaagaccagcctgggcaacatggggaaccttgtttctacaaaaaatacaaaaattagctgggcatggtggcacacacctgtagtccagctacttgggaggctggggtgggagaatgtcttgagcctgggcggtcaaggctacaggagctatgattgtgccactgcactccagtctgggtgacagagtaagaccctgtctcaaaaaaaaaaaaaaaaacaatggtagaggccaatccacaggtgcaggcagggggacaggggttgtggttttcaaataacctggtaattttaagaattaaaatgatgtcttaggtaaaagaccgctgcatgtttataaacccagattttcacatgcttgcttctatttggcctaaaaaatgggtaggtaggaaacactaggaaatccagcacataagggatagtttattccaggaaaaacgagcttcacttctgctgtgaagctgcggcctgagagtcaactgccatttcactcttttgtccctaaggagatggcaggagatgcactgctgttcaagggacctaagttatgggaaaggagacagggatgcctttaatctagtgatttaacttcatgtgcattactagtacaagtgaaaattcatattctataatcacgcaaatattacaaaactaaattgactgtggggtttggatatcttttttgttttttctttttgagacagagtctcgctctgtcgcccaggccggagtgcgtggcacgatctcggctcactgcaacctctgtctcccgggttcaatcgatttcttctgctcagcctcccaagtagctggggctacaggcatgcaccaccatgcccggctaatttttgttttttagtagagacggggtttcaccatgttggccaggctggtcttgaactcctgacctcggtgatctgcccgcctcggcctcccaaagtgctgggattacaggtgtgcgccactgcgctggccaggtttggattttcaaaagcaacttccacattcaagtgaaaagtgtgaaaactccctcccaaaggtgggccacgatcggcgcatctgcccaggagtgttcagcgttgaggccctcttcccgtttttgaagacaacaaacgtgaacgacttgtcaaaccacctacgtgaaacaacatgtgtggaacttaagtgtttaaagaggcaaaaatgaggagacattgcacctctctgttcatcctggatggactaattcactttgcacctgtccctctaacagtgagcagacactcgtctctgtggagtgagggtgaaagtacaaacaggacactgaatcactcatttcttcccttcccagacacaaagatgagcgcttatatcctggcagcctgaagtcaggacctgttgttacgcaaggcaactggggagaggtgggaggctcttcccgtgggcacatgaccccttcatcaccaatccttggctccaccctgcagggggcggggctggccaacactttacagataagaaaagaggacttgagatagccacatgccaacaccctggcctaaccctgtgcctagccctgttgccactctcccctgcctgagtccagggacctggcagccctgcatctcatgagcatctccaacaaaggtggtcatgtacagaggagggaagaatctcagatttgcagctcaggctgtgttgtgtgatagttttggcagagggaagaaaactgaaggttggccaggcgcagtggctcactctgtaatctcagcactttgagaggctgaggtgggtggatcacttgagatcaggagttctaaccagcctggccaacatggtgaaatcctgtctctactaaaaatacaaaaattagccagcgtggtggcacacgcctgtaatcccagctacttgggaggctgaaggaggagaatcgctgaacctgggaggcggaggttgcagtgagccgagatcaagccactgcactccagcctggggacagagcaagactccatttcaaaaaataaaataaaataaaactgaaggttatattttttgccaccttctttcttagcattatagatacttaggggtgagtgtcaggcacacagggtattcttccaagctcatgggcaaactcctgtctctcagaaggtaaggacggtacctgtcgtacatcggccgtgtagtagagatttggcgtagctgtccattgacgtatccgggtcttcactctgtatccttcttcagtttcatctaacgtcacgaagaacgctgctttctccacagcataagagactgcttatttttcccacgtccaaaataggcctgacgacacctggcccagggaatctgcagtgaagatgaaatacgattaaaggcagcccgacctgcagcgatggagcgtgattttgaaatgacacaatcaaacctttgcagtttttcagaatttctcgaaggaaaactccagttgatgatgttccccatctgagactgtttgctggaaggactctcacctgctcctggtcccagaccacagcatggggagcggtgggtattttttgttcaataaatgctgactaaatgacggccagattgcaggctggccccgtgggcaaagccgccaggaagcagcagacccagatcccctgttccacgctccctgacacaccctccctcccctctacaggaaccaccctaggtaattccggcagcccaggtcacagtaagtgcgtaagagtgcgtccctcatgccaggctctgcccaaaccttttctgtgtaccaacttactgatcttctcaatgctactgtacctatttttcgatgagaaaactgaagcacggaaagattaggtcacagctattttgaggcagagtcggaaccaggccatcagcccccaggtgcattccacagatgcccatgtgacccctccacaaggagtctccgtgcccgtcttatttgaatacacagaactggtgtgatgcccacttccttcttggagacccaccagctgggcttcctcgagtgctcccgggtccctctcactccagctcctccaggccctctgccactgcccacccttccagatcggggccatctggctctctccccaccttctctctctaggagtgcttggctatggcggcccgcagggcgaataagcctagaaacacgctggcctcagtgcaccccgctcggggaacaaaggtgacggtgacggtggccggcacgtacgagcccttcctgtgaatgactcccatgggtaagatgctgatctggccctatccagaggggcatcgggaccgaggcgcctacagacccacagggagcccaggccccgcggcgccggctcagctccccacgtctcctccgctggggattccaggctctgagaggagggcatcggatgagccatcttcacccgagatgcatctcctgccgccgctctttccagccttgtcaacaccacagagataccgaacaacgccggcttgcccgcacacatcctcctccatcccgctcctgctcccggcctggccctctttcaggccctcactacttgggccaccgaaaagcatccctgtgtccaggcccctcctccctgcccaaccagaagaatctcccacattaacctactcatgcacccccgccccaccccaccctacaccacctgaagcggcacccagttgcagaatcaagctcaaatagattgggtgcctgggaccctccccagcttggcaccgtggcccagctgcccagcccactcacggctcctgcctgctctgctaccccggggcatgcggctccaccccctggacacccacttcctcctggtctgctcccaccctctgcaagacacagcccacctgcggcccctccacgcacacagaacctctcctgatctttgcagaaggggccccaacacctgcccctcccgccttaccccagcgatagcgtagcagttgtcacactgctggaacgcagcagctctcagctggggacacagtgtccccctgatgctgggcaatgtctgcgacacttctggttgtcacacaggttgcgctggcagtcggtgggcagaggccagggctgctgctcagcatccaacgctacacagggcgtgccccccacaaagaggtacccggccctgagtgtgcacagctctgaggtgagaaaccccctatacaatacacaccacacctgcgagaaaaccaagctcgggctgattcgctttctttttatgttttgagacacagtctcactctgtcacccaggctggagtgcagtgccttgatcaggcttactgcaacctcaacttcctgggctcaagcaatcctcctgccttagcctcctgaaagcttggactacaggcacgcaccaccaagcctggctaattttttggtagagatggggtccactctgttgcccaggcacatctcaaacccctaggctcaagtgaccctcctgccttggttcctaaagcaatggaattataggcgtgagccactgcgcccggcctgattctttttcactaggcaaggaaatgtaaccctaacacaggggccttggtttccatttgttctgtttcctaattaataaatatgcccacagccccgtaagaaaggctaatcctggccaggcatatggttcagcctgtaatcccagaactttgggaggccaaggtgggtggatcacttgaggtcaggagttgagaccagcctggccaacatggtgaaaccctgtctctactaggcatggtggcgcactccagctactggagaggttgaggcaggagaactgcttgaacctgggaggcggaggttgctgtagctgagacagtgccattgcattccagcctgggtgacagagcgagacttcgtctcaaaaaaaaaagcctaattctaatcctcacttctccctgtcctggactctggagtgtttccacaacatttgcctgacacacacacaggggtggccagggaccccccaccatgtccccattgctttgagacctgccaagccgggagaccccagagaaaaacagagccgaggtggggagtcccggccaggattcccacaggccctggtggggatgggccccagtgaggaagagcgcctccaccccccccaaaacaggacaagggacctaggctgcgcacctgtctcctgcggtgagggctgcagcctggcctccccgggctgaggctccgaggtattgtccaggatcctctgcatctgctgtccatctcccggggcttcagcagccgcccatcatggtagagccagaccttgaagtagcgcctcgatggtacacgacgatgtgcttgctgtctctcatgtgctggatggtgtctgagccgccgcaggttggagacacaaaaccaagagtcccaagttcagcacgtgctgagacgaccgaccctgactctgcaaagggcatgggagtccctgctctgcgtctctccaggcagcctcagaacctattcctcaagacgttttaaatgattaaggacagcttggagttaaagctctggatggagaggcctgacttctgagctcagcttagtcactcattagattatgacctcaaacaaatacccgaggccaggcgcagtgggaggctgggagtggtggctcacgcctgtaatcccagccattgggtgaggtgagaggatcgtttgaggtcaggagttcgagaccagcctggtcaacaggtgaaatcttgcctctactaaaaatacaaaaattagccaggtgtggtgacatgcaccttagtcccagctactcgggaggctgaggcaggagaatcgcttgaaaccaggaggtggaggtgcagtgagccgagatcacaccactgcactccagcctgggtaacagagtgatactccattcaggaaaaaaaaaaaaaaaaagcatgcttagcaaaatggaatattatcattaaaaaaaaaaaaacaaattacccaaccctccctaagcctctcctcagtaaaatggaggtcatatgtccccatatgcactgtgcaagaattaagagacgatatccgtaaagcccatgtaaataggcttcgatccgtatagtaactttttattaattaatgacaatagggcaacttagaaaatatgtgagaaacattccgataattgtttctgagaacccgagaaatgttctgagaaagaaagtgaaaattacgaaaccaagccattccgtaaaaactactaaaacagagtaatttaagctcctagtaagcttaaacatcacagaaatgtgatgaagtacgttcactccacgaatatttatcagtcctcttaagcactgctcagtggggatgcacagtgacagctgatcaaggcagatcgtcagtgaggaagacaaataaatgcatgattaaaaataggacaagctaccaggagcagtggccaccctgtattcccagcacttcaggaggccaaggagggaggattgcttgagcccaggagttgggatcagcctgggcaacatggcaaaaccctatctctacaaaaaatacaaaaattagtgggtgtggtggtgtgcacctgtagtcccagttattctggagctgagatgggaggatcattgagcctggggagcagaggctgcagtgaactgaaattgcaccactgcactccagcctggtgacagagcaagatcctatctcaaacaaacaaacaaaaacaaaataggacaagtgtcaaaaaggctagaaagtgtaggactaggaccaacctagcctggagatgtgagaaagcccttcacccccactaaggaagtgatgtttaagaagaacccggccagatgaagaacagaattaacaatattatgcccgatctcatgttttttttgagacggagtctcgctcttattgcccaggtggagtgcagtggcgcgatctcggctcactgcaacctccgcctcccgggttcaagcttccctgcctcagcttcctaagtaggtggcattacaggcacctgccaccacacctggctaattttgtacttttagtagagatggggtttcaccgtgttggccaggctggtctcaaactcctacctcaggtgatccacccgcctcggcctcccaaagtgctgggattacaggcatgagacatgcacctggcctcctgctctgatttttaaaatgtttaccaaaccaaggatgcaggagactgctttggtttgctgaagggttcctaccagaaacttggaccaaacggcatttgaagcctcgctttaaagtcacaaacaagacaagaatgcacaccatgactatgtatattccacattaactcaggatgctggccgggcaataaaataagaaacaaataaaagataaaggattgaaaggaaatatcaaaggtgtcatttgcagctatgattagcatgtggaaaatccaagaaaaccttcagctgtttaagccaataagaatacagctgggtagtggctgggtgcagtgactcacactgtaaacccagcactttgggaggccgaggaaggcggatcacgaggtcaggagatcaagacatcctagctaatatggtgaaaccccatctctactaaaaatacaaaaaattagccgggctggtggcatgtgcctgtagtcccagctactcaggatgctgaggcaggagaagcttgaaccgggaggcagaggttgcagtaagctgagatcctgccactgcactccagcctgggcgacacaagactctgtctcaaaaaaaaaaaaaaaagaatacagctgggtagaaacacagtttataaaacctttcatgttcctataccccagggcacaggctgaactgtgtccccccattcataattgaaatcctaacccccagcacctcagaatgtggcctcatttggagatggggtctttatgaggtcattagggtgggccctaatcctatgtgactgtgtccttttaagaagaggagttagggttgggtgcggtggctcacgtctataatcccagcactttgggaggccgaggtgggcgatcgcctgaggtcaggagttcgaggccagcctggcctacatggtgaaaactcgtctctctaaaaaattacaaaaattagccaggcgtggtggcggacacctgtagtcccagctacttggagtctggagcaggagaatcacttgaacccaggaggtggaggttgcagtgagccgagatgtgcactgcattccagcctgggtgacagaatgagactcagtctcaaaaaaaaaaaaaaaaaaagggagactttaggacacgcacagagggatgaccacgtaaggacacagggaagagtggttatccaaggagaggggcctacagaaggaaccacctctgccaacaccttgatgttgagttccagcctgcagaattgtgagaaaatcgctgtcttgcttaagccgtgcagtctgtgtatttgttatggtggcctgggcaaacttacacgctgcataaccaacaccttgaaaatatcttgaaaaggaacaaaacaataaaagtgcttagaaacagctcgaacaaatgatgtgctgaaggacttcatggagaaaagtatgacattttattaaaatcgcctaaaaaacaaaaaagggccaggcacagtggctcatgcctgtaatcccagcactttgggaggccgaggcaggcggacacttgaggccaagagtttgagatcagcctggccaacatggcaaaaccccgtctctattaaaatacaaaagtaagctgggtgtggtggtgcatgcctgtaatcccagctactagggagctgaggcaggacaatcgcttgaaactggaaggtgcggtttgcagtgagccaagattgcacactgcactccagcctcggcaacagagtgagactcagtttcaaaaaaacaaaaacaaacaacaaacaaaagtaaaaaaaaaaaaaaaaaaaaaaaaaagcagaatgtctggaatatataatactttctacaaatcaataaggaaaagatacacatccattttttaaaaatatacaaatataagaacaatattctcaacagaagaaacccaaatgtccagttaacattttaaaagttctaacccttttggcaaaaatgaagggaaaagggtattttatagattgctggggacgtgaagttggtaaaatcactttgagggtaatttgtccatgccagtaagactggaaatgtccacagggcagccggcaagccaattctaggtgcctgctctacagactgtttgaccaatgcatgaggggagaaacatacacagaattcactgagcgtcacttagaaaggaaaacaggaaagaagaaaagcgttcacatactggaattgttttgatactataacgaagtacatcataaatgtcataatgattgtactggagtggtaagattagggctgtatcttctgctaaaagattttctaattttggtagtaattccattttatagcaatatatattattaaatagaaaaatgccagaattaagacccttaagataagtctatacctctttccctttttttattttggggaatttgaaggtctaattagtgaggattgtgactgatgggatcctccggtggggatgtctgagaaagtggtggggctttgcccgatgatcaccaacgaatggcattgcacgtgctcatatacatttactttctttattttttttttttgacagggtcttgctctgtcacccaggctggagtgcagtgtgcgatctcagcttactgcaagctcctcctcccaggttcaagtgattctcctgcctcacctcctgagtagcagggattacagacatctgctatcacgcctggttaatttttgtgggttcttttagtagaggtggggtttcaccatgttggccaggatggtctcgaactcctgacctaagtgatccacccgcctcggcctcccaaagtgctgggattacaggcgtgagccaccactccaggctttgtatttacatttctttcattcccagtgatgttgaatgcttttctataactcttaaacatttctccttccaggggtgcccatcatttcctttccaattaggatcttcatgttttctggcagatttataagaactctttacatattaaccctgttctctgttgtgagcactaccctcaatttgttatctaccttttaaaacagtttgaagtatttttgaaatatagaaactaaaatctttacatgacaatatttggatttttccgttgttgtaatgagttgagctgttctacccaaaagatatgtccatgttctagccctggtacctgtgaaaaccttatttcttaacggaagtagggtcttttttttctttttttgagacagggtctcattctgtcacccaggctagtgcagtggtgtgatcacagctcagctcactacagtctccacctcccaggctcaagtgtcctccctcctcagcctcctgagtagctgggaccacaggtacacaccactatgtccgacaatttttgtattttttgtagagatggggttttgccatgttgcccaggctgctctcaaaccctgggctcaggtgatccacccacctcagcctcccaatgtgctgggattacaggcatgaccaccacatctggcctggaaatagggtctttgctgatataattcaatattaagatgaggcatactggactagggtggaccccaaatccaatgactgttgtccttgtaagagagacacaacacacagaggtgagagccaaggtgacatggaggcagagatcagagtgatatgcctacagccaaggagcacctggacccccccagaagctggaagaggcataaaggcctcccccagagctttgaaaagagcacggccctgctgacaccttgatctcggactctggcctccagagctgggcagaagaaacttcttttgtcttaagacatccagtttgtggtcatttattccagcagcccaagaaactgactcaggtatcatgctcagaatggctgtccaggtacactaagtaactagttttatcccagcatttcccttgtttattgatttattttatttttatttcatatacatattttttgagatggagtctcactctgtcactcaagctggagtgcagtggcatgatcttggtcactgcaacctccacctcccaggttcaagcaatcctcctacctctgcctcctgagtagcgggattacaggtatgcaccaccacacctggctaatttttgtattttcagtagagatgggtttcaccatgttggccaggctggtgtcgaactcctgacctcaggtgatccacctgcctggcctcccaaagtgctgggattacaggaatgagcctttgtgcctggcctcccttgtttattttttaaacacatacatatttacctcctggaatcactgtcagtgtaggccgcatgtctaaacttaaatgatcttaaggatgtccccataccacggtgctgactgacagcaggtgacacctccccaggacaccctgacccacttccctttggggacactgcctgccctggtcagtgaggggcaactgcccctccaatcagggagacactgtgagaggatggagagaaccaacttcatttcctccacctcgttgcccaactgccccaggactgctgttggccaacacatctgttttcacatgttgagctacagtacaatggacgacagtgtgtggcaggaagagaggaggggtttgccagaaacactgtgaaatccgtgaacacacatggagtgggttcttttttgtttttttggatgaagtttcactcttgttgcccgggctggagtgcagtggcacaatctcagttcactgaacctccacctcccatgttcaagtgattcgcctgccttagcctcccaagtagctgggatacgggtgcccaccaccatacctggctaattttgtatttttagtagagatggggttttgtgaccagtagtaggctggtcttgaactcctgacctcaggtgatctgcccacttcggcctccaaaatgctgggattacaggcgtgagccaccgcgcctggccagaatgggtttttagagacctctgaaggcaggatcagaggaaaggggagaatctgcttaggaaagcccactcagaggcagcttttgtgcaaggatacagcaaaggctccccaatgaccaccacagtgcacactactactagggcttggtctggaatattgactagggcttggtctggaaggaccgggctgcaacagacactcaaaactgcaggtcaggccaggcatggtggctcacatctgtaattccagcacttggaaggccgaggtgggacgatcacgaggtcaggagatgagaccatcctggctaacacgtgaaactccgtctctactaaaaatataaaaaattagccgggcgtggtggcaggcacctaagtcccagctactcgggaggctgaggcaggagaatggcgtgaactcgggaggtggaggtgcagtgagccgagatcgcgccactgcactccagcctgggcaacagagcgagactccctcaaaaaaaaataaataaataaaattgcaggtcagctctggccctttccagccagcttcccagcagccccgaggcccgcccgtcatacaggcctgccatgatggtcttgggctctagctcccaagtgtctctgggtagttccccatccacaggcacctggggaaatggaggccatggacgcacagcctgggcctgggcctggcctggatgttccccacggtgcctgttctccctcccttcattctcaaggacgtcctggtttggacggtggcttacgtggccaccctgcccaggtcagcagctgataaaggagtggctggaacacaaatccacctttccgagcacgacccagtgtggttccatcacaaacgctgactgtgagccggagtaaaatgcccctgaggaatccagactcggaaaaaaacactcagctgtgtgtgactcacgcctgtaatcccagcacttcgggaggccaagcgggcggatcacttgagtccaggagtttgagatcagcctgggcaacacggcaaaactcatctctataaaaaatgcaaaaattagccaggcatgatgcatgtgcctgtggtctcagtactggggaggctaagatgggaggattccttgagctcaggaggtggaggctgaagtgagcgtgatcatgtcactgcactccagcctgggtggcagagagagacctcatgtcaaaataataaataaataaatcaaacactctatgagacagttggcagtcttcaaccaaagagaaattaaatctggaaataagtcaacaacagtgtccaggcctaagacagacaaaggaaattcagcgaaggaatgttcaccagcctacaatctcaggaagggtcagcaaaaatcaatttggccccttgacacttcctaattctgagcatagggatggaaagtgccgattctccagggggccctgagaagcttgactcacctgtctcctctcctgggatccgggaagtattaaacatccgctccactgagcggagcagagtggaatcgtggatcccaaaagacgaatctgtaacaaaaatatattcaaaccaacaacgaaaatcccacagaagaaaagcagcaagttggccgggtgcggtggtcacgcctgtaatcccaacactttgggaggctgaggcgggcggatcacgaggtcagtagtggagaccatcctggctaacacagtgaaaccccgtctctactaaaaatacaaaaaaattgccgggcatggtgtcgggtgcctgtagtcccagctacttgggaggttgaggcaggagaaggcatgaacccgggaggcagagcctgcagtgagctgagatcgtgccactacactccagctcggcaacagagcgagactctgtctcaaaaaaaaaaaaaaaaagaaaacaaaagcagcagcagcaagcaagttaagaccacatggaaatgctgaatgtgttttctgtgcgaattgcttgtttgacttcctcttttccagtggctccctggaatgattcgttgggggactcattaaacatgccagggtgcaacttcctgcacagttaaatcctaaataacacattctaattgattatgataactgacacttacaaccaaagaaatattccaggaagaaaagtcttgtttcttatgacaactaagcagctagtattagttcaaaaacatcaagggcttctccaaagggcagattacgaattaaagtacaacagatgtatattcatttaggagacacaaggagaattacatctcagataattaggctgggtgaaagaaactagaattccgaaaaaaagagtgcatactgttatgatccacttacacaaagctttaaaaattgcaaactaatctagagtgacagatagtagaccaggggtccaggaccaggtgggagggagagatgacaaagggcagaggggttttcgggttgatgatgtattcaccatcctgactgcagtgatgatggtttctcagatgcatcaatatataccatcagaagttagcaaactctacactttattttttaatttttttttttgagatggagtttgctcttataacccaggctagagtgcaatggtgttatcttggctcgctgcaacctccactcctgggttcaagtgattctcctgcatcggcctcccgagtagctgggattacaggcgcggccagcacgcccagctaatttttctatttttagtagagacagggtttcactatgttggcaggctggtcttgaactgctaacctcagatgatccgcctgctttggcctcccaaagtgccagattacaggcgtgagaccctgtgcccggccacaaactgtatattttaaacatgtgcaaatgtcaattatacctctgtaaagctgtttgaaaataatttttttaaagcaatttgtttgctactggtttgatttcctcccggtccagtttgcgcctgtaaagcaggatggcatggatgcgttgccggctcttgctgcctgaatgtgagttggaaggatatacagcagatcctgaaaacgacaaaggtggagagaatttgcatagggaaagataagcaaatttaaataatcacagcaatcctgcacactgtcacaatatttctagagatgcatcaatatacatacatattcggttaatctgcaatgctacaaaataaatggtaatttgattttctccactttgactttgtaaatgtttatgagaacataagtcctctaaaacttctgcgctattaaagataactatttgcaccaataccctcacgtaacacagagaaaggaaagcaaaaattagtcggggagcaattagacaacaggaagttttctggatgagacacaatgaaaggttaaaatagttgtttatatagagctggcctgcagctttctaaattttgagaccctgttccaaatgtctgcattttccacaattggagaaaaggccaaggaacacaggtctaacctacattttggaagagtctatgtacacaccagtccccattgatgtagaaagtgcctctgtttgtgggaaataaacaaaggtctcctggcggaagggcatcagataaatagctcacttccaaatagagcaggaaaagaagttctatggacacactaacggtttttctttcagtttgagattatttcagatgggaaaaaaaaagttaagaaaaaagaaaggacaattttgaaacgaagaaaaacagaaagaaaaagcaaatgataggccggtgctcatgtctgtaatccagcactttgggagaccgaggcgcacggatcacctgaagtaggagtttgagactagcctggccaacatggtgaaaccccgtttctactaaaaatacaaaattagccgggcgttgtggcaggtgcctgtaatcccagctactcgggaggctgaggcagggaattgctggaacccaggaggcagaggctgcagtgagatgaattgcaccagtgcactccgcctcagcgacagagcaagactctatctcaaaaaaaaaaagaaaagaaaaagtaaatgataaaaaataaacgagggaaaaaaataaaaggaagtgaaggaatggaaggaaaaggaaaggaagagttctatttgccagttattaaagcagtggtcaagaacccaaactgagaggcctttaaccatccatgctttgaaagacaaagcccaggaaaccagaaactaccgtcgatgcacaccctctggcgtctcagaaaacagtagggtgaagcgcagcgcactggtggcaggatcttgccaacccactgtccctgagctctaggggttctgcagggatcttaaggccgctgtggcacaagttccagtgctaagccataaaaacagcaggacaggccgggcacggtggctcacaccttaatcccagcacttagggaggctgaggcaagtggatcacctgaggtcaggagttcgagacagcctggataacatggtcaaaccccgtctctactaaaatacaaaaattagctgggcgtgtggtgggcacctgtaatcccagctactttggaggctgaggcaggagaatcacttgaactgggaggcggaggctgcagtgagccgagatcgtgccattgcactccagcctgggggacagagcaaagctccatctcaaaacaaaacaaaacaaaaaaacagcaggacaggtacagcacgtgaggaattcctgtttgccagaaacttatttttgcaacccaaatccccctgcagtagcgagcaccctgggctactaggctaacactgaagggtactcatagggttctccggcctggagcaggacagagaggagcatgagccaatccccagagttttcccaggccgtccacaggccttgaagacgccacctctgtggacagacccgccgccccaccgtcctcgtcagacagcagccgggcgggtggactcaccatggcataatagttgctgttcaccatgagcggccctcgtcctggaggtagatgtactcctcccaccagtcgctcacctagtgggcgcaaacaccagacaaaccgcaggctcagcaggggccaggcaggctccctggcagcagcccagagccgcggggaaggcaggcagtgcttttggcagacatttcggcgtctaacaggggccattccagaacagggacgcagtcctaactagatggaatgcgacaccgtgggaaatgaaaagtgttctttttaagtgagacaggcagaaagaaggtacatcaccttcattttgtagatggttcaaaagggaaataaaagccgaagtgggaggattgcttgagaccaggagttcgagaccaggctaggcaacatacaaggctctagccctacattaaaaataaaaataataaataaaataaaaatttaaaaatgttaagagaccaaatggaaagtaaatcataaatgtctgactgctaacatgttttaaaaacaaaactatgggctggccatggtggctcacacctgtaatctcagcactttgggaggttgaacaggaagatcgcttgatgccaggagtttgaagccagcctgggcaacatagcaaggttcatctctccaaaaaattttaagaaattagccaggtgtggtggctcacgcctgtagtctcactacttgggaggctaagacaggagggttacttgagcccaggggttccaggcaacagtgactatgatcgtgccactgcattcccacctgggcaacagagcaagaccctttctcaaataaagaaaacagaaacaaaggccaggagcggtggctcacgcctgtcatcccagcactttggggactgaggcgggctgatcacttgaggttaggagttccggacctgcctggccaacatgataaaccccgtctgtactaaaaatgcaaaaattagccgggtgtggtggcgggcgcctgtaacccagctactcaggaggctgaggcaggagaattgcttgaacctgggaggcggagcttgcgtgagccgagatcgctccactgcactccagcctgggtgacgagcgagactttgtctcagaactaaagaaaataaaagaaaacaaagaaaaaaccaatgttatgcaaaattgctccacaactgcttcccaggtctgcctgaagaagccaccgtcccagtccgtggcactaacctggtgtccgcaggtgttgtctctattccctggcacatgtgtcctgaggccacccagaggcagtgcccccaaccacctcacagctgctgtcccttcacagcctgctggacccagggatcgcttctttcagctttgtgctgaaacacacgtacctacagaacagtgcccatgcaagggcctcgttgcggagagctgtgcagagagctgacgtttaccagtccagcacaccggtgcagccagcgatatgcccggccccctgaggctagagagacccctccaggcactgcccatccacccaccagccacgtctagcgccacctgctggttctgtcagggtcgctttggacaccttctcttccggttagttgttcctcaaagctagactccctcccttgctttgtctgccggaggcctgctctgccctcccagtacgtggaagcccagccagctccccgcacacagggtgccagctaagacgttcgttggaggagatgctcctgggaccaccgagccacactcaaccccagggaggggcgacagcaccgccctatcccacaccatccctgcatccaccagcgagctcgggaaggatgccctggaatcaagataaaccaaagaggaggatgggagcaggtctctggggcagcatggcactctgcaggagaaacagctcacaggaggactctccggggaagagggagagggagaagcctctgcgtgcaaaacacagcatcgtgctggtgtacctgcactcagggtaaaactgtcactgtggctgggtgtggtggctcatgcctatgatcccagcactttgggaggccgaggtgggaggtcacttgagcccaggagtttgagaccagcctggtcaacatagtgagactctgtctctacaaaaaatccaaaaaccaagaaactgtcactgtaactacacgtcagtcctaacacacacaactccactctgcacagaggtaaaactatagctggaacttcctagggtgtgattttggctatccaaactgtcatttcagccctgttatccctgcccctcaaaattagcgtcttcatacgacgctatttcatcaagaaaaactgtgtatacagacttacgtaatttgtagcccaccaggttttaacttcaaataccactgtaatcttggtccaagaccgacagcaaaatcttgagcaatgctgtcatccgtttgaagtcttcttccttcataagaggcctcaccgactgtagatactggattattggggaaaaaaaaaatcacccaagttaaaacatattaatcaaagcctatgttgcctcacttgtgccttaggaaaagttctaacacattgaaaaggttttaggctgggcatgtggctcatgcttgtaatcccagcactttgggaggtcaaggccagtggattgcttgagctaggagttcaagaccagcctaaacaacatggtgaaaccccatctctacaaaaaaaaacaaacaaaaattagctggacatggtggtgcatgtctgtggtcccagctacctggggggctgagttgggaggatcgcttgagcccagaaggttgcggctgcagtgagccatgatcatgccacgcaccccagcctgggcaacagagtgagaccctatctcaaaaaaaaaaaagaaaaagtttgactcttcccccaagttggtcttggcagtccttagacaggtaaactcccttcaatgctaatggtgtcatagggtaatgataatttaacaattaaactttttcttcctttattagctttaaagtgtcccaaatcctgcatcaccagaaaatcaccattaaatttttagaatttaaaataattctagagttgacaagaaaagttaacaaggaaatttcaagaatgtctcttatctatttttggcccttaataaaagatctgttctgacctaagtaagttttgatgacctgcgatggtaccatgagatggggcagagtcatgctgagagctgggtgctggggctgggcaggtgctcagcagcaggatgggaacgaggggctggaataggtcacggaaccaggctaaggccagtgcccaggttcagggtttccagcccccaccccgcctcgtccttttacatgtgctactttggttaacaaatgctcagaggtggaaacacagagagcaattgtttaaaaagacactcaaaagctctgctacacacctaagcaagctcttacagaaagtaacagtggtcaggtgtggtagctcaacctgtaatcccagcactttgagaggctgaggtatgaagagtgcttgagcccaagcaatttgaccagttcaagaccaccctgggcaacagagtgagaccccccatctctgcaaaaaaaaaaaaaaaaatacaaaaattagctgggtgcggtggcatgtgcctgtgatcccagctactggaaggttgaggtgtgaggatcacttgggcccaggagttcaaagctgcagtgagccatgtcacaccactgcattccagcctgggtgagatgctgtttcccccagcaacaaaaagtaaactgttgctaaccccacaatttgtcatgacatattttaatccgacaagttgtttgtctgcgtaaaaaacaaagcttggtgcaacagtaatctctctatagtccctccctgtacattgaaagtaagaccccactcccttaaaagggccagctgtagctgggcacggtggcttatgcctgaaccccagcactttgggaggctgaatcaggaggactgcttgagcccaggagttcaagacagcctgggcaacatggcaagaccctgtctctacaagaaagtatttgcaggcatagtggtcacacctgtggccccaactacttgggaggctaaggcaggaggatcactcgggcccaggattcaaggttgcagtgagctaggacggtgccactgcattccagcctgggcaagagagtgaactctgtctccaaaaaaaagggggagggggcaggtgtcaagcatcttgaggcttattcaagtaaaatgcccgtgaatgagacagaaaatcatgccctgaatgagctgaagtggaacccgagctacgcaacacagacagaggtcactgaaggtcaagcatctcttgctcaccccatccgccagtggaacaggggccgtcatcagccctgatttgcaagcgtgggcacagaagaggaggatggggtgggccaggtatggtagcttgtgcctgtaatcccagtactttgggaggccaagtgggcagatcacttgaggtcaggagctcgagaccagcctggccaacatagtaaaatccgtctctactaaaaatacaaaaattagccgggtgtggtggtgcacatctgtaatcccagcactcaggaggctgaggcaagataattgtttgaacttgggagatagaggctgcagtgagcgagatcatgccactgcaccctagcctgggtgacagagcaagactctgtctgaaaaaaaaaaaaagagcagagatgggaagaccttaccaaggccaacagggactcagtaaccaagcctgattcaaacccttaacccgagaagtttttgcttattattatagttttaaaattggagtccaggatgtggaaaaactaaagcacccatgcactgctggttagaatgcaaaatggtgcagtgcgtgagagtctcatggttcctcaatgagttaccacggaattcccatgagccagcaatccactcctggatacgtccccaacagcggatgaacaggtggataaactgtggtccttccaacaatggaacactattcagccacaaaaagggatgaagttcatccatcctacaacacggggaactctaaagacatgctagtcacaaaaggccacgtgattccatttatgcgaaatgtccgaagaggcaaatccatacagacagacaggagattagtggttctgaggggctgggagaggaggtagaaggatggggagtgactgcttagtggctatgagcttttgggggatgaaaggtctggaacgagacagcagtgagggctgcgcaacattataaatgtacttagtgcccctgaacgtacacttgaaaatggttaacagtacaattcatgttgtgtacattttaccataattttttaaaaacaaagaaatggagctgctccctctccttttgttcaattaaagaaaaaaaaagacgaagcaggtagatcacttgagctcaggggttcaacacgagcctggacaagacagtgaactccgtctctggaaaaaaaaaaaaaatagggccaggcgtggtggctcacacctgtaatccagtactttcggaggccgaggcaggcagatcacgaggtcaggcgatggagaccatcctgctacagtgaaaccccgtctccactaaaaatacaaaaaaaaaatattagccaggcgtggtgcaggggcctgtagtcttagctactcaggaggctgaggcaggagaatggtgtgaacccagaggtggagcttgcagtgagccaagatcacgccactgcactccagcctgggtgacagaggagattctgtctcaaaaaaaaaaaaatattgccatatgtagtggcatgcacctgtagtccagctactcaggaggctgaagtgggaggatcatttgagcccaggaagttgaggctgtgggagccaagatcgcgccactgcactctagcctgaacaacagggtgagaccctgtctcaaaaaaaaaaaaaaaaaaaaaaagaaaatgaaaaagaaatgagtagctttgaggatgaaatgcaggctttctaggtagtgccttgcccctgggggcctggctttgaagtgcggctgctgtgcaagaagcaccctgtcctcagaccggctagaagctgactatcaccccaccctcagctgggaccctcaccaatcagatcaaaaacattcgccacccagcaacagatgaacggataaataaatatggtctagccatgcaatggaatactattcagccataagaaggagggaaattctgaacaggctgctatgtgtatgaactttgaagacattttgctgagtgaaagaagccagtcacaaaggacaaatatgatatgatgccacttatatgaggtccctcagattggcaaatccagagcagaaagtagaagagaagttactaggtggggggagggaagaatggggagtgactgcaacatttaatacaatgttgtatttagtaattatgtaaagtagcaaaaactggcctggtgcatggctcatgcctgtaatcccagaactttgggaggctgaggcgggtggatcacttgaggtaggagttcgagaccagcctggccaacatggtgaaaccctgtctctactaaaaatacaaaattagccgggcgtggtggcaggtgcctgtaatcccagctactcgggaggctggggcagggaatcacttgaacctgggaggcggaggttgcagtgagctgagattgcaccactgcattcagcctgggtgacagagggagagtccatcacaaaaaataaaataaaataaaataaaataaataaaataaaataaaataaagctttaaaaaattcacaagcagtttctctatgaaacctgcactttttaaaaaacacctaagatgcagcagtgatgcattggagaaaaaaaaaaaaaaggttcctatgagaaccctaccaggcacaccgctgaaggctacttgagccaaatggcggtgcctagttcatcataattaagacctaagccttaatccacagatggctggcatttcagtgtaggcctaagccacacctaccctgttcacagtgtctttgacagccgggaccggcaggcgagcagcgatgtctggaagctgtacaacatgggttttcggcctgaaaagatcttgaccatacctgaagagagagaattatattttcagactactgccatactactctgaaggcacctgtttcgtctgatctcgtgaagctaagcagggtcagtcctggttagtacttggatgggagaataccatttcaaagacaaggctatgttaaagatccgaagccacttttcccgtgcgcacaattgccaaccacttactgattttctgtgtcaatttatttttcatctggtccatcttttaccgccccatacttacaggttctagcaaataagcatataaccctgccctccatgccaataaagcctgggcaacatggcaaaaccccacctctacaaaaaattagccaggcatggtggcatggcctgttgtctcagctacttgggaggctgaggtgaaaggattgattgagcctgggaggggatgctgcagtgagccatgatcataccactgcactccagcctgggcaacatagtgagacctatgtcaaaaagcaaaacaaaaacaaacaaaccaaaaaaccaggtagaatcaaagccagcctgacagaggccgtgagatgtcgctgccagcgtcgtgactggccaggaccctgaccggcttctgcacctagggtgagtctcaccccacctccttccgcaaggcccttagtttcgggtgggctccaggctctaggaacagtgaggagggtcaacgtgcctggccctgagccaagccaggggaagcagtgtctttccttcagtcattgccaagtctcccagaggacacatctgtggccttggttttaggctggatgatcaagcctgtataataaccagtcacctcaatggcaaccaaacaaaggcagtccttgggcccaggcggggagtcttggtactgcagggcattgggactagctgaacctcagctgtgaacccactggagggagtgccctttagcctgctttgccaagttgggagccacccctgagtctcttctaggtgttaaattctgcttctctagaaatcagaaatttatatccaaatggtagaaaattgatttgagagaaaaaattggtttggctgggtgtggggctcacgcctgttgatcccagcactttgggaggccgaggagggtggatcgtttgagccaggagctcgagaccacctggccaacatggcgaaaccctgtctctattaaaaatacaaaaattagctgggcgtggtggtgtgtgcctgtggtcccagctactgtggaggctgaggtgaggaatcgcttgagcccgggaggcggaggttgtaatgagccgagattgcaccactgcactcagcctgggtgacagagcaagatgctgtctcaaaaaaaaaaaaaaatttgtttggcaaaggtggagtcccggtgtgtggtgggcactgcagtgactcccatgcttctctcacaagcaggtcccccagaggttgggacagcagcccagtccaggcaggcaccactgtgggggccatcccaggcgaccaagcagaagggcaccggggccaaggtcggggcagacaagaaaccaaagcagcccacggcttcgtatacaccggcagacccacggatcagccccattcgagaaagattctgagaaaatgtttccatgatgacctggtccattacaaccatttaggccacttggcaagacagggtgaataaagcagatgtttctttacacacatctggccccagaaacccaggttgggctgaggtgccgagcaaagcccaaggcccagggccatgactacaatgggcagatggtacacgggcacacacccgcctgcagggggtcacaggggccccagccccccagacggaggcctcgaagtccagagacgatgcccatcttggagggttgattttcagaaaaactaagcccataaattttttttttttttttttgagacagggtctggctctgtcccctaggagtgcagtgacacaccacagctcactgcagccttgacctcctgggctcaagcattcctcccacctcagcctctaagtagctaggattacaggcatgcaccaccacgcctggctaatttgcctggctaattttgtatttttagtagagacgtgtttttgccatgttccccaggctggtctcaaactcctgagtcaggtggttcactgggcttggcctcccaaagtgctgggattacagccatgagtagccagcccagcccccataaaaacatttaaattgagaccgggtgtgatggctcatgcctgtaatccaacactttgggaggtcaaggtgggccgatcacttgagctcaaaagtttgagaccagctggccaacaaaaccccgtctctattaaaaatataaaaattagtcagccatggtggtgtaacctatagttccagctactcaggatgctcaggtgggaaaatcacttgagcctaggaagtgaggctgcagtgagacgtgatggtgccactatactccagcctgggcaatggaacaagacctgtctcaaaaagaaaaaaaaaaaaaaaaaagctgggtacagtggttcacacctgtaatccagcactttgagaggccaaggcaggatcacctgatgtcaggagttcaagaccagcctgccaacatggtaaaaccccgtctctactaaaaatacaaaactagccaggcatggtggtgctgcctgtaatcccagaaacttgggaggctgaggcaaaagaattgcttgaacctggaaggcagagtttgcagtgagctgagatcacaccactgcactccagtctgggcaacaagagtgaactccatctcaaaaaaaactaaaatgaaaaaatataaatataaataaaaaagaaaaacattaaatcatgaaatttggacaagcatccacatatatggcaaagccattaccttaaataaggacccttgggctgagggccaaagcaagctggaggaacattccagaagctaagtctgagcacgggagcctgtctgaggggtcagctaaggtaaccatttaatgcctgacaacaagtgatcaagaacactacaaagaaccggatggacagcacttttatttgatgaatgacctgaactcaaaccgagcagacctcaatataaaatgctgcaggtctcactaatgtcacaaaagagaacactctttggcccctgcttttgtgtcatggtgactcaaacctctccagccattcaaggtgaggcccaagtcaccaaccaagcatagagggagaaaaggtcgcaggggtgtccttccgcggggtgtccttcttcccaaagcccaaactgtccaccccctccacagccagagggacacgaattaccatccagatcttggtggcacgactcatcttgccgtgctcagtgaacatccaccgtggtaggagagcagcactttcagggagtagcgcatggtgacgatgagggccacccacagccggtgccaaacagcacgccgctgaccacgttcttcgtctggctggacatgcagttgcgtggagacagacccagacaagggaggctgtgcgtgaggccacacggtgccaccaacaccccggtgacgccacagacaccacgtgctgcagggtccagcagcctgccccaggtacagccggaaagtcagagggagagcacttgcaggaactgagctcttaaaacactcacgggcactccctcctcaccccaaaaccaatcacgccgaaagtagctggcagacccaggcgcccggggcggcctgtttgctctcttcccagaggtcccttcagcccgatctgctcgggtggcctcgaaccaaccagggctaatttgtgtcttctggaaaaagatacagcttcctccaggacctcaggccaacggcagaggggatgctgtgaggccaggacctggccaccgtgagagccatgccctgcgacctgtgcgtccccggcaggtgcgcaggagattctgggccactttcttcagctcttgtgaatttttttctctcaaacttacttttagatgtaatcgtaatctcaaattatttgttaaactgttacctccagtatttatatcaaaagagcttgtttttgacttaggtgtatttaaccaaataaagaaacggactgtgtaaaacggtcatgtaaatattcaacttaaatacaggaatgtttttgtttgtgaaggaaggtagtatatattatggtaaagatgggactttaaaaatggatgaaattcagcttttttttttttttcgagacaagagtctcgctctgctgcccaggctgagtgcaatggtgtgaccttggttcactgcaacctccgcctcccaggtttaaatgattccccatctcagcctcctgagtagctgggattacaggtgcgcaccaccacatccaactaattttgtattttttgtagagatggggtcttgccatgttgcccaggctggtttcaaactccttcaggtgatccacccgcctcggcctcccaaagtgctgggattataggtgtgtgccactggcctggccagaaatgcagctattttgtggtttgttttagttttggttgttttgggaactcaaaatattttttaaatgaaaactatttaagcatgcttcaaatgattaaaacaccaataatataacctaaaggtgtccctaatatttgaaaagcactaatttggccaggtgcagtggccaagtctataatcccagcactttgggaggctgagatgggtggatcacttgggtccaggattcgagaccagcctggacaacatggcaaaaccccatcaatacaaaaataaaatttaaaaagaaaataaaataagaaataaaaaataataaaaataaaaaataataaatatttcttcaaataagaaataaaaaaagaaaaccactaatttaacactgcataatatttaagtggacaaaacaaattatcttcaaggttatatactctttgctccaaaatgtatatctttctataaccctgaaatctagcactggagtttcactgtagtctcttctttaaacctatacactcttttctgtcatctaacctataaacaaacttgggtttagggatttaagaagctatcttttagataactacattttagattactgaaagaaaaagacctatatacttacttgatttgcaaaaataaaatattttagcataaacaaataaatgacacattcaagatttttaaaagtatagacatagggcactcagataaaaaacgttagcaaaaagctttctttgaaaggacatgctccttacaagctgtcggggacaaactcagagacaaacctcacatgacacggatgactccacttttttatctttcttttttttaagagatagggtctcactatgttgctcaggctgatcttgaactccgggctcaagcaatcctcctgcctcggcctcccaaagtgctggaattacaggccaccgcaccagcctgactccacttttgaaggcagcagcccagagatactgcagatcccctccaggaaggaaatggcccatgaggctggaagacgttggcccttaacccggcctttctaaatttagccagggatggcccagtttaccaaaataggtttaagaggtacaaagaaacaaatcttacaagacccagattattaagggctttaaacagtcaacacttctatatataatccagttttaaagagcgcctacactagagagtaaattaaagaactggcctgggtgcagtggctcacgccttaatcccagcactttgggaggacaaggcgggtggatcacttgaggtcaggagttcaagacagcctggccaacacggcgaaaccccatctctatcaaaaatacaaaaattggttgggcaggtggcatgtgcctgcagtcccaggtactcaagaggctgaggcaggagaatcacttgaactgggaagcggagcttgcagtgtgccgagatcgcaccactgcactccagcctgggtgacgagtgagactctatctcaaaaagaaaaaaaagaagatattcattagccccatgagagaagaaaagtacgtaggaacagctccagacacaaggctcggaggcagctacccaccgcaggctgtgggtcctgggacctcaaggaagagagcagccaggcctgccctgagcacccaggtctccagctgctttctgagtgacagcaatgacagcagtacccaggcagacaaggaacctggcggcgtcccagccaggcatgcttctgctaaaatgactgggaacttttattatgtttcttgagactcttatagaggcctgagccagcgttcctgagctacctcaaggttgcaagcaactcgctggacgctcgatgactctggagggtccaggggcttcctggagaaggaacaggatgtgaggggtcctctgcagacccttcgcaaaaagaggttcaggaatcagggcacttgctcaagtgtcatcaggagactcagaccattaatctgcttaatcttttatttctagtcatcagaataaggctgggcatggtggctcacacctgtaatcccaggactttgggaggccgaggcgagtgaccacctgaggtcaatagttcgagatcagcctggccaacatggtgaaacctcatctctcaaaacatacaaaaattagccaggcatggtggcggacacctgtaatcccagctactcagaggctgaggcaggagaattgcttgaacccgggaggcggaggttgcagtgagccgagatccaccatcgcactccagcctgggcaacggagcaaaaactccatttccaaaaaaaaatcaattcagccgttaactgtgagtgagttttcgtttacgtctctttttctgccggtttattttttatttctttctgattaaacaatatttatatgcaaacaacctggaaggcgtgactataagatccagagcttcgttttttagcttagcccagacccggcattgtgccttccacctgcaatcctggccccaaaacaaagcccaattatgaggagttggtggctattattgacctcaggtatcgacccacctcggtctcccaaagtcctgggattacaggtgtgaaccaccgtgtccaatggcaaaaatgccattggtgtaaacaagcagcacagaaatcgaatcaaacgtctggcacgggcagcagggacacttccgagacactgtggagctttcagacccgaaagtaaaatgtgttccaagcccaagggtcacggctgcacgaggaagctgagttgccctgcgttccactgtctgacgttcaaatggtggtaaagcagcggtgttcactcgcatttgtctcacagaagcttctgggcagggggtggggggacctcagtgctacactgaagaaagcacagatttcagagctgccagagctgggtttgaactctagcttccccgctccctcttcctgtgacttgggcagacactgcacctgtctgaatgctttctcactggtaaaagggaccctaatgagaggtcactgcaggcaggctctgaccttcctagatgggagtctgggccatctccagaactggatggaataacgacatcacaggtgtgcaataaacatgtgctatcaacaggcggcaggtggttagaaaaaaaaataaaatgaacatgtgctgaatgttacctaaggtgtctctgggcttatctcttggtacaagaaataagccccaggaaaatccaaaaccctagaggtaggagggacgggggggtcccggagatttctaaaccattctgacagagttaagtgggtgaggtccctgcagaggaccccaagcagtcagttcaagggtcacagaactctggaatgaacagactccaagtgcaaagaaatactacatggggaatcagccctttgagcagaaattccatttcagagccctattggccaggtaagggcactgtcattattgaccaaaccctcgggccctgacaccttccaaggggtgcccagggccactaccactcttctcaccctggtctacagaggaaaggccgcaggggaccgcaactcctagggggaccttaacagcacccaggagacaggaagaaagctgacgtgagaacagctcaggagcttcatatggaatccagaacagtgacaatcatcacatttgaagagacataaaacagcaataaaatcggtaacttcccagacaattggagatttcacaggattacttacgcctttccagagtccgattgatttttgcaattattcctaacgaggggtcgatcttggcgtactcgttgtcatcacgcccaccaccacgataagccaactggaggggcttgccgggtacacgcagtgatgatgccgttctaaagacagacacccgggccgtgagcggtgtcctcccacaaccacagggcaatgacgcttcatggcccctggcagcagggctgctgggacagcaggcagtggaagagggtgtggacagcgtgcgtgcactgagaaaccacaccccactagctgggactctcccagagtttacagcctgcagtgattccagtttcctcccttccactacttccgagccaaacccaccctgaaagcttccccaagagtcgacgccccgggccatgataatcagcccaggcctagtttagctggtgaaggacgtcactgagccaccatgacgtcctgtccccagcctgctctgtctagaatgccccgagaccccggttccaaaactgctcctcttgccgcccctgtgtcgaagggctgcttaaccctgaagatttcatgggagacctcaccccatgtcgagaatttgcgtaaaatactccagcccaaaaaaaaaaaggattatatcaaacaaaattggcaaaattgtgaaacaaggaagggaatggtggggatctttaatcagtcctcttcactcttgtgtatgttgacaactccaattaaaaaaaattcttcctaaaccatcctaataagatattgatttcaccagataatggattaaaaatgaccaaagcaggccaggtgcggtggctcacacctgtaacccagcactttgggaggctgaggcaggccgatcacttgaggtaaggagtttgaaaccagcctaccaacatggtgaaatcctgtttctactaaaaatacaaaaaattagccaggtgtggtgggggcgcctatagtcccagctactcaggaggctgaagcagaagaatcactgagcccaggagcggaggttgcagtgagccaaggttgtgccattgcactccaacctgggcaacagagtgagctctgtccaaaaaaaaaaaaaaaaaaaaaattagccgggcattgtggtgtgcacctatgtcccaactacttgggtggatgagacaggaggattgcctgagcccagtgaggctacagtagccgtgatcgcaccactgcactccaccctgagcaacagagcaagaccctgtctcaaaaaaaaaaaagaggggaggggaggggagagggagaacaacattcccactgggttgaatatgtggccaagcctctgcatccaagtttctattttcccagattccaaggtgaaaaagagcagtctcggcgagccgagctagtgcctcagtgaaatctcggatgtcaccttggtgggttattatctgggcccaagaacccacaggctgagccccagggacacccgtgcagctgtactggctccaggggcttgcccgccatgctgtccctgctgccacctgctcttgagcttaggcctttccagtggcccacttcagtgccgccctcggagaaggagcaccgggaagtgcacaaactgaatgagttaccgctggggctggcaggggggtcagcggggggggatttccacttttgacttgtgaactttcacctagtttgcatgttttcaaacatgcacttgttccttctatgatgtttaaataaattaaaatacatggaaaaacaagacacttacttaaaaaagaacaaagttctactctttagataaacagaattgagaacatgtggactcaactgtatttgaacttgtggagagttctttttttttgtttgtttgttttgagacagagtctcgctctctcacccaggctggagtcagtggcgcgatctcggctcactgcaagctccgcctcccgggttcgtgccattctcctgctcagcctcccgagtagctgggactacaggcgcccgccaccacgcccggctaatttttttattttttagtagagacgggggtttcaccatgttagccaggatggtctcgatctcctgactcgtgattcacccgcctcggcctcccaaagtgctgggattacaggtgtgagccactgccccggaccttatgcagagagtttctaatgtgtgaatgttttataaacaaagtagttattcatccacttgctgaagtttggaaaaaatatttttttgtttttttgagacaaagtctcgcctgttgcccaggctggagtgtggtggctcaatcatggctcactgcagtctctgcctcccggttcaagtgatcctcccacctcagcctcctgagtagctgggactacaggtgcatgccacatacctgcctaatttttctattttttgtagagatggggttttgtcgtgtcacccaggcggtcttaaactcctgagctcaagcaatccgcccacctcagcttcccaaagtgcagggatataggtgtgagccactgcacctggcctggaaaaatcctatttgaacaaggtgtaaaggatctgactcagagcagaagatgtgaattctagtctttactctgcctcctattaagtaggtgctggccctttaagcctcgatttcccagcctgctttaacgcatgccaagtccctccaccgcctaatggaactgctccaagcatccagtgagctaaagtctatgtgacggtgtccccaaccttaagtaccatggaaacaggtaagtgatatgcagtcgccagtctgaaacacgtagactcaatagcagccagagccccgttcttagatattaaaaggcatactgtgtagatttcaacaatctcagaaaaccttgaatctgatgaacttctttttccaggaatgaagtccagagagaagatttgtctaagagcttcatggctcagccgcaggtcaatcccgtccggagtgaccgtgactgaaaggccacagcttggtgagcttctgccatcttcagagagtacctggaaggagaagagaaaatgtaacacagtggaacgtgtgaccagacactaaaaaaccctcatacagaagtccattccttctgaacttaagttcttcctcgccacttaacagatttaatacttttcatcacagaccaattccatcaccacagctggcacccccttgcctgtccaccgctacaaagacagcgccacctctgcttagagccccaagatgatcatcaggagtcaggcccgtggtaccccaacctggccctggacattccctggaaccacgcctccaagccagcatccaggcccgtggtactcaactctggccctggacgtcccccagaaccacgcctccaagccagcatccaggcccgtgtaccccaaccctggccctggacgtcccccggaaccatgcctccaagccagcatccaggccgtggtaccccaaccctggccctggacattcccgggaaccacgcctccaagccagcatcaggcccgtggtaccccaaccctggccctggacgtcccccggaaccacgcctccaagccgcatccaggccacacctactgacgtaaagcccacggcgcttcagcaactcgcacagcacgacaaatctcaatcttgcagccaggcccttggaggctggcattagaagaggcccagagttccacgcaggagtccacgaaggagcccacgacagccctagactctgaacttcgagcgcaatcaatcccaaatgcctctgcctctggtgtctgtgtggctgctctttcgagaaactgtttagggtttcggagagacccacgaagactccatgagtcatatgcgcagacacctcaagaagggtgtccacagacggagcgggccttcttccttggaggcagcggctgaaacggaacgtgcttggcggccccacgggctaaacggatcccggggcgctgcagtccagacccaagcacagccctggggagagcatcccctggccggctgcagaaaactgcttccggatctgctacattctcctgtacccttcatcctggctccggccgccttccttcaggctccttggcacagccgctagcacaacacagcccacccccatcccctcctggaccccccggggtggtggctcctgccctctcacggtgcctcctccacctcctcccaagctgcctgccacaaagtactaaatggataaagagaagctaagaggaaaaaactttcaaggaccataataaaaatccaaaaactcgtgttgtgtgtgtggtgtgtgtgtgtatacgtgtgtgtggtatgtgtgtgtggtgtgtgtggttatgtgtgtggtgtgtgcgtgtgtggtgtgtgtgtgtggtgtacatgtgtatatgtgtggtggtgtgtgtgggtgtgtgtgtggtgtgtgtggttgtgtgtgtggggtgagtgtgtgtgtgtgtatggtgtgtgtgtggtgtgggggggtgcgtgggtgtgtgtgtggtatgtgtgggggtgggtgtgtgtgtgggtgtgtggtgatgtgtggttgtgtgggggtgggtgtgtgtggtgcgtgtgtgtggttgtgtgtgtgtggtgtgtgtgtgtgggtgtgtggtgatgtgtggtgtgtgggggtgtgtgtgtctgtgtgtgtgtgtgtggtgtgtgtgtgtgggtgtgtgtggtgttctcaccacaggatgattttcctgttttcgcccactgatgccctctgaaggtgagtcaaaatcagtggctatcacagtttcaaagatcccctgttacagaaatcagcctgactcgtcctccaccagccaaaacacagaaccatccgctggcaggccctagaaaggcacccgactcagacatctgtccatattacaaatatttgttgactgcctccaacgtgccagccgaggaaagagctgcacaccagcagaaaaggtccctctgccctcccacagcttagaccgggctaaaagcaacgcaggagcagtgctctggtgcaggaaggggagaagccgaggggacctctcagagacagggaagccaggagaaggagcaaccatgggaagagcaggcaagagctggaggcagaagggcaggaggatggggtcaagggcaggaagctggggtcaagggcaggaggctgggggcaagggcaggtgtctggggtcaagggcaggtggctggggtcaagggcagggtggctggggtcaaggacaggctgttgggggggggtcagtggcgggacagctaaggtcaagagcaggcagcggggtcaagggcagggtgtcgggtcaaaagcaggtgtctggggtcaaaggcagggtgctggggtcaagggtagggtgtctagggtcaagcgcaggtggctggggtcgacagggtgctgggttcaaggacagggggcctagtttggagaggaaggcagaggcagccggtgggaggggcagggttttgtgctagcaatggagaagcatccaagggcccagagaaaggggaacctgcactgtttcttttctaaagaccactctggctgctgtatggagtatggatggggatggggagcaggaccagttaagaagctgaggctgtcttccaggaaggtgcatgggcctggcccacctgtcagtgacagggacagtgacagtgtggacaatgacccacacaagacagtctgcagagcaccttgagctgcacttgctggtgaaatgggccctcgggctcctgtcttgagccacccctcagtgaagccaggtactgacaagggacagtctcagggagggaaggaggcaggctgggcagaagctgagaattcatgcctggacctgccacatgtgaaatgtcaccaggacatccggtggagatgccccacatcgccagagcaagggaggagctgggcaagacgacacacccgggagtatcagcacagaacctgccagctctgcctcaatgactcggaaagagtaatttggcaaactacattccaccagctataacttcagcttagagcaatttgcaaagcaatcgacaatatgatgggccaggcatgatggctcatacctgtaatcccagcactttgggaggctgacgtgggggatcgcttgagtccaggaactcaagaccagcctgggcaacatggcgaaaccccgtctcgaaaaaaataaaaaattagccaggtgtggtggcatgggcctgtagtcccagctacttggaagctgaggcaggaggatcccttgagctcaggaggtagaggctacagtgagccatgatccgccattatactccagccagggcgacagagtgagaccctatctcaacaacaacaacaacaaacaacagtatttacatattatttagtaggcacgcagccaactcccacggcctggccattttaaaggaatggatcccatttttgaaagcagcaagatcaccaagcagatgtttgccagggttgaagagggcatcaaagcaagcagctctgaaccatttctcaaaaagctatctaagagctgtaagactcccgtggagtctcaaggttaactttttttttgagacggagtctcacttgtcgcccaggctggagtgcagcggcgccatctcagctcactgcaacttccacctcccggttcaagcgattctcatgcttcagcctcccgagtagctgggcttacaagtgcctgccacacgcctggctaattttttctatttttagtggagacagggtttcaccatgttggccaggcgttcccgaactgctgagctcaaatgatccgcccacctcggcctcccaaagtgccgggatactgctatgagccaccacgccccgcctcaaggttaactcttagcccccttccccatcaagccttcgcagtaaccatgaggaaggcatcccagaagaggactctgcaaagcatgcacggggcaaataaagtgacgtgactggctacctctgcacgattgataagatctcctgggcttctacagaacacaaaggcattattcatggcagtggattaaatatagcgtctgtagccaagtcctccaaagttatgtatccaacacttgctcagaaatctaacctctgataggaagagtcaactggaggtaattatagtgtcctttctaggagtgaaacgccctcgcagagcgatctgagttaatgaaggacttgtttatttggactggttcagggtaaccctaagagttctaaatgccctaaggtgcacaatttgtttttctacttctgcaggagctgagatgggctgtcctgacctgcctctccctctttgagccatgagcagaaatgagtgaatccaacaagggccagaggagcccctgtgcaaatgtaatgagcgcaaatcccaccctgggttctggcctggatcagtggcctatgcttaaaaacactgatatagccgcacctacagcagtcccctctcagctacagtttgacgtttgtttgtttgtttgtttgtttgtttgtttgagacagggtctcgctgtattgcccggctggagtgcagtggcacgatcatggctcactgcagcctctactccccaagctcaggtatcctcccacctcagcctcctgagtagctgggactataggcatgcaccaccatgctcagtaatttatgtatttttttgtagagacagcgtttcaccaccttgcccagactggtctcgactcctggactcaagcgatccacccatctcagcctcccaaagtaccgggattacaggtgtagccaccatgtctagtgattttgctttttgaagtctcagttatccatggtcaaccaccactgaaaatattaaatggaaaactccaggcttggtgcggtggctcatgcctgtaatcccacactttgggaggcccaggtgggtggatcacttgaggtcaggggttcgagaccagcctggcaacatggcgaaaccctgtctttactaaaaatacaaaaattagctgggcatgttggtgctgcctgtaatcccagctacttgggaagctgaggcaggagaattgcctgaactgggaggcgaggtttcagtgagctgagattgcaccactgcacttcagcctggggtacagagtgagacccatctcaaaaaagaaaaaaaatcatagttttcgattgtgcagcattctgagcagtatgtgaaaactcccaccgtcccactccctccttccagggacgtgaatcacccctttgcccagctacccatgctgtcaacactccctgcctacagggagttactacacagtagtactacacagaaaacacctcgtatacacatctgtcccccggaatctgagggggactagttgcaggaccccatgcttaccaaaacccatgaatgtgcagtcccttatagaaaatagtgtagtatttgcaataacctacacacatcctcctgtatatatatttttttgagacacagtctcgctctgtccccaggtgggagttcagtggtgcaatctcgggttcaagtgattctcctgccttaacctcagagtagctgggactacaggcatgtgccaccacgtctggctaatttttgtatttttatttatttatttatttttgagacggagttttgctcttgttgcccaggttggagtgcaatggccggtctcggctcactgcaccctctgcctcctgggttcaagtgattctcctgcctcagcccctgagtagctgggattacaggcccccaccaccacgactggctaatttttgtatttttatagagacagggtttcagtacgttggccaggctggccttgaactcctgacctcaggtgatcacccgcctcagcctcccaaagtgctgggattacaggcgtgagccaccgcgcccggcctcatttttgtattttgagtagagacctggtttccccacgttggccaggctggtctcaaaccctgactttaggtgatccacccacctcggcctcccaaagtgctgggattaacaggtgtggccaccgcacccaaccctcctgtatactttaagtcatctctagattacttacaataatgataccttataaatgctatgtaaacagttgttatgctgtatttttattttgtattatttttgttattatttaggttttttctttttccccaaatgttttcaatccttggttggttaaatcacagaagcagagcctgaggatacaaagctgaccatataggtttggttctgtccgcaaatcaggcacccaccaggggtcttggaatgtatccccccaaggataaggggggaccactgcagtgtaagactgcctcctgtggccaatagggagtgcagatctaaaccataggaaaacacacttcacactcaggaggatggctagtatcacaaagatggatgatagcaagtgttggtgagatgtggagaaatcagaattctcatgcatggctggtcaaatggtgcagccacgttggcaacagtctgtccgttcctcaaaagcttaaatacagagttactggcctggcaccgtggctccacctgcaatcccagcattttgggaggccaaagcagaaagactgctttaggccaggagtccagaccagcctgcgcaacatggcaagcccctgtctctgtataataaacaaaaataaaaaaaaaataaaaattgggccaggtgcagtggctcacccctgtaatcccagcacttcgcaagccaagacaggagggttgctttggctcaggagttcgagaccagcctggggaacatggcagacctcatctctattaaaaatcaaagaaattacccaggcatggtagtgcattgctgtaacctagcaacttgggaggctgaggcaggaggatcgcttgagcccaggaagtggaggctgcatgagctgtgattgcaccactgcactccagcctgggcaacaggggagatcctgtcttaaaaaaaaaaagaaaattgtagaaaaatagacttaccatacgacccagcaattccatttctcatatatacccaagagaactgaaaacatgtccatacaaaagtctgcacacgaacactcaaacatcattcatgatagccaaaaagtggcaatacattctgctgatgaatggataaatatatgtggtccatccatactgtggaatagtattcagcaatgaaaaggaatggacctccgaccctgctgcaacatggatggaccctgaagacgtgatgctgagtgaaagaagccatacagaggtcatatattgctgattctatttattctaaatgtctggaacaagcaaatctacagagaagaaagtacactagtggttgccgggggcttggagcagatgggaagatagggaggtcatggtaaggagttgggggtatcttcttagggtgatgaaaacattccaaaattgattgtggtgtagttgcacaactctgtgaatatactaaaaaccactgaaagcctgggcaacatggcgaaccctgtctctgcaaaaactacaaaaattagatgggtgcggtgatgtgtgcctgtagtccagctactaaggaggctgaggtgggaggatcacttgagcctggaagttcgaagctgcagtagccgtgactgcaccactgcattccagcctgggcaacagagcaagaccctgtctcaaaaaaacccaaactcaccgaagtgtacattttagatgggtgaattttatggtatatgaatcttcaataaagctgttaccaaaaaatactgtctgaagaagtgttatctatttaatgtctatcacctaaccattctctcctcaaatatatgatggtgggggtggatatgttattattttctccatatcctgtccaccataatgctctggtcacattaaggactcattcagcagccataaaaagaatgaaattggccgggcacggtggttcacgcctgtaatcccagcactttgggaggcgaggcgggaggatcaactgaggtcaggagttcgagaacagcctgaccgacatggagaaacccatctctcctaaaaaatacaaaattagccgggcatggtggtgcatgcctgtaatcccgctactcgggaggccaaggcaggagaatcacttgaacccaggaggcagaggttgcagtggctgagatcatgccattgcactccagcctgggcaacaagaacaaaactctgtctcaaaaaaagaaagaaagaaagaaagaaatcatgtcccttgcagtaatatggatgcaactggaggctttatcctaagtgaactcactcagaaacagaaaaccaaataccgcatgttctcacctaaagtggcagctaaacaatgggtacccatagacataaagatggaagtgacaggccgggtgggtggctcacgcctgtaatcccagcactttgggaggccgaggtgggcagatcacctgagtcaggagtttgagaccagcctggacaacatggtgaaaccccatctctactaaaaataccaaaattagccaggcgtggtggcagacgcctgtaatcccagctacttgggaggctgaagcggagaatcgcttgaacctgggaggcggaggttgcagtgagctgagatcgggccactgcatccagcctgggggacaagagcaaagctccatctcaaaaaaaaaaaaaaaaagagaaaaagatggaaataacagacattggggattccaaaagggaagggaggcagcagggcaagggctaaaaattacctatcaggtacaatgttcactctcttccctttcatggagggcactctgggacaccagaaacccaaccccaccagtatgcaaaatgcctgtgtaacaaacaggcacgtgtcccccaaatctaaaattaaattaaatttaaaaaaagactcattcaaaacaactgttacccatggcattaaggaatttctgtgaattatcttttaggtattacaagatattgtggttatttttttaagagacagagtctcgctctgctgcccaggctggagtgcagtggcacaatcacgctcactgcagctctgggttcaagcaatcctcctgcctcagcctcctgagtagttgagacgtgggtgtgagccatggcactcaggcagtggttatttttaaaaagggttcccatctttattgatacatcctaacatattgctacatgcaattgtatcttttttttttttttttttttagactgttgagtcttgctctgtcgcctaggctggaatgcagtagcacgatctaggctcagttaacctttgcctcccgggttcaagcaattctcctgcctcagcctccccagtagctgaactacagacacccgacactgcacccagctgatttttgtattttcaatatagcccagattcaccgtgttggccaggctggtcttgaactcctgacctcaggtgatctgcccaactcggctcccaaagtgctgtgagccactgtgcccagcctaattttatcttttatcatatctgggattgcttcaaaatcacttggggtgggaaaaatggagggacgggtaggaaggagccatgtggagaacgggtgaagggcagggctgtgcaagcccggtaggtaagtgtctcttctacgcactttgagatctcctgatgttttagaatgtgttgaatgaaatgaaacattcatctgctgcattggagctcaaaaatctcatgtttggagagctcctcagatactccaagtgccccaggtgccacctcccaggaagggaagcacacacttctcaccccatagcccacccaatacaacaggctggcagcagagaaacggcgtaacccatccggagccagggaagataaaaccaggaggagaaaggtttccggggccagagcatgtggaaagttggccatgcccaagcccccttaccccgccccactacccacaatctggaaatacctgaacagtcaccacctgcttgcccaacccaacggatttttatgaccctggtgtaaaaaggatgagaaaggaaaagcagggcctccccccaggcccgcctccccgagtgcccgcctccctccagtgcctgccccccacctcacccagccagctcttccaggtgcttcctcttcaggcaggaggccacactcctggcccacgcagggacttacctctccccagaagagggcacacctgctccctgcctttcacccagctgggagtggatgagagtggcagcttctcccacctctgagtcaccggaaacaaagccgggggactgcagaagcacgggcaccatggcttcacagaggccaacccaccccagtgagtgccacccagctcctggccagcctcactcactccagacacagggcagagggttcctaatgtctctaaaaccgaggactcataagaatggtaaccagataaagccattcgcaccacacccgccttccctccctggcctggagagtagagggccccagaccagagtctgagagtggtcagcacgtttcctgccttatgtacccccgcactgaaagccaacctgaggccgggcactgtggctcaggcctgtaatccagcactttgggaggccaaggtgggaggatcactgtaggtcaggagttcgagaccagccggccaacatggtgaaaccctgtcactactaaaaatacaaaaattagccggatctggtgggcacgcctgtattcccagctaactgggaggctgaggcaggagaattgcttgaacccgggggcagaggttgcagtgagccgagaccaggccactgcactcctaggtgagagagtgagacccgtctcaaaaaaaaaaaggtcaggcgcggtggctcacgcctgtaatcccagcactttggaggccgaggggggcagatcatgaggtcaggaggtagagaccatcgtcgctaacacggtaaaccccatctctactaaaaatacaaaaaaaaaattagccgggcgtggtggcgggcgccgtagtcccagctactcgggaggctgagggaggagaatggcgtgaacccgggagccggagttgcagtgagctgagatcaggctactgcactactgggtgagagagtgagactccctgtcaaaaaaaaaaaaagaaaaccaacctggccctcagcgtgactttctgtaacatactttactagcacaaacgggattcctcaaagtaaatcgggtctgcggcctcaccacactggcataacaggactgggactacaggtggctaacctcaccttcctggaaacagacagcagccaggtgggcaggtgagcagctgagactgggatgggcagacgacaagcccagggccaagggcgcaagctcttccaaggacctggtgcttagggaggaggagtgggggtgaggtggggtgtccaggggaagaacgccagtcactaataaattcctggacctcagataagcctcacaaaaactttggaggccaaggcgggcagatcgcttgagcccaggagtttgagaccagcctgagcaatgtgaaaatctcatctctactaaaaatacaaaaataaaccaggcgcggtggtgagcacctgtatcccagctacttgggaggctgaagggcgaggctcacacaagcccgggaggttgaggctaagtgagccatgatcacaccactgcactccagcctgggcgacagaacgagatcttgtctcaaacatacacatacacaagctccagtgaactttactatattatacagcaagactgtttttgtcttaaatgctttaaatcataagataaccgcaaacacacaggcaagcagagaataaccctgtgtaccctcctggaatcaacaaatttaacattttgctgtattgatttagaatgtccccctaccccaccccacccccaccagtttgtttgtttatttttgtttttgtagagatggatctcactatgttgcccaggctggtcttgaactcctggactcaagcagtccttcctcttggcctcccaagctgctgagattacaggtgcccagccctgcaaaaatttctaagatgcaaagatacaacctcctctccctgtccccagaatgcggggctcatctttccctacgtatttggtatctacaagtgcatacagtgccaccacacacgtgcgaggcacacacaaatgctgcctctctgtgcgcggtcctgcaacttgcttctcgtccacattgagttccaagctgccccacgccacctacacagccctggccctgctgtcctgcacccccctgctggcaggaaccagtctgtcttgtgtccctgctggggctcagggaacttctctgttcactttttcactgttgcaaacaagaagcagacagtggccttgtccatgttgcagcatcgtattttaatgggagtagaaaagagcatagtgttcgtgggcacccctggcctctggggcagacttccttatgcctgccctgcctgcctgctctaccaaagttccagctccttcttgatgtggtcatcctgccctctttgccttgctgaagtcccaccagctgctcgacaccccatctccctgtgtctcccaagtcagcttcccaaggcgtctgagtgccctgcccacctcgccatcgctgccacatcggccccagccagggcttcttggagaggggggcatactccaccactttgcagcctgtgttccttccgcttcgtgtgtccagaatgggccacctgtccgctacagccaggcctgggtcagggccccccacccccacctgcgtgggagtccctcaccaggctcactgcgtcttcccctccccagcacctttatcgagggcaggaggccagggcacccatgtgttacaactccccttcccggaagccttcctggggtcttgggcacaccctgccagactgggcactgtggctgggagccccagcacgctggagaagggcccttaggccagctggcagccaggcctgcgtctggatccaggccaccaacatgggcagcctctttgctcaccccttcagccttcctgaggctgtagtgaggagggtggcagggcatggcatggcctgaggcttgggcaagcgtccgcctcctctggctggtgggggctcgccacatcccactcacggtgtacaactaaaccgttagtctctgtgggccagccccacttccgttccttcttcctcctgggggaggccaccaggcacgcaagctggccccggtccatctctgctgccttgggcccctctggcttctgaactagtaggtggctccccctgcaccctggggtcagccagccccccaggactttagcttcaacctgagcacactgcacctgaccttccaacacgtcttcacccagccaaaacttcaccagctgacaatgaatctcaccacctgtccacggcccgcatcctccccagggtttctcttactgagaacgccggcacctgccctgcctgggagaagcagggatggactaggggtgttcactccagtccccagaacctgctgatgtgaaggtcccgggccgcgtgtcccaccagcaacacgtccgctctacagcccagccttcctttctccagccacccccatacagagacttcccagagagacctgcccaacggctctttaatccacgtaccccaggggccggcctatctgcagcccctctccttctgtgattttcttccatgcccagtatcggagacatatcacagccctggtgggaaaaggtggtgtcccgggggacaaagtttaacagcgtgaccattgggatccaagctgcacggcagggcgtgcacctgtgccccaagttcaggatggctagaggagagaacgcttttactggaaaggcagaaaagaggaggaagaaaagtaaaaggaagaaatgagaaaatacagaaaaatacagatggatgaaaagggaacttaaccctcccctgtcactcactcgttcccacaaatcatcgcggagccctcggacgggaatcccgactagccctgggaatggactcgtggaggaggcagctctgggtaagtaaaacaggaggaccttgggtgctgttcctgagctaagacccctccttgctgtgtgcccctgggccagctatgagtaaatcggaggtggcggcaacaccccggcggcctccaccacaccaaaaacaacacatgtctggcattgtcatggggccgcggatgtgtctattttcactgaaagtacagaaatcactctgagaagctggcatggtggctggggcctggcctgtacctctgccccaagtggacacggccctgaaaggctgagtgggaggccaggtgcagtggctcacacctgaaatcccagcacttgggagggcaagatgggaagattgcttgagtccaggagttcaagaccagcctggccaactggcaaaactccttctctgccaaaaatacaaaaaattagctggatgtggtggcgcacacggtggtcctagccattctgggggctgaggtgggaagatttcttgtgtctgggaggtcgagctgcagcaagcccggactgtgccactgcactccagcctgggcaacagagtgagacccttctcaaaaaaaataaaagaaaggctgagtggggttgggggattgggggtggagatcgccacctggagcccacctgctgggagctcacacagacctccttgcccggagcacacggggtgccaccaactcccaggtggagcatgggagccaggccacatgccatcctggaggctatgatggactcatcactgaggtctgtgccatagcacttaagcaccttatgctaatctgctctcgaaccacacagagatgcagaataagaggccccagccaaggctgcaaccccttcatcacaatgtcacaaatccgctgtcccgtctccagctcacctattccatggttgttcctaccacctccaagctcagctctccctgtcacctgcccctccgccaggcccaccagccttgacctatgcactaactggctcgcagctgggaagtcttcagctctttttccatttctgttttctccttcttcatacttagcttaaagctcccagcactttagggggcagcccacgaatccaaactcccaagaaattctacaagagacatttagcaatgtcacctgcaccagctggcaaatgaccttacttgtgagttatgtgtccagtcttccaaatacacttctcaaggacatgaatccttgtgcatccgaattgaatcctgaagactatggacagttctccaacgctgaatgctacatcaacatcgtgggggggaaggtgataacacatcttcaattttgcttacgattaacttcattttacaactttgctcaatatcccccaaatccttggccaataaactgctctggtactttgtttttgaaagtgttcactttgttccctttctccataatcaattccttttaaccaaaacctttccctctttcgaagtcattggcctatgaatcctaacactggccacgtaatcaagaagacaccaacacaggtccctatgccctttgagcaaacctccccactcctgcacccccagtcctgcgagctgagacaggcaggtggctgaggaaagcaggtgaaaggtcagcttgatgcaccgtgattgccaggtttcaaaacacgcccaaggaaaatggagatatgggacttgcctctgtaattaaaacaaacaataaaacttgatacgtgacaacggacttccaagaaaatggtctttatacaactgaaatatgtaaataatttctgagtggggcagaagtctttcaacacagccttgcatcaacacgtatggagatactaatagataggtgtgtgggaaggtaggtaggtaagacataagattcctttttgtgcttttaataatgaagttacagcacattccttttttttttttttggacgaagttttgctccatcacccaggctggagtgcaatgacatgatctcggctcacagcacctctgcctcctgggttcaagtgattctcctgcctcagccttcccaggagctggaattcaggcacgcaccaccacgcctggctaattttgtatttttagtagagatgggtttttacctgttgaccaggctggtctcgaactcctgaccccaagcgatccgtctgccttggcctcctaagtgctgggattacaggcatgagccactgtgcccgacccagaacattctttttaccaaccctttggcatatgctagacaatgtgacccatatatatttttatattgatgtatttgacagcattagatcatttaattcccactagcaccctaggaaatgggtactagggctatctcctgtactaatgagaaaaccagggcttagatgtcaagaaacttgcccagtgtcacagccagaaatagcagggctggaaatcaaacccaggcccaggccaggtgcggtggctcacgcctctatcccagcactttggcaggccaaggcggacagatcacctgagctcaagagttcgagaccgcctgaccaatatggtgaaaccctgtctctactaaaaatacaaaaaattagctgggcttgtggcatgcacccgtagtcccagatactagggaaactgagacaggagaatttcttgaactggcaggtggaggttgcagtgagccaagattgcaccactgcactccagcctgggtgacaagcgagactctgtctcaaaaacaaacaaacaaacaaacaaacaaacaaaaacccaggtcaactccaaaacttatactcttaactcccaaagtaaagtggtaggtactacacaaaaagtctacttaggattcctaaagttacaacacagatataaaattaggtcactgttgtaaccaaatgatgagattgcagccagcaataaaactccagtaagtataaacaccatcagtgccaacgtaaaattattcacatgctgcagtcttcccactagcattgcacagtgcccatgcacacagagcaggctctgctttctattcaaacctagctaacagctgcccatctcctccagcggtaacaactatgttggaaatcctctgagaaaatgttacccatgggaagcgacagcttagctcgcaggaataccaggcagggcctctaggaacagagaaagtgtgaggctggatgacatgggctcatccctggaaaaactggagaaggcgctgtaggcagggtcagaagcagtgtctctgggaagggcagggcagttatctcatcatctacaacacattcttggatgcccgggtgaccaagcctgggaagattctgcttcgctagaaagctagtgccagcctccgggactggctccagccggggaaaccaccttcacaacatgcatgatttccaaggtggcaaaaatctggcctggcccctcactgctgcccaaagaacttcaagggaagtaccaggaaggctctggaaggacagcacagcccagggggttccctagaactagcacacatgtgcagtaaagttcatggctcttctgactgagatgcaggcaaaaattagcaataatgggaaggaagaaaagcagcagctcctctttccaggcaagtgtgggtgtgcgctctctgcactgtatgagccacatcgttattcaattgagatatgcacatctgtaatggtgcccttgtacttttccagtaaatgtgtatacacacaacagaagttgtttcccaaacttggctgggcgtgttggctcacgcctgtaatcccagcacttgggaggccaaggtgggcggatcacctgaggccaggagttcaaaaccagcctggccaactggtgaaaccccatctctactaaaaatacaaaacattagctgggtgtggtggtgggcactgtagcaggagaattgcttgaacctggttggtggaggttgcagtgagccaaggtcccacaccgcactccagcctgggcaacaagagcgaaactccatctcaaaaaagaaaaaaaaaaaaaattgtttcccaaacctgatggaagcaccttagaagtgagaatgtaagactcaccttagtttttcggagggtttcatgtacaagaaaggtgaaggattttcattattatttttttttataagacagggtcttgttctgttgccgagcgtgaccttgaactcctggctcaagagatctcttgcctcagcctaagctgggactacaggtgtgctccactacacccagcctggagcttcattatgaaaggttgcgtcttgaattcatgactgatcattcaatattcacattatttaattggccacacagtggatttcctgtactgaagtttatcataatggactattcacatttatgggtcaatataatgggtcgtcaggttataaaaggaattctgggctgggcacggtggctctgcctataatcccagcactttgggaggctgaggcgtgtggatcacctgaggtcaggagtcaagaccagcctggccaacgtggcaaaacctcatctctagtaaaaatacaaaaattagcaggtgtggtggtgggcacttgtaatccagctattcgggaggctgaggcaggagaatcgctgaacccgggaggcagaggttgcagtgagccgagatcatgccactgcaccccagcctggtgacagagggagacttcgtctcaaaaaataaaaataataaaataaaaggaattctggacgggtatggtggctcatgcctgtaatcccaatactttggcaggcgaaggcaggaagttcgttgagcccaggtatttgagaccaatctgggcaatgtagcaagaccccatctctacaaaaatacaaaaattagccaaggtgtgggtagtgcatgcctgtggtcccagctacttgcgagttcactcgagcccaggagtttgaggttatagtgagctatgatcacgccactgcactctagctggatgacagagcgagaccctgtcttaccaagtactgtaaaaattaagccaattctggtggatcacttgaggtcaggagtttgagaccagcctggccaacatgatgaaaccctgtcttactaacaaacaaaaactacctgggcatggtggtgcatgcctgtaatctcagctactcggaggctgaggcaggagaattgcttgaactggggaggcggaggttgcagtgagccatgatgcgccactgcactccagcccgggcgatagggcgagactccatctcaaaaaaaaaaaaaataagccaattcaaatttagaccttatagtgcaccacgtcaataagtaatggttagataatacagacaaatatgatcttagaaaaaaaatttggaaaagccacaaagattcacaatttttaaagaagatagccaacgtattgacagacccagttatctgacctagctattcagaagccaccagaagtttaacagctgctacttctttcccactgtgcctgccctgcctctagccagctcggcactcgggcaggagctcagactgcaaggaggagacctgcacctgcccaaaggacacctaaacctcctcttcgtaccagtatattgttcccacaaatgtccctaagacaacaggacggtgtcccctgtatctcccatgcatattcttcacctttgcacagaatataacaacttgacttctaattcaaactgaacttgaactgaacttctaatgtggggactgcaaaatacattgtgtccctaaatgccgcctgcagccaggacattgtttgctagagcctgtatttactttaacactcaaaactctcttcacatctgacctctgattggatcctcacaaaactcgtgtgactggaatgacaggttcagacccaccaccttacagatgaggaaatggaaacccagaaacccagaggcggattcagtgccacacccagtctgcatggggtagggagtgggggcctccaaaaccaggccctctggctgcccagtggtctgggaagcagcctgggaaagggaaagaaaacaccagatctgggttcaaatcccagctctaccaattactcagacctgtgaccttgagcaagttttgcctcacataaagtatgcaggatgcccttacctcctccggcaaactgcaggaggactggcagccagctctgacacctgttaggtctttactgcaggaacacgttctttgtcccttccaactgtagccctgtggtgccaatgcaaaccctctaggaatgtggatttctcttcctactgttgcacccccaccccatgccaaatctcaatgccagcatttgataccttctgacttcatgtataccttttagcaatctgtggttgtattttgtgcaaactgtactggacatcacatgagccactgtgtgtatttgaagaagtataaagaaaccaggaagcccggcgtggtggctctgcctggaatcccaacgctttgcaaggccaaggtgaaagggtcacttaaggccaggagtcaagaccagcctgggcaacatagtgaggcctgtctctacaaaaaaatataaaaaattagtaggtgtggtggcatatgcctgtggtcctagctatgtaagaggctgaagaaggaggatccttgagcccaaatgggagattacgttgagctatgatggcaccacggcactgcactccagttgggcaccaaggcaagatcctgcctcggaaaaaaaaactcctggcgcagtggctcatgctgtaatccccgcactttgggagggtgagtcaggcagatcacctgaggtcaggaattcagaccagcctggccaacatggtgaaactcatctctactaaaaatacaaaaattaggcaggatggtggcatgcccctgtagtcccagctgcttgggaggctgaggcaggagaatcacttgacccagaaggcagaggctgcagtgagccgagatcataccgctacactccagcctgggcacagagtgagatttcctcaaaagaaagaaaagaaaagaaaataagaaaagaaaagagagaagaaagaaaaatgaaacaaaatctccaagaaaagaaagggaaggaaggaaggaaggaagaaggaatgaaggaaataaagaaaaaggaaagcaaacctccatgtattaaatctttttcaggcaccagaggagatgacagttggcaaatcagggataaatgcttttataaatgaagaatattttataaaaagtcaaatttcagtgatagcatatgacagttttgtctcttctcttctctttcttttcttttttgagacggagtcttgctctgtcaaccaggctggagtgcagtggtggatctcagctcactgcaacctccaactcctgggttcaagcgattcccctgcctcagcctccgagtagctgggattacaggcgtgcatcaccatgcccagctacctttttgtattttagaaagacgaggtttcactgtgttggccaggctggtctcgatctcctgacctcatgttccgccatcgtggcctccagaagtgctgggattacaggcgtgagccactgcgcttagctgacatttctccagggcatcagaacacagcgttaggaaagctgtctgtggtgactcaatgtgactgatgaccacaggaccccctgagtgagccagggctggtgggcgaagcagacatcactgcgagagctagcagcttgctgtggggagagaatagggacgtggtctcgggtccagatgtcccagccacagtagcagcatgaaggaaggtgcattgaggggggacccaaatgctcctctgcccctgcctccctcacaggaacttcccataacacaaacaggaataacagtgcccctcgtcggcggttatggcaatccagagtggaaaaagggtgcttcgggcagggcgagggggcttatcctgtaatcccagtgctttgggaggctgaggtgggaggatcgcttgaggccaagagtgcctatgattgcgccacggcactccagcctggacaacagagcaagaccttgtcactaaagaaaaaaaagaaaggatgtctcaaatgttctgtcattccttcaacacatatctgaatgtctctctgggccactgaaataatgaggaaggtgaatgtaagggtgagttaggaagaagtagcgcacttagccccggctgcatgtgggggcttagggaacaggaagaatgcaggctggctctcggctcctgggctgggtaccacaaaccacccgcatcaggagtatgaagccttcctttctaacataaaggacttggtgtccaatgcctaacctatatccctcaggaagcagagcggtaccaccctactgcccaaccctccaaggtgacggtgaccctcctgcacaccctggagagggccgcctcactcagcagcatgatttctttcattgttaacttccaaagacgttcctggaccgagaacaatcctcaccaaaaaaaaggcaaaggcagacacttctgaggccgtcaagataccaaatagggtagctggcctcagcccagggcctgctggagatccaaccttcacctgacattggatggggtaaaagttgaaatttacacaaggtaacaaatatttgaagctagcaagcagaaaaagtccttacttgtgttaagcaatcaatttgtttaaaaaacatatcctgtacatgtctcaaagaaactggtaatagtggtggcatctggagaggggaaccaagtgagaaggactctctctgtatctgcaccttttaaaaaaaaaaaaaaaaaaaaaaaaaaaaaaccagagacaggtctggctgtcaccgaggctggagcgcagtggtgcaatcatagctcactgcagtctccactcctgggctgaagccatcctcccacctcagcctcctgagtagctgggaccacagatgcctccaccaggccctactaattgtttgtagagacaggggtctggctctgttgcccaggttgtctcgaattcctggcctcaaagcaatcctcccaccttggcctcccaaagcattgagatacaggcgtgagccacggggccgggcccatctgtgcctctttaactttgcatcgtatgctatatcgcttatttgtaaaaacaaaacaaaacaaaagtcttcacaagaaaagctcaagacggcagaagacaagtgaggcctctttaaagtgtgttggagagattctcgagagattctctcaacacactttaaacaaacaatctcgaacagccattttaattcttaaagcaccaattctccggaattcaagttcaggcttccaccagcaacagaattctggcctgccaataataaccagcagagtgactaaacattttttccaacaaaggaaaaaatgcaaacgatcaaagtgcagagcagcccttggcccgcgcaggctccggtttccgcctcccgccgccgctgccaccgccccgcgcctttagatttcgggcagcaagtttaattgctcgcttggaaagcgtcctcggaaggcaccgccagcaactgcggcttcgcgccccgccccttcccccaagccccgggcggcgtcagtgacggctgagaaaagtaggggaaaggtcagcagcagccccgcccccaggctggcgcgcccaggcgctcggatcctgttccacccgccgtgcccacagagaccttccggagcgagttgcgcgcgtccctgtggccaccccagcgacagcgggagaaatgcaacgcacctctccgtggaaggtcgagccctgcggtgcccagctgtggggacagctcggtgctcagtgcttctgatacagatgctgcatccaacgagccagaaacgcaggcaccgcgctcaagagcccagggcgctctaaaaggggctcactgtgaagcctcagtgaaaactgacggtgtttttatgaatgagcctcggggccagggttgggtaagggcaggccctcgttccagggctccccggaggcccaactgaccgctcggtgaccactggtccggggccggggccaaacgcagcagccgcagcagtatggaagggacccagtttaattctcttcccctccagggtaggcggcttgtttttagtaccactcgaaacgttattttggcctgtgcatgatgccaacttctgccactttgaaacaaagtggtgcactcccaaacctggccctttttattgtttgattccaactgttaagatagggttcagtgcaaggtctaggctagcaatgcttcacaggaaggaaaccagtaatttacatgcgaaagcagtccacaggctcttggtattgaggcaaaaccaatccaaagaaccagctgcgaatgcgatagtccccagaccaactgacagctggatgttcgctggcctcagcggtgtgcattctcgcgacacttatgtcctcaatttattgctacgttcactcggtcagagtcgccttaaagaattggaaaggcccgggggtgggggtgcttcctggcataaatagaagaccagtgctcagccttttttattcacttggtttgtggcttagaatgaaataaacatgcttgcatatctggaataccagaaaccggacacctgtggaagaaaatggtgtaacaaaatacaacgttgcaaaaggaaaaccgattttcattttattcggtaacttacaaagttaccagcttcctactaaaatctcccttaaatattttataacacacggagccgagaggaaccgaaagcctgtgccgagttggaatattaactttgttatgtatttaacctggtaggtagttgggatttttaactctctgagtgttttctttttttaaagtaagatcggccctcatctttgagttctgcggctttaacgaagccaagggcggatttacattataaagacgctgacccatggcctctcctgacaaaccgaagaagccggctgttggctggccgcggcggtggctccgagaaggggctgccccgcgtggcctgaccgcaccgtcgggctcgcaggccaagttcgccagggcacggccacgtgacacccccccctcccgcggccccgccgctcccagcccggcacgaccttgggcacatgctccgcgccccccgcccttgacccagcgctgcacgggagaggctgcggggcgctcccaagcaggcactggcccggcaccctcatcctgctcacggcagcgctcggaccgcgcctggagtccctgcgccagggcgtgtcccgacggctgcaccgcgagggcgggcatggggagggggaccggggagacgacgctgggatggggtcagcggcgccctgccgaatcccgagggccgagcacccctccctagccgcactgcacctgcccgtaggtgaccaacccacgggcggacccccagacccaatccctccagagccagggtgggatgggcagggacaggagccggaggccctactggccccgggcaaggcatcctggaaagcatccagagcgtccagcatccctcccgcggccacccgcaggctaccgacccctgggcagaccctcagactcaatccagtccagggcggattaaggagtgggaacaagggagccggtggccccgctggccccgggccggaggcgtccagccaagtccggaggccgagcatccctcccgcggccgcacgggacccgcctgcggatggaccgacccccggtggccctcagacccaatcccctggggaacatggggagccccggcctctttctgggttcaggactccacaaccccgccgtccggggggaataccggggttcctctcggcgccccggttccggggcgtcccccacccggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgtcccccacccggtccggttcccggcagccccgcgccccgccgtccccggcccccgcagcccgcagggccccgccaccctccccaccgcgggcgaccgggctcaccgagtcagctacggaggtgcggcacggcacgacggcggcggcggcggcagcggcggtggagtgaacgagcggcgagcggaagccggggaaggagggccgcgggcgaggccgagccacccgacgccggcagcagcggattggctgaggcgggtccggctgcggcgcctgcaggcggtgactcccggcgcgcggaggggggcccggggcctcggcggggcggggcgtccgcgggctaggaggggagggaaactgaggctcgagcgggtgctcgcgtcctcgacctctgccggatggggtctaggacgagattcctcaccctccgagcctcagtttcctcatccgtaaaacgaccatctcgtggaggccgtgcgcataaaatcgcttagctccgtgcctggctgatcctcgcacttatctatcggcattgccccgtgtaatgctccaggcaccccctgatggtattcaccctgactctttcatgcagacaagggtcgcgggccaggaaataagttaccccacatcaccgactgagaagcaaccgatccacagggagtggtggggcgcgcctgtaatcccagctactcggaggcgggaagtcgcttgaagccaggagttcgaggccagcctgggcaacgtagcgagacccgtctctaaaaaaaaaagcgcggggaagtgatagatcggacattgggtccagatctgatccacagcccatgccccaaatcagaccttataccacgagtggcagtcatcgcgatccagagcagcgtggctcctcctcatctagctaggataaaaatgcctcacttggggggctttggtagatttactaaaataattcttccagcgtcaagaacataataggtgctgggagaggagtactggaggccagggcagagcgaccgagagacccttgtgctggagctcgggagaggggccggagcgggaactgaacatccaccggtcccaggagtctagggcgagcgcagctgcaggggaccagggggttgagggggagggagaggggccccaagcgtaacaggagggccaagggggtctcctgaccgggagccacccctcccctatctttgcccgcaatgcttccaggcgcgagctgcggctctgcatacagcaggtgctccataaatgcaccgatgttatgaacaaagactctttaaacctcttttatgaaccctgctctttttaagttcgaccacttcttctagttatgaaaaatccatgtttgcaaccatccttctttctgtatcatttagttgttaccgcagaagaatttgaagagaaaatgaaagttctcctttgatcccgccccccaccaccgctgcagttaactctcctgcggttcccgggctcgctgttttaaaggaaggctaggatgcaagctgtctgtaaggtgttttgttttcacttggcttacgtcgtagacaggtctctgctgggggacggagatgacaccggccttcccaaggctgcataagatttcctttgactatgctgtgatccatttacgcgcccccattggacaattagggcctcctccccgccccccaccccaccattgcaggtataaaaaaagctgcgttggccgtcgatgtacctcctggagctcctgattatcctgtaggatagaccctggaggggaagcaaccaggcacgtgcgacattttggtgacacaggccaagctaccagccgaaaagtttaccaacttccactgccacccgcgcgtgcaagcggggccctgtctccgttatggattattttaatctttgccaatcctaaaaggaggggtgggggagggaagaatcttcatctctccttttaatttgcatttctttgaggttagaagttgggggtttgtccccctgttgcgcttgtctggaccaccagtgagcccaggcactcgacccccgcagatttcaccgcccaagaggccagtgggctgggccagggcacacgttcctgacgcgcggctgcaccccacgacccgggcggctctcgcgcgtgaggctctccttgcacgtgggccttcgcggtttgcactaggaagctggactgtcattctcaccgcaaatgcccttccctcctttccctggaacctcagcaccgacaggtccccgctccaaggtcatttcctccctcgctcagcgccccggtgcgcgccagctgggattggccccgcgccctgtctgttcccagggctcttcggccttgaccgtgcgccttccctgcgcgccgcctaggtgccacctgcaggccgggcggggcagggacagggaccagtctgtggggacgccgaggcgccacgctcacctgtgccatggtggccgggctctcggcgctgcaacgagcccgcgccggcctgcaactgcagccgcactggggaggccttattcccccccgccgaccacgctgcagctctcctgcccgggtctgcggctcccgcggctgcgtagctagtctattaataaagaagcagagaacgaggcctcccggggagctccgggcctgagcctcgttccctggggccaaaaacgtctccatgtctgcctctgaaactagagtaatctttctcagccttgttttttacagattctgccccagtttgaatactgtagcaattgcctaccatagcacaagaaaaattttctttttaatgcaggtaatgtttttatttaccgctaagatttctcttttactcaaaaaatacttttttatggaaaaatccaaacctttttattcattcgttcattattcattcatttttgaaacaggatctctctctgttgcccatgctgcagggcagtagcaaatgacagctcactgcagtgttgacatcctaggctcaagcaatcctcctaccccagcttctgagtagctgggaccacaggcaagtcccgccatgcctggctaatattttgaaaaatccaacctttgaaaaaaattaaccagaatagtataataaaggcctatacaaccaaaactcaactcaaccattatggagctagggccaaggtgtatgcctgtgttcctacccactcctgcccatcctactgtttattttaaagcaaattcagaaatcctaccgttatgtccacaaattccttttttttttttgacatggagtcttgctctgtcccccaggttggagtgcagtggcgcaatccacctcactgcaacctctgcctccagggctcaagcgattctcatacctcagcctcccgatagctgagattacagacgtgcatcaccatgctcggtaatttttgtatttttagtagagaagggtttcaccatgttgggccaggctagtctccaactcctgatctctggtgatccatctcctcagcctcccaaagtgctgggattacgggtgtgagccactgcgcccagccctcaaatctcgagtacaaacctctaaaagataaatattcttaactaaaaaatatgaccatactatcttgtcccacctaaaatagatgaacaattgttacagaaaatggtaaaccctgttgcctgcaagagcacagctgagtccccactcgatctcgccagcctcatttcttgctggcagctcccgcagattctgatccagaagtgtgtacgacttttttggaactcagctctggtatccccatggaaacagtgttgaaatctcagtgtggtgtgcttccctctcctctccgaagcctgtagtcctctgaccttgcaccttgggcctctaggtgttgagtaaatatggtcagttccactttgtgagcctgcatcaccagggtttcatgaggacagaacagggtgatgcagacgaaagcaccgcacgcagcaagaggacgtgcacggaaaggactcagagcaacaagtgcactgttttcttacggaacacgtctgctctgaacacgggatcagaacacattcttttgttgttgtttgtttagatagagtctctcttcgtcacccagtctggagtgcaatggcgtgatctcggctcactgaacgtctgcctcccaggttcaagcgattctcctgcctctgcctcccgagtagctgggatacaggcacgtgccaccacggctgatttttgtatttttactagagacagggtttcaccagttggccaggctgatctcaaactcctgacctcaagtgatctgcccgcctcagcctttcaagtgctgggattacaaacatgagccactgcacccagcccagaacacgttctatcccactgtcctggacgctttgctgcccatctgtgcctcagtttcctcacttaaaagaggaccagctggtgcagaggctcacgcctgtaaacctagcacttcggggctgaggcgggtggatcacctaggtcaggagttggagaccagcctgaccaacgtggtgaaaccccatctctacaaaaaatcaataattagctgggcgtggtggcaggtgcctataatcccagctactctggaggctgagcaggagaatcgcttgaacctgggaggcagaggtcgcagtgagccgagatcgcgtcactgactccagcctgggcaacaagattgaaactcagtctaaaaacaaaaaaacaaaacaacaaaaaaaagaggaccttgacccagggcactaatgagcaaacctttcaccactctccgtcgtccttcagagccggactccgctctgtttcttctgcacctctcagtccctggcacctggttgcccattgaggcacaaggaaggtcggcagggggttgccttgtggggaggcagcacagtgagaagcaagaatggaggtcaggagagggtgcagcaggccacagggcacagagctgagtcggctggctgcatgggtgcctcactgctcatctggcctcagtttcctcacttcaaaaaaaaggatggccaggtgcggtggctcacaccttaatcctagcactttgagaggctgaggcggtggacctcttgaggtcaggagttcgagaccagcctggccaacatggtgaaaccccatcttactaaaaatacaaaaaaaaaaaatttgccaggcatagtggttggcgcctgtaatcccactacttgggaggctgaggtgggagaatcacttgaacccaaaaggcagaggttgcagtgaccaagattgtaccactgcactccagcctgggcaacagagtgagaatccatctcaaaaaaagagaggacattgaccctgggcactaataagcaaccttttcatcactcttttctttctatattattctgattagttcatttatttggagaagcagtcatattctggtgttgggagtgtaactccagaaccactcagcctgggttcaaatcctgtctctgccacttactagccgagtgtcttaaacctccctgcacctcagtttcctcatctgtaacatgggaaagaaatggaagctccttggagagttgtaatgaagatgagtaactgccgggagtgcttagagcattccctggtcacagtaggtgccacataagctttagctgtgattattattcccccgcatcctgtcatgatccatgttttaaaagctgttgccctcccagatcagagaatgctggaaaaaaaggaaaaatgtctaaacgaataaacaaaaacactgttgcctataaacagtacgtttaatgggggaataataatttccctgagcatacagcagaaatatgcaaaactgccacctggagcctacaaccgcataaaatttgctcattcctttaaaagatgcttatcaataagcacagtggctgccaggcaccgtgtactgccagccaagaaccaaaaagctgggcattttgatctatacaggttaattcagatagatgaggggcctctttaaggccatttgaagtggtcagaatagttcaaaggtcctattactccctcctcagtttccccagtcatctctgaggcccccatctacctagcctactagagagtatgcgttcaggccaggacctgagcttcttcatgggatcagagcagcgtgctggcccagtgcaggcaatgccttaa

SEQ ID NO: 5098 - DNA, 89008 bp, Homo sapiens
tattttactaggctgccctttccctcattatttggttaaagagggcaggattttgtttgctatgcttgttaggttttcgggtttaatggctcctccagctccaaatctaggatatatgggcaaaaaaaccaaaacaaacaaaacaaaccacagaactcacctctatgtcaattccaagtcctgaggtccctagccgttctacctactcctatccacctttcagagtcttctcatgttgtttcatatagtaatataatgaccagggcttttagttctacttagccatagaaataggaaaagtatgttcaactccatctttcccctgtaacatatttttgtcgcaattttttgccattttaatctctgttgtttgtgccttgctaattacacactgaatttgtgctgtagttaactgaaaaatgtaattaatgcagatgcctttggtaagttatttctgagaataaatacatttattaccttgccaaatggaaatataaataattggctcatgggcttctaatatgagtctgttaagtcagatagcacataagaagatatatgaaaaagtagtaattattattagcctaatgaaaaccagggtgcagtgacaggttcctgctaactcagaaaagactgccattgcccgaactagcaattgtcagtgttgacacttctaggaatcactcattagaatgttcgtcttgggagaacctgttgggtgactattgatttgggacctttctctagatcctgcttggagggtgtagtcttgttataataaatagttctctatatttctgggcccatcttgtgtgatatgattacctcatgtgttcataaaagttgaagataatttccagtttttttctgtattttattttacattcttttatattcctagttagatttcatctgatgttaagcaagagtaaatatgcatatttattcttttaagagtcaagttctagtgaactcttataacttctttgcaaatttacttccctggctatattcccaaagaaagtttacttgaatttatataagaccataatgtttgtcttgaagatctcaagtctttgtagaactgctaagaacagatacactgaatttccctcaagaggactaactctaggtaaaattcctaaaccaaaagactcaaatctttcctcttagttcatttctctggaggaagccttctaacttttttccaactggaagactttcagagatgaagtttatgcagtgcatcctcttggcaaatatcagtgtcttggcacataaccttcctgcagatagattcatcagacctaatgagaagatgaatgtgtttacctctgaatccagagctgcgccttaaaaaattggtgtcatttggacacaagtcaaagggtaaaactggaccatggacagatttgaggtaaccaggatgcaattttattaattatgtcttctataattaaaatgagatgtcaggaaatatctcaggctgatactagaatagacaacctctccaaactgcaatttattttctgtgtattagctgtatctcaggcataaatggattggtgattttactagttgcataaaaagcttgagtagaaaaagtggtagatattttttgagctttgttcaaggtacatggtagcccacacactaatgacatggtgtattagccataataagatttattgatgataacttaaaagcagagattagcagaaagtatgatatactctgggtccagggagttgttcaatcaagaatgttgccgtagcaggttggatgtgctacaaggagctcttcagtggggggaaacttcacctctgaacaacttacatatatttaggctagtccaagtgtgtgaggaggacatagtttactaagtaaataaaacaaaactgttgtggggcatctctaggcgtataaaacagtattaggggaagttggagctcatcttgggagtttgcacaccaaaggcactgacattaaccagaggccttactaccttctctagctgtccagtccagctggaccaacagttccagacttcaagaaaggaaaacagagggaggccttacaacttctcttctgagaccaaagtttcatgtcttttagtggataaaatcataatccacaatggagactcagaaaatctcaggtttccgacaggttggacctacttctccttgacacttgaaaggtactctcacagcatctttctctgagtatcaggctaatgtccatcaatctccacttttaatgagctctcacatcagatatgaaatatctttatataacacattcatttatttttttgttttaaagaagtcattatatgataagcacttatttgtgagacatcctagatactttatatggattaactactttaagtctcataattctataatgaaggtataatttacccagtttacatatggaggaactgtgacccacagtggttaaacacttgcccaagtcagaaggctagtaacaacaacatgccctgatttcatctagtgacatggagatgaagagatgaataaatttagaaattaaaagtgctatgaaggaaataaagcagggtgatgtgctattttactttgggtggtcagggaaagtctcattaagaaatgtcagaggatctgagacttgaaaataaaaagcaacaagccaaaaagagggttgggtgctaatgattacaggaaggacagaggttcaaggcctcaagaaggaaatgagccaaatgtgcttgagaaagacgaaggagaccgatcattggaggaatggaatagtggtaagagacgtagtggaagaggagggagagggtcaacctggtaaggggtttacatttgagttgtaaacaacagcaactctgctctgcgtggcatgcctatgtgccaagcactattctgatagttttacctatcttcattttatcttcatagctttgtatgaagtagtatcattattagtctcattttacagatgataaaactgaagtgtagaggtgaagtaactagtaattgaaatgcaattggaaatgatttgaagacttagggtagtaaaacctgatttacatttaagaagtggcacaggagctgagatttgggaaagaaacttcttttggttgtgtggaaaaaggattaggggctatgaaagaacaaactagagaaccaggcaggaatcatagtagcctcttcaggatattactgataaatgggaaaattggactaaaggattttgtatattttgtactgatgctggagtagatgtaggaggtgaaattaaataagaaatcaagtatattcctaggtttcttgtttggacatctgggtggatggcaatgtcatatgtaacagtaataatagggaagacaagaggacagagttagaacacagtgatttggccatattaagttatgacacttactagacatccgaggagagataagtagaaagatggatatatggagtttaagctcagtggagaggttacatattgttttagtgaaaacaagaaaaaggatttggaaaaggttatttccataaataaatctggaaccaaagtttgtttttgtggtagaaacctaagcagggatttctcctttttgtttaaagctttgtttgggatttatatctttcttcttagataaaaaaagtttaggttcctaataaaatgtccttcccagtgtcagaagaagtctattctttttttttcttttggatttttttcagatataggataccctattccaagaccccattgcctctgactcagtcagtgcatgtctatagaagtgcaaggggaatgctcttctaaaagcatgttcagctagtctgcccatgggaacaggaagggtacaaagtgaatatgaacttctaaaagatgacactgcccaaacacatgtggtattttcaaagaaagttcaaactgagcatatttaaaatggaagtgctatattggagatttttttgtgctctgcagcatgagtagttcaatgattattttcttaggtcctagttgattgcttgtttatttatgcctggacggttttttccttgatctgaattgtttttcaaacatttagcaaaatcccagcatagtaaagataggatgtgttgggtttgcttacattacctactcttttctatgaaaagcagaaatcagattaacatctctttctgaatccaaaataggagttcactttgatatgagaaatagcaagaaaatgtcaactactgaactcatcatattcccttagctgcttgcttccaatatactgctctgtaaagatttagagatttccttgaaatcttctgccaaatcaattgtgagatgtaccttttatactactgtaatattttgaaatcaaaatgcttcttacaattataattagtagtgttttgttttttagcggtacataaataacaatgtgttttacttttattattatatactttaagttctagggtacatgtgcacacctgcaggtttcttacatatgtatacatgtgctatgttgatgtgctgcacccattaatcgtcatttacattaggtatatctcctaatgctatccctcgccactctccccaccccatacaggagccggtgtgtgatgttcctcatcctgtgtccaagtgttctcattgttcaattccacctatgagtgagaacatgcagtatttgattttttgtccttgtgatagtttgctgagatgatggtttccagcttcatccatgtccctactaaggacatgaactcatccttttttatgctgcatagtattccatggtgtatatgtgctacattttctgaatccagtctatcattgatgacatttgggctgattccaagtctttgctattgtgaatagtgccacaataaacatacattgcatgtgtttttatagcagcatgatttataatcctttgggtatatacccagtaatgggtggctgcgtcaaatggtatttctagttttagatccttgaggaatcgccacactgtcttcataatggttgaactagtttacagtcccaccaacagtgtaaaagtgttcctatttctccaatcctctccagcacctgttgtttcctgactttttaatgatcgccattctaactggtgtggatggtatctcattgtggttttgatctgcatttctctgatggccagtgatgatgagcatttttcatgtgtcttttggctgcataaatgtcttcttttgagaagtgtctgttcatatcctcacccactttttgatggggttgtttgtttttttcttgtaaatttgtttgagttctttgagattctggatattagccctttgtcagatgagtagatggcaaaaattttcttccattcttaggttgcctgttcaccctgatggtagtttcttttgctgtgcagaagcgtggataaggaaaccgatgttctagtgcaaatattggaattagggttataaaatgagaattgttggctgcggatattctttgattctgatgcttttttgagagataccttattacctttttttagggagccccaagtaatgtttttacaatggcataaatataattttcttaaaatatttatattaaattgaattctaagaagatgtttttcaagctatgattctgttacatattttttatagtttatctatgttactagctcactttgacaagtgaaacaaaaggtacaaataaaaagttccaacttcaaaatctgtagatctagaatgacctctgcttattagtcagtcaagaattattagcaactttggcaaacaatgaagagagaatcttcttataacaatttataatactcaagtgttcttaacattttctttattaaactatgagctcagtaactggcttctcagaacttgtcaattttttccatattctgtgctgcacaagtatgacttcataaaggcaatttaacaaatagaaatctggattggctagaacatttgtcaatactggatttatggtttatagtgtctgccccagcatgctactgttctaaaaccttgacacttagtccatcaatctgcctataaaaggaaaaacctatttctaaagtgacagaatctatttgtagtagtgcagtcagttagcaaagctgccttgaaatacaccagagaggaaaaggtgagagggaggggtatacatttgttaagattctcaaagatctcagtttgctgaacagagatattatcctacctattaagacaataaaaatacttcaggagacaatccttttcttccttctccatcaaatcaaaagcaacttggtaatttatttcaaatgtacgcctgtcatcacttgacgagagaaaaacttttcagggagcagtaggccaagtgttgttactcccacattgattttatggtgtgtttgatggattttgcatatgttgctttagtgtggtgagactcatattttctctataccccttccttcctggatcaagacacttttcaccgttctcctggagtcacagttcacatcaacatatggagctgttgctataaagaaaaaaatagattctttaagcaaaatataccagagtcctacagaaattgatagacaatattagaatcaaatattagcttctgtagtagctatttcaccctgggtttaggcctagaagaacaattttccttcatttcctcctcctgtaggtggaaactgactggcggactatctcgtccctatagcagcactaaaatggtgatgtctgctagccactactcccaaagccacaataaaccacacacacgcaaaaaaaaaagaaaaaaaaaggaaacaaacaaaaaaaaactgttcattaacaaatgctcactcaataaatgaagttttaatctatctcctagcctccacttcccacttcactcatttgacagattattgctcctaaatgctatctgtgtagaaattctggaacaactcctctcctgccatttccatggggcaaaaacacagcgctaatggtagcctgggacaataacctgaacaaaaagcaagaggactctccgggctgggtagagaagtgatcagtctgagagtacttataggaaacacaggttgggaagtgagatctgagagaaacaacttttatgtatgttaagcaggcttaacataaggtataaggtatggctctgtatagacagagccataactccataatggaaagaaaaatatgtcctttgcagggacacggatggacctggaagccattatcctcactaacttatgcaggaacagaaagccagacactgcatgttctcattcataagtggagctgacaatgagaacacatgaacatagagtggggagcaacacacactgggacctgtcatgggcgggggtagcagggcaagggagagcatcaggataaattgctaatgcatgctgggcttaattttaggtgatgggccgatgggtgcagcaaaccactatggcacatggttacctatgtaacaacttgcacatcttgcacatgtgtcttggaacttagaaaatgtggtatatatacatcatgaatactatgcagccatgaagaacaagatcatgttctttgcaggaacatggatggagctgaagccattatttttaggaaactacctcaggaacaaaaaaccaaatacctcatgctatccttataagtgggagccaaatgatgagaacatatggacacatagaggggaccaacagacatggggcctacttgagggtagagggtaggaagagggagaggattaggatataaaattaatgatactaggcttaatacctgggtgacaaaataatctatataacaggcacccatggcatagtttacctgtataacaaacctgtacatgtacccctgaactcaataaaatttcaaaaaaaaaaaaaggaaaaataaaaactgttttgcacatccctcaaaattctgtgtatgcttcacctttaatggcaataattgttaaatagtgggctaacccatcttacttttctaaatggtaattcatgactaaggggttacatcatcttagtaaatgaacttgactccaaacaaatcagtttctttggttgttatgatggcctcattgttttttgaattacttagtgctatattctgaatgttatgccctccccagtgtcctgccacagattcatatgttgaaacctaatcggtaatgtatggtattagaggtggggactttgggaggtgagtcggtcatggggcagaaccctcatgaagcaattagtgcctttatagaaaagactctaggtcaagcgcagtggctcacacctgtaatccagcactttgggaggctgaggcaggcagatcatgatgtcaagagttcgagaccggcctaccaacatcgcgaaaccccgtctctactaaaaatacaaaaaaaaaaaaaaaatagccagcatggtggtgggcgcctgtaatcccagctacttgggaggctgaggcaggagaatcacttaacccagggggcagaggttgcagtgagctgagattgcaccattgcactccagctcgggtacagtgcgagactccatatcaaaacaaacaaacaaacaaacaaaaaaacaaaaagacctagactgttcttttgccctttcctccatttggggacacagggagaagttggcgttttgaacaggaaatgggccctcgcattaaatctgtcagtgccttgattatggacttcccagcctcagagctgtgagaagtaaatctgtgttattaataagctacccagttatggtattttgtttagtagacccaatggactaaaagggttactatacttaaaaatggagagattgcaaacagatatagatttctgcctgctccttaaaaagcatcctcatggccactctctgttggtgccaaccatgacttccctgtgaacagtatttgtggtctgaggacagttacagtttctactactcctggtgtttcttagttgtctttgctctgttgcccttttttagttgcccttgctctattgtattcttacaactggatcatttcagtctactcatctatattacctacttagctcccatggcatttatgttttcatcatcaccaaaaatggcttatctattttttatgttcatttttggagattctttcatgcttaattttttttgtgtctcttcattaaaatattgggtgatggttgtgttcagtgatgcatgcattttaaagaagaagaggcgggtcttagaagaataactaatgcacaaattcagatgagcatcctttgggcattaccaatatttttctctaaaccaatcctatgtatgcatagctttatcaagtcccatttaagtgactcaaactccagaatgcttttaaaattcaattgtctatattagcttaaagatcttgggacaggaattttattgttagcatgccacacattcgtccttctaactgggatgaatgaagtaaccagggagcacgttataggtagcagaaagagaaacaatacttaggggcatagtttctggtgtgaatagagtttcagtgtatcactaatcaatccatagacatgtgcccaatggctaatctgtagctaaccctgttatgcactaataatatggtataataaaggagaatgtgttatcttttgattattaaaaaaggagaataatgaaattagattgtttgtttttttaaccagatattttgaaataccaaatgacaaaggaataattcccatgaaatatttttattataaaatcagatttattttttacttgttaatagtttagaccttccatagtactttatcttcagcaggggtatagttttagctttcaaaaatagttttattagttttctagtaaaggacaactgtcctttcatttttctactttacaaatgaaaaaacaaagtgaagttctatggaagccaatttattggcttagtcagttttgacacatagggtctgagcagagtttgtgcttcagagaaaaaacaaaaccgtaagaaaacctatcccggtgtcacctccatcagatagtgctttcttgctttatgttattccatattggtcaattggtctttaaaatgtcatcaataactgctacaagggtactaatctattttaactggtctcttggtagtcatttcaatcttgggttcatgttacttttttttttatccctccattcatttcactctgaatttatagttatcaggtttataaaagtgacccagaggcctggggtttggtattagttcatcatcagctctttctctataaatatttcacaactctgatcttaaatacatttactacaagtattaaatattaaaaattcatttggctacaggcaaaattaaaggtagggtaatggttcttcatacataaactaagcatttttatatagagaaatatttcctaataataattctttaccccatactatctcaaagaaaagcaagcataaacagaggcccaggtagataatatttaaggagaacaagtataaaaaatgcagctagggagataatatcaatctctcttattcccattctaattttaggtttctttgagatagtgatagatccattctttcatcctactcttcttcaaacagcttttcatgcctcaccctgactgcaatggtaccattggaatctcaagtttaggactcaggtttcctccaatattgtcttggcatcagaagagaagaaattctacagtcattatagcttccctgacatatacacacattaccctcacacaaagtgtttgatttaactcttataaacaacgagagaacaagaacaagaatcttgcattttacttggtaaagcagtgtgctttagatgcttataattatgtctaacaatgttcatcttaagaaagggaaactatttggagagaacatcaaagtgaaaaaaaaataagtgacaagtatcttgttcatgaggatagtgtaacaattcattgtggatatctgtaaaatagttaagaagcatctagaaaaaaatagggttcatctggtctaaataataatcagcattcatgaatatgcagccaatctccagcatgtggatccactgggcaccagcatattttcttcactcagtctagttccttcagtgttctacagtctgctggagaccagatttaggtaaaatccagagaaggttcagtttctaccataagagggtcaatcttatttattgatattggctacaatcttatttattggtattggctatattatatcttcttggtttactacatgttacaaaaattatcctaaaacttgacgtgattgtgatacaaaagagaacagcatttttgcattgtgtagtcttagggagaaaaggttcctgaggctcagatcactgtgttgcacaagtccacatggcttcattcacatggtattctacctattagcattcgtagagaggagttcgtctcagggaatgatgaaggaccactcatgatgcatctgcaggaatcttttgaatagggaccccttagggattattttctttaaacacacacacacacacacaacacacacacacacacacacacaaatcactgctatttctaaaatacctgaaaattaaacctaaatagtgtcagaaccaagtagtcagcggtcttcaatattgttaataattagggcatttttgttcatgtaaagaaaaacataaccttatataagaggagtcgttgtaatttaaatatcactaattgagattttatttaattataaaggcagctcagtaaactcttactttaatacacttatatgtgtaaaatattataggggttacacacacagttcatttcatggctgcttgatttctctgtggttttccaaaggttcaggatccacaggttggtaactgttgagataaaattcacataaaagcagagggtccttcacaggcataattgtgtttcatttattttcattgtgagaaaatctaaatctgaaactcacttatataatattatttaatggattaagaaagcatagaagcagaacatattgaaactctgtctgtaaatgtaccaggtctgatgaaagaataaattcacttaaaaaaagaacaatggaaatttatgtgatatgaatcacatgctgaagaatacatttctgcaatgtttgtacaaggggagcagtcactagtagttataagatagaagtgcccaaatcaataaattaaaaacagttttttatcatggtatttttcaaacaaaagtagaaaataataacacaataaactgtgtgtccatcatctagcttcaataattattaacatcttgcaatttatttcatctatcttccccatttttctaaagtatttaaaaaatcagaaactataaattttcaaaatatatttctaatggcgaatgactttttcatatttacatgatcattattacaataatattaacaatatcgtctagtatccagtccatgctcaaatttgccaaattatctttaagttgttcaaattacaatttcaccaaggtctatacatgtactttgttaatgtttgtaaatctttttctctatagcagtttcttctctcctttttttccccttgacatttatttattgcaatgaaactaggtctggcgggattttttcacattctagatttctctggttgcttctttgggcatcatttactgatttacctaatttattcattctccatatttcttgtaaaatttcaactgaagcattcgattaagcttcacttttttttgaagcaaaaaaccctcaaaagacacttaggaagtgctgtgaaacatcaagtgcatcatatcaggaggaagcctcacttttagtcagtgggttcggagctgtaagccccatcaatctattccagggtttctcctaagactttcacaaatggttgcccattggcaatcagtgctaagatgtttgtttccattagagatcacagtatgtgattttaaattttttattctttctgcatttgtagctgaaatacttctataaagaatattttcctttcatcagtattgttccctccaaacataatttgtaaaatgatggtaaaggttgattatttgcctttattcattaatttgcagaatgagttgatattttagcaacttcacagtaaccaatgatttttaaagaaatgctcactgtgttctgatcaattgcaaatattattcttctggtgctcaaattactcaatttgtaaccaatcagagtttattggctcttgtacctttttttttaaaatacaactgcaatagtctgaaatctttcttgtttttttggtacaagatgtccaggctcattttgaatattccaagacctggaatcacccattgctccaaaaagccttcgtcatttagcagaaaatgacaatttgattccaaaacaagtactctacagttgactattgtactgaattaccatttatttttgacctttcagaacttgaaaattcatacttctttatataagaaaatatttcatgacttcatagggatattggaaactcagatttcagattatagggtatcatttaaattgttttatgttcacatctctttctctttatctgaaaatcttggttcctatgcagttaacaaaattacttatttcttttgtcctacaatatactcataatagtttcaaataacaatgccagaattttaatttatgattaaatcactgagtacaatataagatttctttttgttctttttgtccttaggatatatcccacaaggattataatgaaaatattgttttttaatctgtcaacataactatttttatgtagctatgccaccaacttaatatacagttagatcattttcttgaattacttttcaaaatatagggttgccttttgttatttatctttattttgtttattaaaaatgtaaaacatttacaaggctccaaagccaaagctcaagatgagtttactttcatctctatgtctgcctcctttaataggtgactttttttgctattcttagtttattttctgtttttttgtaatatatatgtatatacacatatgcatgtacctatatatgtaaggtatatatacatgagtgtatatcaatacctacatatgtaagtgtatttgtgcttacataacacatacacacatacttctatctcttctttttatgtaatagtaataaaactgttttgtccttgtttttttaagcctaataatttatcctcgtgatcactataccacagtagactgagttgtcctcgttcaattttacagctgcagagtactccattaaagtttattcaagcagtacgtaattatgcacattgatttttcccagtattttcttattacaaatactgttatgataaatatttttgtgtatcacattttgtactattgccagtgtatttttgggaaagttcctagtatgggattgctgagataaagggtaattgtgtatgtaattttgctagatatcaaattccctgggttgagtcattttacattcccaccagcaatgtatgagaatgattgactccccacaagcaactacagagtatgctgtcaaactttcagatgtttgccaattggatagatgagaaatgtatctgataataggtttaatttgcattttttattatgagtgagagagtgagagcgagcactttatatgttatttatgtttctttgtaaatttttcattgggcaattggtcttttggtctgaaatattaaattttctttgtatttcttagggtatgaacttcttatttgtaatatagtttgataatttttttctagtttacaatttgtctttttactcgtctgtgtctgtgtttgcctaaggattttttttaatgtacaaaaatgtgtctgccactttctttattacttcttggtttgaatcataattaggaaagtgttttctactctgatttatagtgaaattttcccattttgcctactacctgtatggtgatatttttaatgttccaacctctgatgcatttgaaatttatctgataaattatgtgaggaatgattcaaaattacactattccatatgactatgtagtttcatagcactgatctgagatgctgtgctaattatattccaaatttcccaatgctctagtaccattttctgaatttcctactctcttctactagtatgtctggtcattgatacgtccatacatatagtttaattatagagactttataatatattttagtatctggatgaagtagttccccatacattgtaagatttctctggatattgctttatggttagttttctaaatgaagtttaaatgaacttgtataatgctacaaacaattcttatgatatttgtattgggattatatcaatgtattatgtagcttggaggaaattgtaatttttagaatgctgtgtcttcttatgcaaaatatagcatgtattttcacttcttcaagtctatttttgtgtctttcagaaacgtttcaaaaaaaatcatttaataaaacatggtatattatgggcacacactttagttataatggcagtaggctaaactttctaacttgaaatatgtactttggttaatatggagttgatgaatgttttgtcatggtaagtttttgctgaaaaatatacataagtcagtaaacctatccctattatttataaatatttgtttatattctttttatcagacaattttaaatgaagctgataatacttcatttgactctactgaatctattacctcataataaaatacttctagtcataaattctatttacaaataaggtggtcttagggtcaggtaagccttagcctttgtattacaatctcctatttcagttttaattgacctgtatatacagttaaataaaagcagacacagattctctataattgaaaagcatctgaatccaagaaaaaaattgatacttagctttattttctttacctttgtttgtgtctgcatgattctttttgactttttgatcaaggtaaataaattgtagattaataatgcaaaaggcagtccatacatcctatacaacagaaaaattgtctaaaacacatcaggtcctttggttgaactcagtatttattttttatttttatttttttgagatagagtctgcgctgtcacccaggctggagtacagtggcccagtcttggctcactgcaacttctgcctctgggttcaagtaattctcctgcctcagcctgccgaatagctgggactaccggtgcgcccaccatgcctggctaatttttgtattctttttagtagagacgaggtttcaccatattgccagcctggtcttgaactcctgacctcatgatttgcccgccttggcttcccaaagtgctggattacaggcatgagccactgcacctggcctgaactcagtatttaatgtgtaacagaatgtctttgtctctttggagttctaggtttgtcgaatttccaagccaatattgtgtgtgcgtggttctcaaatggaggttgtcagtatcttgccatccatgtggtatgtgggagtggttgggatatttttttttctgaccttttaactgaggggaaagacattattggcattctgtaggaggaccaggaaagcaaatgccttgttacaaaggcagaatcctctgtggtgaagaattgcttggccaagttctgggttaggtattggaactctcctgggatatctgaaacccttattttgtttttcatggttagaactccattaattttgcattcagaattcctactgattcagattctattgagggaggacataatatttagggctgcaggggagattagaatcagaccagttgctatttgtcatattatttatgtgtgaccgggagcaaaattgtgtgcctttttatagtagatccataaattaaaagacatcatataatatgacagaataaaatttgatatgttgatacaaatattaatttatattaacaaagctatatttgtgaaggcctgttttacttgtgctgatgctgtatattcctgtcctgagcttttaagttgtatagaaattaattagaatattttccccacacatctccctacgagagaaaaaaggcataatcaagggaaactgaggcactgggaagactaattatttttggttattacagtgccatagttatatgatggaaaaatgtacttttattacaatgccagtcaatatttcattttttgcataagattgcacttttcacacctttgatttacagagcatcctaaatatccaagctatgttgtggcaaaattgtcctaccttttctgaacagaattatttatctaagcttaagctcatggatctaatgagctgaaatgaatgcttctctttccaaaagtcatttccagaaacaggtttattaaattacaattgagagagtagatcttatattttagtggtaatgcttggcaagatgttctttcaaaaacataaataaatttcattgtttcatgagtactagctttggggaaaaacaaacaataaaaaccaaagaaaatattaggtaacttttaactcttctaaaggaaaaatgttaacttcaaaggtaaatggagtcattaatataaaaacaaatgtaagaaaatcaatgctaagtatcaatggaaactttttcctttaaattccaccaccagagtgtaccccaactaaaaagcctgcagtcctgcaaatcattaccacaatctgcttaaatatgtcagaagcgggcacagggaataagagctggcagttttcctgcctgttaaaaaaagacggaagcccatcatgaatgaaagcatacaacactacatttgccatctgcatgcttccaaatctcttgtattttatagcagtagcttgccaaaactctggcaagccaaaacagaataagactcccaatctgaaagagagaatatggcaaataataaaatcatccagacagagagaagtagaattgcagaaaatcaaactaaaataacaaaactgtcaagcagtgttgaggagctaagaaatgcctacaaaagaggatttagaggaaaaccaaaggctcaggataatggaaccattgttcagttgaaaggtttttccaaagcaaatatactcactggtaataaaatgtaagcctttccagaaaatgttgcttctttctcatttccaaagttctagctatgtttgtttagataaagcaaaccttatgtctttgagcagttgggtccctttctattttgatagaagaaagactcataagagggactcaaaccctggctattaagccagggtttaatagctcttaattgtcatttgggatatattcaaaattacaagccaaataaacacagctttgcaacatttaaactgataacatttaagacattttttaggcagttgctgaggggatttgtgactttgatttttgtaagtccagtgcaactctagcaaccaaaatatatcacatgcttacaacatatattcaaaattaattaggaagaaagaattatatagatttttgaaatttgtattgacacaatgtatttacatatttatggggtacatgtatttgctacatgcatagaatgtgtaataatcaagctgggtatttgaggtatccatcaccttgagtatttgtcatttttatgtgttggtaacattcaagtcttctggtttagctactttgaaatataaagtatactgttgctaactatagtcatctactctgttattgattattgggacttgtttcttctatctaattatatatttgatatattgtactcactaatcaacctctcttgatcctcattcccattcacacatcctacccaccctcggtatctataatttgattctctgtctcaattagattgacttttttagcttccatgtggagaacatgtggtatctgtctttctgtcactcaacataatgacctccagttccatccgtgtgctgaaaatgacatgatttcattcgtttttatgactggatagtatttcattgtgtgtattaccatattgtctttctgtttgtccactgatggtcaactaggttgattccatatctttgcattgtgaatagtgctccaataaacataggagttcaggtatctttttgaaaaatatattctttttctttggataaatacccagtagtggaattgctggattgtatggcagttcaatattgtttttttgagaaatctctgtaccattttccagagcggttttactaatttacactgccctggcagtgtatgagttactttttctccacatcctgaccagcacttgctattattttgttttgcaataatagccattctaactggggtgagattatacctcattgtgattttgatttggtttccccagtgcttagcaatgttgagcacttcttcatattcctgacggtcatttatattcttcttttgagaaatgtttgattgtatcttttgtccacttgttaatgggattatttattttttagtgtgagttgtttgagttcctcatatattctggatattagtcacttgtccctaatacattgtttgcaaatatattctctcattcaacgggttgtcatttcactttgttgacttttcctttgatgtctttacttttgaggtcttagccatgatatctttgcctagactgaagcttgaagtcttttttcctatatttttttctagaagttttatgcaaacactgatttaaatttattaactttaatgattaacattaagaagacttaatgattaagtctttaatccatattagttgaattttgtttatgaggagtagtaggggtccagttttattcttctgcatatggtttcttaattttcccagcaccacttagtgaagagggcgtcctctgcccagtgaatgttgctcctttgtcaaaaatcagttgactgtgaatacatggatttattgaatcactattctgttgattggtctatgcatatattttatgccaacaccatgctgttttgtttactatagctttgtatatattttggagtccgatagtaggatgcccccagcttcattctttttttatcagcattctttggccattctagttcttttttggttctatatgaattttaggattgttttctctattctatgaaaaatggtattggtattttgatgggggattacaatgaacttgtagattgctttggcaataggatcactttaatgtaattcttctaacccatgagcatgagatatctttccattgtttgtatactcttcaattttagtgttttgaggtgttttttgtttgtttgttttttggagaggtattttacctttttggttaaaatttatttttaggtattttattttttgtcactatatatatgggattaacttttttgtttctcagctaattcattattgatatataaaaactataatttttgtacgttgagtttgtatcatgcaaacttactgaatttatttatgaaatctagagttttttcagagtctttccgttttgcttgatgtaagattatgttgtaagcaaaaaagacaactcgacttattctttttcagtttggatgcctttaattttcttttcttgcatttagggaaaggctttcagctttcccccattcagtatgttaactgtgggtttgtcctgtgtggctttattattttgagtatgtttcttcgattcctaatttgttgagagtttttatcatacaagatattggattttatcaagtaaattttctgtatcaacaagatgatcatatgatttctgatttatttgtcatctttccttttttctcagtcttgctagcaatttattatttttatttttataaccaactttttgttatattgatgttttgtgttgttttttagtatctgtttcatttactctgctctgatctttttctttcctcctgctacattggggtttgttttgtacctgctttctagttccttgatgtgcattatattatttctgttgtctgatatctttctactttttgagtagatgtttattgttataaatttccatttagcactgcttttgctgtttcctaccagtttggtatgttgtgtttcattttcatttgtttgaagaaattttttaatttccttctgaagttttcaaagactaagtgcttgttcaggagcatgttgtttaattttcatgtatagttttcaagttctacttgttattgatttctagttttatttcattatgttcagaaaagatgtttgataaatttcaattctattttttgaatttttttgagacttgttttgtagtcaaacatatgggcgtcctgggaaatgtttcatgtgctgaggagaagaatgtgtattctgcagctattgaataaatgttctataaatgtctagtaggtctatttggtctacagtataaactaagtctgatgttctttgttgactttctgtccagatgatctgtcaaaatctgaaagcggggtgttgaagtccaagctattattgtattggggtctttctctttaggtcttgtaatatttccttcatatactgggtgctccggtgttggatgcatatatatttgcaatactatatcctcttgctgaattgtccctttatcattacataatgatcttctttgtatcttcttaaagtttttgtctaaaaattattttatctgaattatataagtatagctactcctgcttacttgtagtttctgtttgtaggaatatatttttctcttactttactttgagtctatatgtgtctttacagctaaaatgctttcttgcaggcaacatataggtggatcatgttttttttttaatccatttatccagtgttatcttttaagtcgaaagttcaacccatttatactcaaggttatttactgatatgcgacttctgtttctgtcatattgctagttgttttctggctattttgttgttctttccttttctttattctttgtcattgtggttttgtggtttcctgtagtggtaccatttgatctctttctttcctcatttgtatatttgatttactagtgagctttatattttcatgtgctttggggatgtaaatgtacttttgcttctagttgtagaactcccttgagcaatttttgtaggattggttaatgctgatgaattctctcattatttgcttgtctggaactttaattcttttttatttcgaaggataattttgctggatatagtattcttgggtggcatttttattgtttcagctcttaaaaatgtcattccatcttttgctggcttgtaaggcttttgctgagaaacttgctattatctgatggaggttccttgatagttcctgttgctatttttagaaatttttttttctttgttactttagactgtttgactataatctgccctgaagaataccttttttcattgtatctgttggaaatctctgggcctcctgtatttggatatctcatccctgttctacttgggaaatttcacttgttattttgttaaatagattttctaactcttttcttctctcttcactcttgggacactgataatttgagtatctggtcactttatgttgttccaaatgtcatggaggcttcaacattttttaaattcttttttctttatctttgtctgattggactatttcaaaagacttgtttcaagttctgagattgtttcatctgcttgatctagtctgttgtttatgctttaaatgtctttgtattttcttcaatgaattctttagttccagaatatcttccctggttcattcttaaatctttttggtaaatttctcattcgtgttctgaaatgatttcctgatttcttttcctttttctttttttttttttttttttagcattttcttgtatctcactgagcttatttaaaatagtgttttgaattctttatccagatttcacaagtctttttgatggggatatactggaaattgtttttcttttgagtggattgtttttcattttcttgctttttcttgtttcctgtgtcttacattgatatctctgcatccagtgtaacagttactttttctaatttttaaaatttgcttcataggggagtactttttctaaagctctatctatgatgttggttgtttagtcctcttgacttctattttggttgtatgcagtagtgtagtctcagcatgatttcttcagctgtataagcatccatggtatctgtgatttttttcagtggcttagagtgcagttattaatggaggcatggtgaagttttgctggggactggaatgccagatgggccagtctttgggcctcatgttgcagcagtgagcaagcctgtccctgagccctggagcagtgtgtgctggctctagtgttatgggtccaggcaggctgattgttaggcctccaggaggcttgcttggctgctcatagtggagtggtgaaccaagtgtcttggtggttccttgggctcctgggcagtgagcatgatatgacaatggcagtagcagtggtggaactatgtactggaacctaagagctttcagctggtgctgcagtagctgcaatggcgtgggtgggccagggagcaggtggcacaggcaggtgggtgccgttgtggtgatattacaggttgggtcagcctgacctcagattccagaagtgcttacatgtaagggtggtggactagactggccaatctccaggcccctggacagcatgttcaaatattgggtgacaggaccaggcaggtggacttgtcctcaggcctctggtggtgtgtgcaagtgcggttgtgataggcaggagtggggcagttcccaggctgctagcagaatgctcaggtagagcagcagcaactgcacagcaggcctgccctgggggtagggcggggccactttcggtgccacagtgtaggcaggcggctaagggacatgtggtttgctcactccttagttacacagcaaccacagcagcagcactgggttttcccttggagtgtgtaaaagtgcctggcctttcctctcctccttggcctggtagcagcagtggtgttgtcagtcccagggcgggaagcagttctgtggagctggactttctgaatggtgccgtgctccagctgttcaagggcaggggcctatgggtacagtgtgggctccttctctgaagcaatgcctctgtgcaatctctagccagctccctatttagtcttgagaccccgagtgctgaggggttttctagtagctaggattataaaagatcaggtgggaatgtggaagcttagatgtcttccacttactctctccctgcatcctatagaatttaaaacgtgacataaacttcacctaagggaataaagacgaaaatttgaatcaattctttttaggatatagactgcctctactcctatttccagccatctgtaaatactctttatatttaaaagaaatattaattgcctaccccattaccctgaaaagtagaacagaaaaacatgaaagtaagatatttgccattataacagattgaaaatatgtgtgtgtgtgtgtgtgtgtgtggtgtgtgtgtgtatgtttactgcggcactattcacaatagcaaagacttggaatcaaccaaatgtccatcaatgatacactggattaagaaaatgtggcacatatacaccatggaatataggcagccataaaaaaggatgagttcaagtcctttatagggacatggatgaagctggaaccatcattctgagcaaactattgcaaggatagaaaaccaaacaccgcttgttctcactataggtgggaattgaacaataagaacacttggacacagggcggggaacatcacacactgggcatgtcgtggggtggaaggaggggggagggatagcagtaggaggtatacctaatgtaatgactagttaatgtgtgcagcacaccaacatggcacatgtatacatatgtaacaaaccgcacgttgtgcacatgtaccctagaacttaaagtataaaaaataaaaaataaaagtgtggtgtgtgtatgtgtgtatgtcttatcaaatactcagttgatgtcatcttttcctagtctttgttaaggcatttcttcttctaaccttcagatgaagataacatgagataatttggcttctatccaattaataactgtacttcagggaaatgttctatggaaatcaaccctggtaacgtcatctaaaacttgaagcacctttatattttatcactagcccctgaggcctggatattcttatgctcagtgttcaaacctatggacaagtcttacttgcggcccagagaaatggctcaaacactctggggcataaactaatttcagcatgcagtaagaagctccctcacagtggagggatgcgtaagctttgcaatgctagaaaacaaaatagcttgtctacttttgaattcctgaaataagggcagtttgtttcatgttttagcacatcaagaagaatgaaagtaaggaatggtggaatgcattgttatagacaaagagaaggtaaaagagaagaaagctatgaggaggtattctcaactcttgcctgtaagagcttcagtaggcaaggagaaggggagctctacctttcctggtgtcgtgaactctccctggtaaaagaaagaacatattggaatgcctctgctcctgagatacatccaaggtgcccaaggtcaatgaaggaaacttgaggattaagacactgggtctggcttcctcctgggtcagtggaagcatcttcatgataggaccttctcttagctgttgtttcagacagccctgtgctgggctcctacttgtaccggaataatccttgttgcaaagaggatcagtggagaatagggaccagtttaaatggtccttatgaggaggaactcaaagtgtacctgtggagcagaaaccagtgcaggaagtaaaaaaggtaggcaaaggttattgcatatcaacgggaagctcactgtctcctcacccagcctaagagtccccaggctccttatagatagtgatattgcatcactagttttaactatagtctttgatacctggtgagtgcttaataaatgcttttgaataaattactatatgagcataatatggttttgaagtttttcataatagggtttggagctgtttatttatttatttattaggtgtgtaacctaagaccagttaataatatggtggtaacattggacaaaaaagtttatttgcctaaaccttagtttacacatctttaaaattagctaataatactcagattttgtgaatattaagggaaagtgtaagtggaaagcagacagtgcacgcctgtctgtacttttctctcttccatcttttttcccaatgctgactcctttcctagaatacttttctatctttgctttttgctttttgttcatttgttaaggctgatttcaaaacaaatttccctgtgaagataattctgcatccctgcttcttccctcttctcccacttaataggtataaactctatttcctttgagcccatgaactactttacttgccttataagtatattcaaagtcagcgtggctgtgttttattcaatgactcatatttgatgtataggttgcatttttttattaaaatatcttttgcctgtgaaagaatatgtaaggaaaagtaacaggaattttataaaaatcacttggtttttataagaaaagtttaatcaggaaaaatgtcctgcctagtggaaatatcttcatcctaagtaagtcatttcactgtctgagatgaacgaggacaatgacaatttaaaaggattggcatataaaatgcattgattctttttctgctgcttacctggagttatgtcaatacgtttttgtatagtgtatgatttgacaagtcacaggaaacagaattataaaattcttattcaaatgcataaattagaagagtagatggagtttttagttcagtaaatagtcaacctgattctcctttttttggctagtaagatgatattctaacagctttttctgaagaatatcttctattcatatttagaaagagctcctttattgaaagggtccttacaaatgtctaatccagtgctcacaattgtttaaagggacgggatcagttctagagaagagatttgttaaatcacaaagccagtatttagcaaagagcagaatagattccaattctggctctctgacccaatatagcctaacattatttttatttttagttgctttactacttctcttacttaaaagttattaccccagctgtgttttaagctgtgcccatctgatgccaagacaaaaggctaagaatagattattcagataatatttattattatagtggtctcggtcagtttatgtcttagtcttgtttatgatgctataacaaatcaccatagatttggtggcttacatagcaagcatttttttctctctctcacagttctagatactggaagtccaagtttaggataccagcatggtaggttctggtgagggccctcttcctggcttgtagatggtcagcatctccttgtatcctacatggaagagagaagaagagaaagcaagttctctgtgtcttttacaataaaggccctattctatcattagatttccacactcatgacgtaattacctcccaaaggccccatctccaataccatacatcaccttggggataccaatcacaaagggtttcaaaatatgaatttggtagaatatggggtacaaacatgcagtccataacaggaaaaaatagttaatcgtggttagtgaatgggtttactgttaaaatattatttgggacagggaactaatagattcaacacttccacttcaaagaaagtgcatgaggaagcatttgaagagtcagtacgtttgtataaattccttaaatggatatattcagcagaaaggttgttattactctatcatgaaatagaaatgtgaggatatagagtatttaaattgcaaataaaatatccattttctaaaatattgcataattcagtattactatactcctatgaggaagagagtcttagcatttatttattagctttagttttaataatcagtaattacataataaagaggtgaaattgagtgttgagcacaaaaatatgtaagctgccacattcctctgttgtaatcagctcttgtttgtgatttcaacagaggggaaggttgaatgccatccttctggaacaccctgagaagtccaggtgagtgggaggtggaatatgcattctactccttgtttttctttttctaatgtagtgaaattgatagaattatattaactcctattgtcagtaattatgccacacaattatttgagcttaccaacctacatccttgactatcaggacatactctagtttacaaaaaatgagcacactttaatctcccttttcatgaggcaataactaaaggtttcaaaggtacaaaaaatttgaacatgactgaatatttgataataagaattactgacatttttaaaagaagtgatagcggtattgtgggttaaaaatatttttaaaagagttcttttaacatttagatgtaactataaaaatacttatgaataaaataatatgactctctaatttgcttcaaaataacttgaaaatggggagtaagtagaaatatgtgtgagacaaattgggctatgagttggtaatgaagaaggacatttattataattttctcattgctttttaatgattgaaatttttacaataaaaattcaaaaaataaaacaggtaaaacacttccttttctcctgccttagaaaaggttaccaaagtggttggtcaggctctacaagttaatacagataggatcacaaattcaaagctcaagtaaatccaatgaagtcaaaagtgaataccacaaaggttgggaggtgaaggagggaggaagattaaaaatacaaaacaaaacctacctataattctagatacacattaacttcattattatttgatagtataggagagcaaatattaattcataagaatgtagatggaactctatgtgccaagcaccatgataaatgctagggatacaaaatgcttagacaccatttaaaactataataacatgttttacagagtatagtagagttagataaattgctttgggaacccaagtgaaaggacaattaattctgcaagggttgataataggacatgaaaaggtaataattgaactagactttgaataagcaggcgtttgctatgtgaaaatgagtctatttctaaataggtttgtcaagtcatatttgatacagtatctctaaagccatgttctcaaagaagcattctttaccttcctcaatggctcaggtagtctccattgaaccaagctgatagggacctcaggttgtttgttcacaaccagaatgattgctttgggagaaatagtagaaaaaacaacacggaatggccttttagatgggcaaaatgaaattatcagaaattcaagggtgacctgttaatggcactggttgaagttctgtatggtcagaacacagggagcagggtgtgtggcagggggcaaggatggcaggtaaaatgtgaccagactgtgaaggatcacataggaataggagtttgatattttatgtacggcaaaatagtaaccattgaagatttttaagaaaggattgatgcagaggttttcatcttatattaagaaaactctgacatcattcttctacatcattctgagtgattggaaggagaaatactttgaaacaaggagaataatcaacaagtattttaattgacctaagcaagagtgataaaatgagtgtctttggggataaagaagaaaaaccgatggaagacagcatttggaattagaattgataagacttagtcactatatggacacggcggagtggtaaaaaaaaaaaaaaattcaaaacaaaacccatgtactaccctactctaccagggtggcatgatcagatcaaggtttgggtttcaaagtatcagcatcaactagtcacgttgaatagttcaaaatgcttctcaatgtttggttgtcttaatctgtcatagattccttagcaaggactaggggatgcattactgtttattcttgccatagtttttcagactccttccgctgaggactcaacctattcttcaaatgatgggtttttggattgagaactgcctgagaatgcaatatgtgccgggatcttgattttctatctgggacaaaagactgagactgggcctcttcttctctttgttcattcttgatttctttggattatatattatattaaacaacattatattggctgttgatctatctcattggctgtggtattagccagttgcatagctccctgcagtgagatttccctgcctgttattctgaccttgttacttgttgaactttacttctagcaataaatgctgccacatttcctttgctgttcaaggatcacatcatcttgattgctgttgagctgctaatagcaggctaatatttttgaatgtcatcagcccagactgtagaggacagccacatgagattttcaatgatactgttgcctccttcatcagcttattccattttggtaaatgggggtcctttagatcttttcaaggaatatagttggaatgtaggtcttttggtcttaggtattggtctattctaacatgctcctatcaatgagtcttttgatctctttctctatggcctgcagaacaattcagacatctttatgttttttcaaatttctgagtcgtcctaatagcacatagaactgtcctgcagggttttgtcaggtattaaattaaataaaataatttccctgaaatgacaaaaatctttgttatccagctttaccttcactcatgatctggcatcccggagatccatcatggggctactctcctggttcctgttggtggatgataattaggttctgtgggttctcaacacgtaatttttctcccttcttagcagactcggcttttccgtgttgtgccatgttgtagttgaccgtcttgattgatctaatggccaggaggggacaatagggcaaatcctgcagggatgaacattgtctcatgagcaaccttgcctcacttgaggcatctgcatagtcttcaacaaggatgagatgggagaggatgctgtcctctaacaggagtgatggtctacttttgcagaccaggggattcaagggaatccacggcttaagtttctcaagggcattttcttatataacctttcctaaatttcagagtccaatttctttattaccagggccctgatagccctcaagataaagaagtgagggaagtatatgacatagcatggcaagtggctaaacacagatgaagtttatttggaatctcgctttagctagataccttggggtgctctgggcataagtcacaccttatgttgttgttacctatgagcacaagggccaagccctggctgtaggctgtcctggggtggagaagtaacttcttgagtgaggtggctcccatttagtcaaagttaatttcttgaaaagagaagttgtgagctataagcaaccaagatttacagcagctgagagttgggcgcactggctggtaaagatagtctggctaggacacaacatcatccatcatccacaatgcttgtcctctgagaactggccccatcttccactccagtgctgactatcaggtcacagaagagggttaagtacaacatggcccaactcagaagaggtagaccagctatgaaagaagaaaaattgcatattgatgttgaaaaccacattctaggcttcattttttcctgcccttattctttccattgcccaattattttatccatttcatatttacattatttctaacactttactattacaaagagtatgtcatgaatatttttgaacatatgcatgtgtgtatctttgtaggtacatttgtgagatcattcctagaaatgaaatgttggatcaaatttaaaattcataacattttgccaaagagccttcatactttgtaacaatgtatatactccacaaacagggtatgagaatacctttttctaaatcttaactaacagtgttatcatcagattttttaatgacagaagattgatgatcagattttccaatctgaattagatatatattacatagtatattattttaattagaatctgtaaattatgaatgattggagtacatttttataggtttaaaagccatatatatttcagaagaggtacttttcagagatttagaaggtagactcacactatcaaatgacatcgctggtgttaaaagaggatcagatctgaatccccgtttccaaaatcataaaccaatgtaagatgcatttcgtatttttctcaatatttagctcaaaggccaccccctctatggtaacttctctggctgcctggaaaagtgaccggccccttgcgtgtgctggttatttctgtgcacatctctcctcaatcctcactacagtgtgggcaggtgtgtcttgttcagtgatttgaaaattaaagcattaaacttgtaaagcaaaaaggcaaatagtataggaacatcaaatgtaaacagataattttcatttaattttctaatcccacctcataatggaatcccttaggcatttatttgtatgaatccaaaacttccattactatattctttgtttatacaaataaaaaacatatttatacatatagtaataacaataatgtgacatacacacacacacacacacacacacacacacacactattaggatcctgtttttttaaataatatattatttttttcttaatccagtctatcattgttggcatttgggttggttccaatctggattaagaaaatgtggcacatatacaccatggaatacatgcagccataaaaaatgatgagttcatgtccttcgtagggacatggatgaagctggaaccatcattctcagcaaactaacacaaggacacaaaaccaaacaccgcatgttctcactctaggtgggaattgaacgatgagaacacttggacacaggaaggggaacatcacacaccgggcctgttgtggggtggggggaggggggagggatagcactaggagatatacctaatgtaatgacgagttaatgggtgtagcacagcaacatggcacaggtatacatatgtcacaaacctcacgttgtgcacatgtaccctagaacataaagtataattttaaaaacttaaaaaaatatatttttttcgaagttaacacatatacatatgtttcattctttttaggagttcatagagagtctcttgaatggatataacataagtgataaaaacatttctttatatatggacatttcagctgttccatgtatttttttttctgctacacataatgctgccatacataaatctatctaatatgtcctgaagtacatgtacttttattttagttggttacattcccagagtaagatttgaggtcaaagttaatgtgatttaaagtttaataaatatttccagattactctttccaaatttgtcataatttatactcttaccaactgtgtatgagaagaaatgttttcctatgcctttcagtgggacatacagtcagtctttaaagattttgtcaaattaatgacaaaagtttggtctttctcatttttataatttgcgtatttttctggctaatattgacattgtgtttcttctcattttctgatgtggggaacaccttttcacagtctttgttcattttataatgggtagttatcagtttcagagctttactgaaaatttggggtattgtatgtttttcaaatgttttctccaatcttttatgtatcttttgacttttttggggggtctctatggtcatatagttgttttgttttcgttttggaattgactatgtcaacatattttttggcttataagtatacactctttttaagatcttcctaagcacaaggttaaaaaatattctcctatattctaaaaattttatatttttcttttaacatttcgttctttgatacatctgtagtaaatattttgatgtattttttaatagcaattttcccatttaatgatgccttttatctaaaataatttccaaattctaaattaagaaaactgagagttagtgaagcaaaattacttgcccaagatcatgcaaattaatgcttgtgtgtttttctgttctttcctccctagtgtttaagctcaagcaagtaaagacctccttgtattgtctacttctgtatcattgacacctgacattcctaataagaatgaataaataatcattagacatgactgtattcatgtttatcttgaataaattttgtcaatgtggtgggccaagttattacattgtatacagaaaggcttcccactatggggatatccaagtaagaaaaagcatagatgtttcagaacacgatctcatgtcattattgcttgcaaagagtatctcaatttcctaaaggaaaaaagagagtctaatggatacagagaatagaagaagtgatactggcatgagactactgtcttgacttagtaagaatagcaccagtcccacatcatttgaattaccacacacacacacacacacacacattcacacccacactcagaaacatattatttccataactgcaaagaggactataccccatttaaggagctgagattttgctctggttccgcggttacagtctctcacatgttttcagtggctctcaatttcctcatttctataattaacctaacgtaggtaacatataatacctactattatttacctgaaattcattgagtgcttgtttgtgaggatggtttcactaactctagtttcagaatccctatctcacataaattttaaaacaacccatgagggaggtgttcatgtacaatttatgagtgagaaaactacatcttttgttagctatatgcttgggatcactcaaccagtaagtagcagcttgaggtttgtcttccaaggtgtgctgactctccaagacctgcagtctctgtagctctaatacaggaagttgaaaccagatgaataaactgcaaagacattccttgtctccatgtaggcaagagtcccttagatttatcaattctttagactcttaagcacagtcactgcatagtaaacttttcatagtttaactgtcccaaatatgattctctttcaggcttctctgcttgtggtcttgggaaactggaaactactaacctaataccattgagatgttggcagctaaagaaaataatggtttgttagcaagtaccttcaagtagtaattctccttttacttctttattaaagcaggcaatagaatagccatacatagtgagagggttgggcatcactgtttattaccacaaaacttgaagccaaacacagcaatcacaacctaaaagtattgaacctacaaataccttcaccagagacttactaatgtttttggttatagcgaggaagggagaagatccaagtgcataacctcacacctggtcattttgatactagatttaattttgtcattattaaaataatgaatcctgaagcactgggaagcttgtacgtcccccatcagggtcttctctgccttctgatgttgctgcccttttcgtctacacttaacttgaattgtggtattgtattaggtagttctagtagaaaaccaaatccaactgtgtaagttccatcaacttctactctgaaatgctgtgatttaaaacagcagctggcagatcatcagtctctatcccaatggacacactgaaacaaattaatatgcttaatttctttagtttacagctcagctttggtgttctcagacatgctgctaaagcatcattgtcaaatcctactcatttgcttctgcttaatcagagatcacctgcttattttgattttgagtaattaagtagaaaatctcacttttgactggtactttatctttgttctgaatatgagacagaagacatttttttctaagtgttcagatatatttagctaaaattgttttagttatctcacaagcattgttgacaactcctctgccccagacttcctcaaacaccttgtctggccgtcactctttgtttctagttgcctatgcagatactaaaagccacaagagcaaatcgtatgtcactccaaagactcacattaaaatactcaaaccttctgagacagaatttaattttttttttttagttttacattcacttgattagcctcgatttttcttctcattgtccctcctgctagaatccaatggcctgattagaaatacgtaagcgagagagcagccagaatggatagataactaagttaggtatgatatttgattttttttccactgaaagtgattctctgcttacaaacctttcatctaatgaacttgaaaataaccaccaagaaatattaactgttttcttaaaagacattctgaggcaactagtgtgggtgaagggtttgagcaaattcgccaagtgtcacatgatgccagctagagtcctcggtaagggtgtatgagattcccagtctcacagacaggggcctgggggtttgcgtgctggatcatcctgcttgtgttataatctgactcttcatagcatgggcattaggaggaggcctttgcagcatgagagcgctcttgcgagcagagacagaccttgtacatgctgactgttgcccggagagttgcgtgtagggctgccagtgtctggagatcttgtgggaagttgaggccactgtcgcccctgttgctgcatcaattgcagtggaccgcagtggctccctgggattaccctgtggcattcccctctccacatggtgaaaatacaattcccatttagtaagaaagataaattaagaactagtttctgtcctggatggttaagggaaatagggacaatttatgaaatgcatcttggctacttagtatctgaaccttctctttgctaaccatctttcactcactacctcttatgagtatgccgtgattttaactcaatatattaaaaagaaaaaccaaatgggtttctttgagctatgtaaatttattacttgaacatacaagtatacacacaaaaggcctattctttctcaaacacctgagtaattcccattaatgtcaactggagttgcggatgtatgtcaaggagtaaaaaaatacatttaaaaatcctccaactgatcattcacacaaactctttttgtgtgtgtgttcgtaacataatgaaatttggtctttttcttttctctaagttgaagcaatatgcgtctggttcatttgtttaaatgccatgattgtacatttcctgcattcaaaaaattaatcagagaatagatgtagccaaaagtatgtgctattcctggccaagttttgtggtgtaggaaaagtgactacttatggtattttcattgccgcatttgtggtcatgactttaaaaaaaacccgcaatttaaggttgagaatgcatcatcataatcctctttttatgcaggaaacacccacttcaatagttttcttttttctgtgagttcccgtaggcagacaatttccacaatcaagttgcataaaacccttcattcataaaggataacatctgagctatatcaatgaaacattcatgacctcgtttttctaagcagcaggcagtgactttgaaactgcccatttcctttctttgaaaaagacaaaagcacctgcctcaaggggtgtgtgtgtgtatatgtgtgtgtgcatgtgtgcacactacatgcatgtacataagataatgcaaagtcagtcagtgatggcctaaaatttttgaggaagaggccatgtcagtttattcagcaaagtagtcttgctgccacacctgggattggcatggtataaggtcctacgaatattcgaaaaatacatttgtgaatgatagtctagaattctcaggctgtctatatatgcaatgtcagcttacctgtaaatttgccacagtttgtgttttaagacaaaatgttaatgtcttttaatacctgatttgccaataatatcctgatgcagtcaaacaaataatggatgtttgccttgtggatttcaagtcatttatatttctacttattagaagaatattgctaaactgaataatgacgggcactgttgctttaacagtatactaagaatgttgggtaaaacaaaaagaactaaagtggaaaatattttgctatccagacaatactttgcaattattttaaaaatgaatcttgtaacattatagataattttatataaaattaacatggagttgtttacaatctagctatttaccaattgatatccacacaaatgtgcatcagctacttgtatatctatagaatgatgtcttccttgaccccttttttttcagcgaggaaaatctattaaaattctacttgtgagagaaaaagcagcagcacccactgactgaggaggttgcataacgttagcgaatctgggtatttaaaattctatctcagttctaacatcttcagatgtttctgttctcttttgaaacatgctttatgagagcttgacattttacaatcacagaagtttcctaagtatttgcacaaaactttttatttagatggggtgagatataatacagacttattattgtaaagttagaatataggaaaacagcaatttaacaagtaacacattatatatgtatactatctatttccctgtttttttaagtagacatagattaggatggaaaacatacaacttaatttttttttattaccttaactataaggagtcataatagagtagaagattagatgaacatttttacaagttacataggattaggaaatgcttcctataagaggatttggggatttaaatgcagatttcctcctgaatatttcaatatcttttagtaaatgcacaatttgctaaaaaataaggttaggtcacaaacacggttgttttaaatacagatgagaaaaactttataatttggaaaataagagcttgggctcaggaaaaagtaagatgtgttgtcaaatgaaccttcagtcatcaaccccattggaaaccccagaaatgtttacagtagttatgaatggtttctcccagagcagaagtaattgtgaacgtaaaaatgtggaagcattcttctaattttgagcatgttgggtccgaaagcctataaatctatattttaagttcatttcttcctatgcatagtgactaagatgacttcaacttgcagtccctctatacattacattcagcactcatgccttcaataaatattctcagtacctactctgtacctggtgcagttatggccacaggggatacagcaataaagtatggaatagatccatctatagcataatgttaggaaatgagaagggctataaataaaaaagtgagaaggacataaagaatgacaaggactgtaagtttccatttgacggtaagaaaatcctctctggccgagtgtggtggctcgtgcctgtaatttcagcactttgggaggctgagacaacagatcatctgaggtcaggagttcaagaccagcctggccaacaaggagaaaccctcatcctactaaaaatacaaaaattagctgggcatggtagcaggtgcctataatcccagctactaggaggcttgaagcagggagaattgctcgaacctgggaggcggaggttgcagtgagctggatcatgccactgtactccagcctgggtgacaaagcaagactccatcacaaaaaaataaaaagaaaaaaagaaagaaaaggcttctctgaggagctgacatttgaacaaaaataggaagaggtagtgaatgaagtaaggatgtggacgacctgcatatctggagaattaatgttcctttccaggacgtgggtacagagaacctgaggcatgggtttgcttgacttaatgaacagcaaaagaccatcatggccagagcatatgagggagaggaaaaagttaggaaatgaggtcagtgtgtagctgggctgcagatcatgtagcgtattataagttgtggtgaagacttaggaattattctaaatttgaagatcactctggctgctatgagtcagcaaggccagaggggcacaaagtagaagcacagactctatttaggagtctcatatggatctcagctagagttgatagtggttggactggtgggataatggtggagttgggaagtagtcagatttgttggtgaattggattgagttagagagaatgtcatcaaagataatctgagaatttctatgcctggagtttatgctttcaacctgaatattttcagatattcttattattgagtaaatatattttattaggcttaaaatttttaattaactagttttatctactttggaaatccattaagtttgttaaattcctcctggatgagctctgtagttctttcatctttgccatgtggcctgctcttcagtagacttcttctcttgaattgacattaagctaacagatacccatatggatcttgatcttttaggtgacacttaaagcccagttcacaagtcactttgcttcattgcagacatagtcatcctttatcttcattaatcaattcactaaatactcatttctttaacaaaggttttttgggtacctatatgtactaggtatccaggactaaacacaacagacaaaatttcctgccctcgagaaactatttcaaatagaagaagacagaaatcaatagatgagtaaatacatatagtttgccacatctagtaagcactgtgcagaagtctaaagcagggagggggaaagggtgcactgaattagacagaaaaggagggagtgttacagtttaagtagggtgtcaaggaaggtttccttggaaagtgacatcagaggaaatacttgagggaaaggaaaagagtcttgtgtattgggaaggaaatggtccaaagaatggaaatactaggcacaaaggcacaggggtgggagagtgctaatgagtcttagaattgcaaggaagctgcgtgtaaggaacatcttgagcaaaaaggagaggcaaacagatgaggcaagaagggcaactggggttgcggaaagattaatagatctttgaggaaaaaacagattggaagattttgagtagggaagtaacatgatgttacttgtgttttagtgggatattctgctcctgtgtttggaatcagaatgaaacatggggtcggagtggcggggggggcacaaatgtaaaggaagacaagttgggaggctgtgttaatattgttagtatttattacacaacagagtgatacacacctgctgcaagatttgtgtgtggtttttcagagtcattttcacttggaatgatttatgcgatatacacggaaggtatttttttgttttctcaccacttttaattacgtgcatgttttaaattactttgcttttgtttcagctgtgattgttagctctcttagagaaatttaaatgttttcttaaaccaagagttaccaaagatacagcaaataaggctggtaaacatctcaaaactaagccaacctcactaactagtctgcagatagagaccaacataaatatcacagggtctaaaattacaaggcactaatgctaatgccaactctagatagtgggcagttgatctactttttctgtggagtaaagtcaatgtaattttgtatgtgtctataaatattataagttgaaaacatttaagtagaacagcccctatccacattttcattaacctgcatggtataactatgtctatatttatgtgtacagatatattcactttgaagtacatttgctgtccaaaattatagctagcccgttttaaaaaactgactatgtattgtggctgtctctaatccataacaatgccaaatttcccaaggcctcatttcatattgtgttcctgcatgtctgactaagggtttatttcatacttctatactaaagtgcaatgaaagctaaaaccgtaacaggggcagttctttcgcttattctcaaaggatttatctgaagtcaaaaggatagaaacagattctaagcaactttcaggctataattttttttgccagaaaaacctaactagagcatttagtaagaaagaagaatgagaaatactacatgaacccccaaaaatgagtctatgaggaaaaaaaagaaacaaaagatatagcccaattttgatatccacagataataaaaggaatatgtcttagtgcccagaaattattaggatttacatcctagagattggatgacctcattgctccaaggatccaggctaactgtaagtgagcaatcagagaactactgacaagcccatcacttcttccgggcaagaatttctaaactacagttcgcttagcaattcccctccatgggcataggggaattccccttgtgtgtgctgtcctgtgggagagctgtgtttgttcttgtctgaatcattgtgcagttgctgtcttgttctgccaaggacagtgctcagcacagggagatagagtagaagataaaatctgcttagaaacaaatctagttagaaacaagggacgtaattcaggaatctcagaaatggagagtgcttgatgataatgagaagccatataagggaaatacattctaatacttggtgacatgcacgcaaagagaataagagtaagaagctgttgtacaagccatctttcaatgttcctggattcaatttctcattaggttatttgccttgtgtcctctcccactagtaatgttttcaaaatggagaaatactttaaattataaaggtatacagatctgatataaaagttgaacaaaaagtgtgtgaaatagaaaattatcttccaattctataaatccactcctcagagtaaccattacacacatacatatatatgtatcacacacacacacatatatctctcacacaatatatctcacacatatatatatcgctcacacacacacacttatatatttggcttaccagacaattaatatataaacataccttagagtacaaatacgaaactacaaataatttttttacttttattttaggttgagggatacaagtaaaggtttgttatataggtaaactcatgtctgggggtttgttgtagagattatttcatcacccaggtattaagcctagtacctgcaggtattttttctgttgctttctctcctctcaccctctatactccattctgaagtaggccccatgtctgttgttcccctctttatgcccatgtgttctcatcatttagctcccatttacaaggagaacatgcagtattttattttctgttcctgcattagtttgctaaggttggtggcctcagctccatccatgttcctgcaaaggacatgatcttgttctttcctatgtagtactctatatatacatgtaccacattttctttacccagtcaactgttgatgggcatttagattgattcatgtctttgctattgtgactagtgctgcaatgagcatttgtgtgcatgtgtctttacgtaaaacagtttatattcttttgggtatatatacccagtaatggtagtgttgggccaaatgtagttccacttttagctctttgaggaattgtcacattgatttccacaatggttgaactatttacacccccatcaacaatgtataatcattcccttttctctgcaacctcatcggcactgttattttttgactttttgatagtaactattcagactggtgtaagatggtatctcatttggttttatgtgtatttctataatgatcagtgatactgagctttttttcatatgctattgccacatgtatattttctttagaaaagtgtctgttcatgtcccttgcccacttttagtggcttttaggggttgttttttcttgtaaatttgtttgagttccttaaagatgctaggtatagacctttgtaagatgcatattttgcaaatattttctccaattctgcaacttatctgttacccttaaacagatagtttactcaataacaattcatttccatgttcgtatcttatttatgtattggctgcaatgatatccattatataaaactattatttttttaacctagtaagttgaacccaatttttatatatatgtaaaatatatatgtatatacacacacatatatatatataattaggttgcatatatatacataatatataaattgggttgcgacttactaggttaaaaatatagcacttttgtataagtataatgtgtatatatatttacatgtatatatcaggttgatatgtatctttgcctatgtctatgttttttttagattaaattcagagaatatacatatgtaatttggatacatgctttcatattgcccactagaaaagtgatataatttgtagtcttccagaagagagtttacaaaagtgccattttttaatataaaagtcaacattaaaatttatattatatgctatattttcataataaaaattggtctggctttttttttgggtttatactgcttgtcaaaatagaaagctagaagccatactactgatgtctgaataatattgtcatagaatctatggcagtgttgaggggagaggaagatgaagttttcattaacgaaggaaatgaacataggtgaagattccacatgggaatgtgttgtgtgttgattaagggcaatttgggggcacaggaaatacaggtaacttctcttggagctgttagaaatgatatctcatgtgagaggagaaggctggggaagaaaaaggggacagccctcagaaagtacatgctgcgctaaatatcctcataaggtgtttgaagagaaaaacttctaaaggactcagcaactcattatttctaagatctgccacagtagttcattttaggaaatatgtgtgtggctagaaaagcagaataaaaattggagtacctaagaaaatttttcctcccaaatatattttccatcacatagtagtcatctattcactgtatctctaccttgaaaaactgcaaacacttttggaagaggtctactttagccaagttcatgaaaagttactcgctacgcatggcttattatcctactgagcatgagtacaacttagaatcattcttaactgactggtatgggtgaatattagcaacagatcagtcagccctttagtaagcatacgtatttattccttttatctatattttatacatttttttatcaacgccatatcaactctcattctgagtgtcgatttgtgacagaaggcaaaggaaagaaaaacaattacataaaggagtctgtaagtgtcaacaataaactttttcataattttgtgaaggatttaaccatgaattacatctggtttcaggagtcctgaagaacaacatttttattctagaaatatattagaagaaaagtattcccaatatgtcctatagctaaacttacatattatcgaacagaaaagaaaaaattagacggagaaggagagacatatggaaaaccatgagaaatatgaactgtctgtactcatgtgaaaaggcagaaatcaaatagaaaagaaggtttcctctagcattgttaagaaatacatggaaatgaaaaattcaaagtgaaaatgcctctaaaaataaaattttctttctaaattataagacctatattcatgcttttaaagtatttccaatcagtggtatattctagatcaatttttatattagaaaaccaaaattactcacttttcaatatagttcctagcgttttaataactattattttttataacaactaaagacatattaggtattgtcacaccattttataaaatatacacacatatatatatgtatttacacccatacgtctgtgtgtaactacatctctctctctctacctatcgaatgaacgattgattgatctaacatcaatgaattctaagccctgagtatattaatagcagaagcaaaatgaaaactcacgtctatcattttagactatgttgcagaatgaatatcaactcatctaattctcattattagagaaaaacagtcaaggggattagagagttagtgttactagcaatgtcaggttgcatgtcagatgtattgatttcagtccattttttgtttcttttactgacagaagaatccttcttgaaagtaagtaactcatgaacaccaagctagtgacttgagaagcttatttactcttcctgacctgattagaaagtagtatctgagtgagaacatagtttaaatgcagcaattcttgcctatcccactctccgagtcatctcccatctgtggtttctgggcccatctctggaaaataacgttcaatacataatagaccctgaatggatggggagaagcacagcacaatcatttcctgtggttagtgagtcacactcttaaatgatttctttgatattaagaaaaaagtgaaaggaaaattcctgctatcatgaaaacttcatgctcagcggaaaagaaatggctctttcaggtcccaaaatatagatgatcattgattaggtcccttcttccctttctctctctcacctgtgtggttcttacccaagaattataaattaatatatcttaatattcattatattgtgtgtgttttttaaaatctatttctatggggaaataggtacatgtaaaatacacatgtattgtaagaaagaggaagagcaattatagtagccaaagacagttatttcataggattcaattagtatacaaatgaaggtaaatttatgtagagaagacactattcttattttttaaaattttgtattgatacataacatttacatatttatggggtacatgtgatactttcttacatgcctggtatgtgtaatgatcaggtagggtatttggggtttccatcacctggagtatttatcatttctatgtgttgggaacaacaggttatctcttctagctactacgaaatgtataatacattgcagttaactctagtcacctattctgatgccaaacattagaacttatgccttctatgtttattccctgatatggtttgctctgtgtccccatccaaatatcatctcaaattgtaatccccatgtgtcgagggaagtgggagggacctttggaaggtgattggatcatggggtaagtttccccctatactgttgtctgatggtgagggagttctcaaaagagctgacggttttaaaaatgtttggaagttgccccttacatttatctctgccactgtgtaaggcattcgttgtttctgcttcatcttttgccatactgtaactttcctgaggcttccacagtcataaagaactgtgagtcaattaaacctcttcttccataaattatctggtctctgttatttctttatagcattgtgaaaacagactaataagagaactggtaccactagagtggagtactgctataaagataacctgaaaatatggaagaactttggaactgaataataagcagaagttggaacagtttacagggctcagaagaagacggaggaatatgttgggaactggaataaaggtgactcttgttacgctgtagcaaagagtcggcagtattttgcccctgccctagagctatgtggaactttaaatttgagacagatgattggggtatctaatggaacaaatttttaagcagcaaagcattcaagaggtgacctggattatctgaaaatgttcagttttatgcatccatgaagagatgatgggaaattggaactcattttaaaaggaaagcagagcataaaggtttggaggcaagccccaagctcagcgcttcaatgtgtgttgggcctttcagtgcacagaagtcaagaattgaggtttgggaacctccacctagattcagagaaggtatggaaatgcctggatgtccaggcccagaagtccaggtccaggagtgagccctcatggaaaatctctgccagggcagtgcagaagggaaatgtgggttggagtccccgcctccggcaacacagagtccctactgtggcactgcctagtggacctgtgagaagaggtcaccatcctctataacccagaattgtagatacactgacagcttgcactgtgcacctggaaggccacagccactcagtgccaaccagtgtgagcattctatggggtatatactcagaatacagttgttgaattgatttgtgtgacatacatatacttaaattaactggatattgccaattgttcccagagcagttgtatcaacttatgcttctactagttgtatttgagaataccattttccccaaattctaatacttgacattatcagaatataaatttttaccaatttggcaattaagtggaaaattgttgtttcaataatttatttattcaataatttaatgagattgaaaactttttataatttatctgttctggctttcactttctaatttatgattaacatttttctactgatttatacatgttctttataaattctggaatatgcatactaatcctttgactgcttacatgttgtaatactgtagtcacttgtatttttgccttgctcataataaactttgatattaaaattgtttcattttgatataataaaatgtattattgtttcccataaggtatataattcaaaatcttatttaagaaattcttttccacctgacttcttataaattgtctgctttatagatttaaagttttttatttatgtttgtattttagttcagtgggattttatttttgtgtatttggtaagaaaactatttttcaaaaatattctatattgagaaaaaattgttgctaatattcactagttcattctaatttttattcatttgccattccaaaactgtcatttatgtagagcctggttctcaactctatcccatttcactgatatttgctctttgctttttccttttaaatttctattgaaacatatttcccaagtatccattgagagataaatagatttaaaaaatgtggtgtatacatacaatgaaatattgttcagccttaaaaaaggaggaaatcctaccattgcagtaaatgataaggatggacctggaagatgctatgctatgtgaaataatccagttccattctctcatgtctttctccctctcctcaggtctcctttccctgagatacaaaaatataaaattaagataattaataactttacagtgacctctaagtattcaagcgaaaagaaaatcatttagcttttaagtcaaaagctagaaataattaagtttagtgaggaaggcatgtcaaagctgagacagcccaaaaagtaggcctcctacactaaacagtcaagtggcgaatgcaaggaaaagttattgaaggaaatttaaaaggctactccagtgtacacattaatgataagaagaaaatcagtcttattgctcatgtggagaacgttttagtggtctggatagaagaggaaacagccacaacattcccttaatccaaagcctaatccagagcaaggccctaattatgtgaagctgagagaggtgcagaagctgcagaagaaaaatgggaagttagcagaggttggttcataggtttgaggaaagaaaccatctccataacataacagtgcaaggtaaagtagcaagtacgatatggaagactgtagcaggttatccagaagacttagctatgataattgatgaagtagctacactatacaacagattttcagtgtagatgaaacagccttatcgtggaagaagactcatcgaggcttttcatagagagaagtcaatggctggcatcaaatgacagctgactcttgtatagaggctaatgcagctggtgacttttaagttgaagtcaatgttcatttaccactctgaaattttagtgcacctaagaattatcttaaatctgctctgcctgtgctctcaaaatggacaataaagtctggatgacagcacatgaatttatagtgtggtttcctgaatattttaaaccactgttgagatttacttcttagaaaaaaagatttctgtcaaaacattactacttattgcagtgcacttggtcacccaagggttctgatggagatgtacaaggaaattaatatttttgggctgctaacacaatatcctttctccagcccatggatcaaagagtaattttgacattcatccttattttttttaagaaatacattttgtaaggctatagctgccatagatagtgattctttaatggatctgggcagagtaaactgaaatccatctggaaatgattctagatgccgttagaactttcatgactcatgggagggggtgaaaataaccactttaacaggagtttggaagtattgattccaactctcatgaatgattttaagggattcaaggcttcagtgaaggaagtactgccgatttggtagaaatagcaagagaactataattagaaatggagcctgaagatttgctgaattgctgtcatttcatgacaaaacttgaaatcaacttttatatttctaaggtgtctgagagttaataattttttctttctcttgaggaagtcaaatttgcttctaaactgtctctattgtttattatttttatctagaattttaagccatctttaaaatacataagttttgctatttatattttaagatcacttaaatttaccaaccatatttaccaaggtgtttttttagataatagactttggtttttaaagaagtttcaggtttacagaaaaattgggcagcaggcaggtttccatatatactatccttttctcttgtagttttctctattattaacatcgtgcattgcggtgcatttgttaccaatgatgaactagtaccgatatattattatccacagaggctctagcttgcgttagctttgtgaagttctatgggtctggataaatgcataatgttttgaatcaccgtcgactactatacagaagagttttaccacccgaaaaatcccctgttttcccttctttcttctattttagtccctggaaaccacttacctttatgctgtctctatagttttcccttttcagtaggacttacagttggaggcatgtaatattagctttttcagattggctccttcatttagaaatagaaatttaagatacctccatgtctattcatggcttgatagcacattttttttatcactgaataatattccattgtataaatgtaccatagtttgtttatccattcaatactgaagaacatcttgcctgcttccaagttttggcaattatgcatagactaatataatatccatgtgtatgttttgtcgaaatgttttcacctcatttgggtaaataccaaggagctggtttctgaattagagagtaaatcaatgcttagcttggtaagaaatgccaaactatctataaagtttttatactactttattcccattaacaatcgagagatttcctgttgttctattccttgtcagcatttattttgttaatgtttcatattttagtcattctaataggcatgtaaagtatctcattgttttaatttataattccctaatggcatgtgatattaagaaccttttatatgcttatctgccatctgtatagctttttgtgaggtgtcttttcagatttttgtcaattgttgttggattgttttcttactgttgtaagagtttttgtgtatattttagatcatagcctttatcagatatgcaccttgtaaatatgttcttgctgtggtttgcctcttcattctagaaaagtgtctttggcagagcagaagttttcaattttaatgtagttcaacttattaaatttcttttatggctctggtgtcatatctaaaaagttatcaaactcaaggacacctaaatctatcctctgttattttctatatttctatggttttgtattagtcagtttttaccttgctaaaaagaatagctgagactgggtaatttgtaaagaaaagaggtttattttggctcacagtcttcatgctgtacaagaagtatagtgccagcatctgcttctgctgagagcctcaggaagttacaatcatggtgaaaggcaaaggaggagcaggcacatcacatcgctaaagagggcacagagacaatgagaaccggaggtcccagactctctcaaacagatattttataaactcagaaactcactcataaccgtgagatggcatcaagctattaatgagatctgatctaaccccatacccaaatgccttccaccaggtcccacctcccacactggggattacatttcaacatgagtttagaggagacaaacatccaaaccatatcaggttttatgttttacattttgatgtatgtccattatgagttaatttttctgatacatgtaatgatatatgtaatgtaatatgtaatgataatgtataatgtaatgatatatgtaatgtctgtgtccagattattattttttcttttttgcgtatgtttcccaacttgtgttccagcacgtttcctgaaagactgtctttttctatgaattccctttgcttctttgtcaaagatcgactgactatatttacgtggatttattttgggttgtctatcctgtttaattggtctatttgtccatttttcaccactaccacaatgtctgattactgtagatatatggtaaatcttaaagtgggttagtgccagtcttgcaactttatcttcttcgatattatgttggctattctgagtcttttgcctttccatgtaaacattagaacagcttgttgatactcacaaaataatcttctggaatttttattggaattgcaataaatagaatttgggaagaactgacatcttaacaatattaaatcttcctatcgatgaatatggacatctctttatttagatcttctttgctttcttccatcagtatattttagtttcatttgtgagaccttatacatatttttctagtttactaagtattttttatttgtatgtttggtgctatgtaaatggcattgtgtttttaatttcaaattttaattcattgctgttgtacaagaaagaattgactttcatatattaaacttatatcttcctacctttctataataatcagtttcaggtattttttcttggagattttctacatagacaatgatattatccatgatctaaggtaatttatttccttcctccaaatttgtatatatttatttacttttctttttttattgcattagcaggtctttcagtataatgatgaacaggagtagtgagagacgtatcatcttatccccaatttatggagaaagtatctagtttctcaccatgaaataggatattatctgtcagttcctttagatgttctttatcaagttgaggaacttcctctcaattccttgttttcagtttgtttttaatttttatcattaatgggtattggattccatccagtgctttttctgtatctactgataaattatatgatttttcttcttcagtcaatttatctgatgaattacattaattgattttgaaagtggacctagccttgcatacctgggataaatcccacattgtcacagtgtataatttgtttatacattgttagatttaatttactcatattttgttgaggatttctgtatttacgtcatgaacgataaccgtctgtagttttttcttacaatgtctttgtctcttttgggtattgggtaatgctggcctcatagaatgagttaggaagtaatgattctgcttctattttctggagaaatcgtgaagaatttgtgtaattcctttcttaaatgtttgatataattaaaaattttattgtcttcctattttttttttttttttttagatgaagtcttactctatcacccaggcggagtgcagtggcttgatcttggttcactgcaacatccacctcccaagttcaagcaatttcatgcctcagcttcccaactagctgggattcccggcgtgtgccaccatgcctggctaattttgtatttttagtagagatggggtttcaccatgtttgccaggctagtcttgaacccctacctcaagcgatccaccttcctttggcctcccgaactgttgggattacagatgtgatcagcatgcccagacaaaaacgttattttcatatacttacttcttttcgtcccaatcctcctttgtggaatcatttttattattcaagaaatacatcctttagtaatcccttcagtgcaccttgtgtgtagaaattcttttgaaaatcttatgtccaaacatgtttttatttcattttttgcttgtttgtgaaattttagtttggtaaatatatttccttgatactttggtgattttatacactattttcatctcattttttgtttttattgttgttggtaagtagtttgctatccatctgattggatttgtgttcattctgatgggtctcgtcctaggtacaagtttctgagtacgatttttttcccctatttggaaaacgttaagaagttttgctaattttcatgtctgggtaaatttctaaaaatcatccttggaattctggaaacacttgtaggctgaagaattatacctcaactacggaaaattttcattctgtactaaatatttctttttcattctctcttaccatagaaagtaatacttcttaccttctgtttcatactttttgtctctatacagctttctgttcactttgagacttgatttgatctcctattgtagtaagttactctttagcatctctacagtttagttattattttatttcaaatactttgttttatatgtaacttttattcttttctgattgtttctgtgtctgcctgtcgttctttcatagcatcttctttttatggatttcatttttccctcttgaaacgtatttattttaaaaaattccttgtgaattgtactgtggtctggttcttgtaaattccctagtttattgattctgtggacactattttatggaattaataggtatttttctcatatgtattctggggaattcttcactttctcttcaggtgacactataggtttctcagaactgaatcaacacttagatttatttctcagttcagtagttttgtaactaaaggggggatcagttcagacccccacagtaatcaatacatgtgcttgtgattcttatagtatggtattctctgttttcacatatgtcctgggtaagcattttgtttgtggctgctacaagttgctgctgaaatttcaagtcactgttcacataagtaatagcccttgtttaggctcaagctcatgcagggagcccagtgctttttcactgactagtgatagcacctcctgaatctactcttccgacactggcttaaagcctgggtccctgaggcatacatccagtctcatttccccatagcacatgggtttaaatcttactgggttttctcttggttccaaacaaccttaactgagacggataaacatacctgtgtatgctcaatttaacatcttgactggaagccccagaaactattttttctggataaaaacctttctaagtgaagcttaagtgcctaattggctgctactgaagtctcagccataatttgaagtgaatgtctttatgattccttgttgggctttgttaagagttttttttttttttttctctttctaataattactgtttctgtacttacgtgcttagctcatagtaaaaaagaaaagattcttagttgctccttcagttttcctgataggtgaaaatagatactggagcatggtttttctctttagttctcattctcctttaaactcttgttttgtttagggatcttatgaacaagtagagactccctcactaattgcttaaatttctgtgctttgagttgtctgagactgtcaagcatatcaagagcaaatctgaataatgactggatcatctaaggtaatctcctttgtcaaacaattgctttcttgaggcttagaagcacagatgaaaaaataatacatatgcaccctcacaactgattaatattgatccaaaatcttgttcatttattgacctcattcatctaataaatatgtactgaatgcttattgtgtgccaaatattgcagtggaactgaaatacaacagtgaaaaattcaaatatgctcagtgccttcatggattttataatctataacagaatggacaaactatgacccagaggctgcaggaacacaaatacacaaatttgtaacttagtgtctgtggatgctttttcacaagagccaagttgagtagttttaacagagacatttgcctgggaaagcctgaaatatttactaactggtcttttacagaagaggtttgctgccactggtctaacaaatgacagagacactaaacaattaaatgtaaaacctcaagtaaagagagttactgagaaggaagaatagagagtcttggcataaacatgagagccatgtcttgttgaggatacaaggcaatggcaattggtctaatggtcacttaagaatgtataagacttaccacaagctaaccgggagaaaatagagtcactaaatcctttgggacaaggagacagcatggggaagcacaatacaaaacagaacagcacaatacaagacagcacaatacaaaaacagaagattgtttatctgaaagagtaagtcagagtggcaagaagtgagtctagagaggtaggcaggaccagttcacacaaaagcttttagtttttattagtagttcagacattttattaggaaaatgagaagcctttgagggttttttaagcacaaagggacatctagaagtccactgtaatttctagatgagagaatggtgagctggacttgagtgatgagaaagatgatatagtaggtgattgaacttgatgtgggtgttttgggaaatatagaaattatcatgactcccaggtttctcttcagacactgtcatttactaaggtggtggaaacagagagagggtcaaaattgggtggaaattctgagttaaatttttggggtatgttgaatgagagatgtgttttgaattcgcagcggctagaagtctagacagtctagagccaagaagagatacaggtatgggtaaaaaggtggaatttttagagagtttttttttttttccagaataaactaaaacaacagaaaatacctgtgttgcttgtgggttttaagggtagtgagctcttgtatgaaaactttctttgctgtagcctgtaatattctgtgtgggtttttgtttgtttgttttgagatggagtctccctctgtctcaggctagagtgcagtggcataatctcggctcactgcaacctctgcccctccagggtcaatgattctcctgcctcagactcccaagtagctgggactacaggtgcacaccaccgcacccgctaatttttttgtattttttttttttttagtacagacggggttttgccatgttgtccagttggtcttgatctcttgacctcatgatccacccacctcagcctcccaaagtgtcggtatacaggcatgagccactgcgcctggcccattctgtgtttttgatcagggaagcatctacgagcttcacttctatttctctggggtaactaggcaataacaaagaatggaatgggttgggatgcagaaggaaataagcattatatgaccccctacatgttacaaatttcctcaaaattaacatattctcagcccacaaaattcaaatgttacatctaggtttctcaaattgggtaaatagtgtatgttcaaaatgtgactaatataagacttatgatagaaactgataataaaaatttgtttatatagaatctttgtagtgatacagtttttctgtcctaatgcccttccaggtaaattttcaaaccacgcctctcttaggtgaaacagcttgtcagtgggtatactcctctgttccccacccttgtcagtgcccatcttgagtccctcaagaccaatagcttatcatttcataggggatataactctcgggatgatacagtactaccaatagtataaaatactaatctatggtgcttatatactttaaatgtacatttatatctccagtttaagaaaatgatgccaacccccagtgttcaagagaatattgtatcattaatatgattgtttttgatatgtgacttacttcattgtttgcataaattatggaaatttatacaatagccccaagaatcaaacacaaatctacaagaagaaaagtgttgacaggctaatttttcagcattttcttgagtttgtattgtgaaacaatattttcactcttagcactaagagcgaagtttagaaatggtcccaaagcccaaaggcctcaataaaattgccctccctaaatagaaatatctgcacttgtagacaaatctaaatagtttccacattacagggtcattgatagaaacattaaatacaaaaattaacatcttaacccaaggctagcagataagttaggttattctttaatggcaaagaagtgacaaaattctgtaaaggaaaaaggatgggacattttaactactctttaaatcaatggtcatatgaacaaagaacagccagtatctttataaatgacttgcaaaatagaatgagattttatgtgagacctctatctgtatagatgggatattagggtatagtaattttgcagttacgttggaacattttaagataagaggtaagagtaactggtgataagatatatataacattttcaaatttaaaaaactaaaactcataggtcgtaatgcaatccattagagagaaatagcagtcatgaaatattcttcaagcttaacagtgatggtttggaggcttaatcaaactgaattaactttcacaaaatgactctaaggtaggctgctgattatcatactcaattagtgggccctgtgtttttctccgtttaatggtcaaattggatacatccagtcaaggacagctgtgggtgattcctttccaactactcaattcagttcctgccaagatttccccagtgtcaattgcaatgtcaattgtaatttactgttttccaaagagtgcttgaagattaagagtattttccaaaggaagatattagactaaagattgaaggttttgtgtttgtttgaatcaactatcttatttttgagctttacacacaattttagaaaatacactggcatttcagctgtggtaccctctgggtgacaggattatgggataattttaatctttaatttttattttttgagatggagtcctattcactctatcaaaatgctggagtgcagaggtgagagaggtgagatctcggctcactgcaactcccactacaggtgcaagcgatttttctgcctcagactcccaaagtgctgggattataggtgtgagtcacatgcacagccaattttaatctttttatgcttggtcaatttctaaaattatttgcattagcttatttttatataattatgtcattaaaataagacatataagtagttaaaacttaagaagtgctaaatggcatacaattaaaaataccagttcctgctccacctctccctatttctacacttgtttgttctgctctttaccaccatatttgatgagcacatggagattcattatacattctatctattttcatataaagtattttataacagtggtaaataaaacaatactattgaaggtaaaataaatcaaataaaaaatatattgctatggctatttaaaaatttttgtatatctactgattgttacgagagagatgatactttgacatttttaccataatttatctcccatcccactgtagtagtccattttcatactctttaaacaactgaccaagacttggtaactttaatggaaagaggtttaattgactcacagttcagcatggctggggaggcctcaggaaactataatcatggcaaaagacaaaggggaagcaaggcaccttcttcacaaggtggcaggaagagaagagtgaagtaaagggggaagagcccctgataaaaccatcaggtctcatgagaacctctcactaccatgagaacagcatagggaaaaccacccctattattcaattatctccactggtctctcccttcacatgtggggattatggggattacaattcagaatgagatttgggtgtgacacaaagcctaaccatatcattctgcccctgacttcctccaaatcttctgtttctttacatttcaaaaccaatcatgccttcccaacagtcccctgagttaacccaaaagtccagtccaaagtctcatctgagacaagtcccttctgcatatgaacctggaaaaatcaaaagcagttagttacttccaagatacagtgggggtacaggcattgggtagattttcccattccaatgggagaaattggccaaaaccaagggactataggccccatgcaaatccaaaatccagcgggcagtcaaatcttaaagctccaaaatgatccctttgacttcatgtctcacatctaggcatgctgaggcaagaggtgggctcccatggtcttaggcagctctgtccctgtggctttgaagatacagcctctctcctggctgctttcatggactggtgttgagtgtctgtggcttttcaggtgcaaggttcaaggtgtcagaggatctatcaatctggggtctggaggatggtggcctcttctcacagctccattaggcagtgccccagtggggactctgtgtgggggctacaacccacattacccttctccactgccctagcagaggttctccatgagggctccgcccctgcacaaacttctgcctggacatgcaggcatttccatacctcctctgaaagctaggcagaggtcccaaacctcacttcttgacttctacatacccaaagacccaacaacacattgaagtgccaggctttgggtttacaccctctgaagctgtggcctgagctgtacattggccccttttaacacagctgggatacagggcacaagttctgagactgtacaaagcagcagggccctgggccggcccacgtttttccctgctaggcttctgggtctgtggtctgtgatgggaggggctgcctgaagccctctgacatgccatagagacattttccccattgccttggtgattaacatttgctcctggttacttatgcaaatttctgtagctggcttgaatttctcctcagaaaatgagttttcctttctatcatattgtcaggcagcaaagtttccaaacttttatgctctgctttgctttaaacataagttccaattccaaaccatttctttatgaatgcatacaactgaatgctttatgagcacccaagtcacttcttgaatactttgctgcttagaaatttcttctgccacatctgtaaattatgtctcacaagttctaagttccactaatctctagagcaggaaaaaaatgcactagtctctaaagcatagcaggagttaccattattccagttcccaacaagttcctcacttcatctaagactacctcagcctggacttcattgtccatatcaccactatcagagtttggtcaatgccattcaacaagtctctaggaagttcccaacttttccacatcttcctgtctcttagccctccacactgtcccagcctctgcctgttacccagtgccaaagtcacttccactttttgggtatctttatagcagcatcccagtctctgtagtaagaatttatttattaatcattttcatactgctataaagaactgccacaccaagcgaagtggctcatgcctgtaatctagcactttgggagactgaagtgggtggatcacctgaggtcaggagtttgagaccagcctgctaacatgatgaaaccccgtttctactaaaaataaaagaaaaaaaaaattagctgggttggtggcgtgcctgtaatcccagctactcgggaggctgaggcaggagaatcacttgaactgggaggcggaggttgcagtgagccaagatcataccactgcactccagcctgggcaacagagcaaaactccgtctgaaaatacataaaataaaataaaagaactgcctgagactgggtatttataaaggaaagagatttaattgactcacagtttcagcatggctgggaaggcctcagaaacttaacagtcatggcagaatgtgaagggcaagcaaggcaccttctttacaaggtgtagtgagaggtgacagcgtgctggcagccctcgcagccctcgctccctcttggcgcctctgggcctcagcgcccactctggctgcgcttaaggggccgttcagcccaccgctgcactggggagcctgtctctggggtggcccaggctggagctggcttcctcagcttgccgggaggttggagggagagacgtgggcgggaacccaggctgcaggcggcacttgcaggccaactgagtccgggtgggcgtgggctccgtgggccctgcactcggagcccccggccaggggcagtgagggcttagcacccgggccagcagctgtggtgggtacgccaggtcccccagcagtgctggcaccagccaccagccgccggcgcagtgctcgaattcttgtggggcctccgctgcctctcgtggggcagggctcggggactgcagcccgccatgcctgagcctccccctcctgcattggctcctgtgtgacccaagtctccccgatgagtgctgccccctgctctgcggcacccgatccatctaccgcccaagggctgaggagcgcaggcgcacagcgcagcactggcaggcagctcgcctgcagccccagtgtagtgcgggatccactaggtgaagccagctgggctcctgagtcagtggggacttggagaacctttatgtctagctaagggattgtaaatacaccaatcaacttctctaaaacagaccaatccgctctctgtaaaatggaccaatcagcaggatgtgggtgggccagataagggaatacaagcaggctgcgccagccagcagtgacaacctgcagggtccgttccacgctgtggaagctttgttctttcactctgcaataaatcttgctactgctcactgttgggtctgcactgcctttatgagctgtaacactcaccgggaaggtctgcagcttcactctgagccagcgagaccacgaacccaccagaaggaagaaactctgaacacatccgaacatagaaggaacaaactccggacacgctgcctttaagaactgtaacattcaccgcgagggtcgcggcttcattcttgaagtcagtgagaccaagaacccaccatttccggacacagtaggagggaggtgctgagtgaagggggaagagtccgttataaaatcattggatctcatgagaatcactatcagaggaatagcatgggggaaactgcctccaatgattcagttatctccacctgtttctcccttgataagtggggattatggggattacaattccagatgagatttgtgtgggacacaaagcctaaccatattacccactcccactcttaacacacacattttaccttctcaactttccctccctccagcctcccagaaattaagggattacattatgcgtatatctgtatttccaaagctcatccatgtggtctactggaatgtgttcactctgttgtgatgatttgctatatttatctttgcttatcactaattaattccagaaatcttacagagcaagaagcctttattgtggtcaagcacatcatttaaactctgtttaattttgtatttgagggactttttcaagtgtttccctctcttctgatctggaccagaatctttcgtttttggtgggttctgaacacctggaaattttcttcaccttttctttgtgcgcatgatggatcccattttctggatgcttgacttccttttgcttattgccttgttttagtcaagcacattctttagcagcttcctaaaaagattgcagggcaggttacactttttgggagcataaatgtctaaaaattctactattcattcttaatttgatggtagtctagctgagtgtagaattctagactgcatttcatttcccttgaaattttgtaggcaattacctgattgtctctgtaaactaagtgaccaatgcaaattcaattgatttataggtttatgttgccaaagttgaggacgtgctcagggaaaaagaagtcaagacacataagatttgtgtcttgtgctttttccaaagtggattttgagaacttcaattttaaaggggaaaatgggaagaaagaaaaaatggggagggtaggcaatggggcaagtggttcattcctgtgaggctttgattagcactcagtgaatttacactttacatgtgaaaagaggaagtgggaggaagtcaactatgtatacttctctttctcagtaaatctaattttacatagattaaagtcagcatgtgaagttacatctatctattcgggaacaaaaggaagttgtgttttgttttgtttttttccatgactcagttccccaccttaactttccttttggtatagttagtttggggtcttgagattttattattttacatattttagcttctatatgaaaattatatgtcatattgattactaatcttttatgtgacctagggtttttttttttccacataaacttttcagactcctgtctttatttttagtgtttctgaaaaattataatggtgtgccttgttctggtctctcttattcattgttctgtgcatttatatataatgtttattctggagactgagtcttcaatgctagcaatgtttgttgttgtatctaataatttcctctctttattttctcgatcactttttctggttttatattatttgtttgtttgactgcctggaaagagctgctgatcattcgtttttccttccatttttgcctcaacttttctgttgattttttatttgaattacaatatctcatttgtaattttctagatatttttctggtttttgaatgttctttttatgtgccttctgttctttttatttcaaaattttgattgcaataatttagattcatatgcagtttaagaaaaaatacagaaagttgtgcatacattatttaggactaatggtaacattttattatctatagtataatattacagtcattgacattgatataatccaccaaactaattccaatcagccagttttcattgtgcttgtgtatgagtgcatatgtgagtgtgtgtttggttctactaattgtatcatatgtgtaggtttgtgtttctaccaccacagtcaagtttcatcaccacagggtggctcatatattacccttttataaccaaacttacatcctcttacttctctaaccatgttgctacaatttttatctcttaaaaatgttacttaagtataatcatacaatatgtagttttccaagacttcctttgttcactaaggataatgcctttgtgattcatcggagttgtgtgtgcgtagttcatgcctttttattgctaatagtccatggtatgaatagaccaccatgccttaactgttcacctgttgaatggcacctgggctgatgccagttcttagctgttacaataaagctgttatgaacattcatacacagatttttatgtgaatgtaaggttttatttttcgatataattgtccaagagtgcaggtgctaggttgcatggtgattgcctatttagttttaaagaaactactgaactgttttcaaactgtttcttgcattcttacgtttgcaccagtaattatgtgttgattcagtttctcttcatcctcaccagaatttggtgttgtcaccatttgttttttagtcttccatagaggtatgtagtgctgtggttgtaatttgcaattccctgatggcataaagctgaacatcttcatgtgcttcttttctgtctatatgtattcttcattgcaatacttcatgtattttgcccatctgctaattgaattacttttttcttattgagtgcagatgagaagcccaagttatcaatcttttttacagattacgatttggtgtcaactctaagaacttttgcttagctctagatactgaatattttcttctatattttttctaaatgttttacagtttatatttaaaactataaaatgtacatagtccattttgagttaatttttgtttaaaggataggtttgggacaaagttcatgcacttgtctacagatgtccagttgttccagcagcatttgtaaaaatgttattcttcctccactgaatggctctacttttgtaaaatgagaaggtatgtcgtgtgggactattgtttttctgctgggtttcgttgatctacatgtctattgctttgacttttattattgtcttaaaggtccctgaggctcttttgagcattttttttagtctgttcttttccgattgtgtgaattccactgttctgttttcagattcacggatcgtatcctccatatctccactctactatggagcctatccagtgagctgtttggtgttttttagtgcatttttcaggtttataaattgcatttggttcttttttgtaacttctaattattttctgagatttctattttttcattagttcctagagatttataacagattactgaactatttttatgacagtgttttaagattcttgttagataatttcaacatctgatttactatgaagttaatatccatgatggtcatttttcattcaagttgtgatttttcttggttcttcatatgacaggtgattttgattatatgctggacacttatttattatattatgtgaccctgggtcctacttaaatctttatattaccaggtagtcaccctgtttagggttagcacacagctctctgcctattttttgggctatggtcccaatgacagtttttcagaacctttgcgatgttattttggtctgcttgtttatctggtgcaggtggggcttccactcacccctgctggtgctgcctgagggaatgtagtgtctcttgtgggtggatggggtggtggtatcctctcatgggtatcccttggctatttagtgtttctggtcagaggaggggagtctcaggcctgtgggatcaaagaggcttctcaagccagttcacttgttgagacttggtccttccttccagctctacctgcctacctcctaccccaatttcttggtagaaagggtctcaggctcattggaaaagaagatcactttccctggcgctcattgtgggtggagcgtccaatcaatcctgcttgtggtgatttagggctgacaatttgtcaaaggtactcttctcctggggaagaatcttcctatgtaggctgctttctgttgctggtttgggaattggaagtgctgcgtttgagtcatcatctcctgttgaggagggagacatggatgccctgatgctgtgttgttcctccagttttggcttcccaaatcagttcttctttctgctaccttttggaattcacctgtgttgtatcttgcattatttccaggatttacagttagctatgtgagaatgagcagggagaaaccagtttctccctagtcttgtttttattttgtattgcaatatcttacctgtgttcttatattgtaatcacaatacttctcttgtctctttgaaatcatagtttcttcttaaacattctctgtctttctgcgttttatgttttctctgttttcgtttgtttgttttcctctcagactttcatgtaagggtcattcctcatataactggtgtctttgcctacttcctataattgtgaggttccaaaatgatgaaaaacagttctgtgcaaaagactggaaagcagccttattcctaaactttctgctcagtatggcttattaccctaccttagctatgaatagtctaagttctgtttcttccctgacttaagactccagaaagctaactaccatattttgccttgttgtgagttggtgagtccattgtttgcctagtttgaaatctgtcatctaattgttctttttaaaagacatttatctcgtgttttcagctcccctttggccctggtctttagaggtatctgatgtttccacttcctgagccttttgggatttttcagtgtggaagactctacttcctcctttacaagacaggctttagtcttttctgactcacctaaatctttgccaggtgtccagtttaaaaaattttgttggcatcttattcttttatatttttccttcaatagttcgtgggtttatgatttgtctgtttatataatgtcatttcaatgggactacagaaggaagagagatgaatttatgtgttcacattttacatatgtttattcatttaaaaaaaattattagataagtaccctgactgagacactcctatagacacttggtaatcaccaaaaattacttatcaatgtgtgcaaaaaattgtaattgttattttaaaattacattactaatttgatttgttggaagcataccaggtaaggaattgctagaataaagtcatgtgcccaagcactgagagagaagagatctctaaaaaaagttaaatatatgagatctcattaagagtatcaattaggagccagaaaatctagatacaaggagagatttaggttcataactaactagcagttgaatttattgttagtagtaagtaaaatgaaatattaaagaagtaaaataaaataccaacataatgatgagataacttttatatactccttattatgagtaaggattagacactatagacatttttttgtgtttgtttctattgtggtgaaataatacataaaacttaccattttaatatttttaaatgtacatgtcagtggcatttagtacattaatgatgtgctaccatcccacgtatccatttccagaacttttttatcatcccaaacagaaactctgtgcccattaaacaaaactccccattttccctcccgtcaggccttctgctttctgtctctatgaatttgcctgtttatatttatcatataagcagaacgatacaatatttgtccttttgtatctagcttatttacttagcataatacttttttttttttttttttttttttgagatggagtctctctctgtccccaggctggagtacagtggtatgatcttggctcactgcaagctccacttcccgggttctgccattctcctgcctcagcctcctgagtagctgggactacaggcacccgccaccaggctggctaattttttgtatttttttggtagagatggggtttcatcgtgttagccaggatggctcgatctcctgacatcgtgatccacctgtctcggcctcccaaagtgctgggattatagcatgagcgacggcacttggccagcttaatactttcaagattgatctgtgccatgcatgggaggaatttcatttatttttaaggagatgaataatatttcataatatatatacaccacatttgtttatcctttcatctgtggatggacatttgggttgtttccaccttttggatatattatctgtatctatatttatatctaatacctaataccttaatgttcttacagcaacattagacacaattattatgattctcttaacatcctaaacagaagttagtcaaaacacatggccaagattgtataacaattaagtagaatggggttgaattaatgtctgtctcactccaaaatagacaaaactttacttacataatttttaaaacgtaggagccacctcaggaataaggaaaagcttgaggagactctgatactgattcttcaaacctccaactttaaccaggtcacctctcctttctgtgattgacattttgtttgaacaaaagattccgtctaaaataaacacaacttttaaaaatgaaatgaaagtccttatatctccaaatttaaaactttcaatgatatttatatgttaggaaatagatgtcttaaatgttgcaaggttattaaataacttaggagaaaaaggtaatgttttctaattaagttgaacaaactctgtcgagaaaaattgtgaaagcctgtaaaaatactagtaaaatattactaagttttatatcttatgtgttcctctgcattatatccgctttcagtgcttttgatctgttttacaactgtacattgtagaaaacataaaaatgcaaatattctcatctgtagaaatgcaaatgaaactcatttgatgaaatgcaattattacttcataaaagagagttttgctttttatttttttaattttatttatttatttgaggtttggaagtcaaactcaagacactagcatatttggtgtctagtgtgggcccattttgtcatagatggcccttctttgtgtcctcacatgttggaaggggtgaataaactcactcagacctctttttaaaaaagatatagtccttatggccaattacctcccaaaggctccactccttaacactattcattgcggattaagtttaacatatgaatggcgggggacaaaaatattcagaccctagcagtaaagtcagagagttttcatcagctgaaatgtttttgattctcattttttgttgtcttatgtgaaataggtttatatggatagctttatatgaaacttgcctcctatgttctgtactttagaaatacctttaattgtccttggttaatgtaatactccatatggaagagatcagagtttcagtcatttctagggctcttacattcttagttctttagttcttttgttagttattgtatttatatatcaagaaaaccagccctttattcataaaatgtgctgcaaatatattctcagtttatgtgtttttttttcctagagttttgctttttaaaataaatacatttcagaatttgattgacctatggatgtgagatcagtatcttactggatccctcagtagttaatcagttaacaaaatattttgcaagagatcattttatatttgtatgagtcatgatattaccttttttaaaaattatcattgaatgatttgctgacctgagatttaggtaaccagtccaaggcctgagattcactcttgaccaagccttagagaaattcctccaaaaagggaatcctctcctaggacccagaggagcttgtgaaagtactcacagactcacagaattcctgagctgcacaagctactctagagatcatgactcccctccgtactctcctcacattgtagaggatgaagcagaactcagcagacccactaatatgttcagtcttccagtaagggagttacaggcagaggcaatccagggctaagattaggtctcctaaccttacagcaagaaatctctggcttggactggcatttccacattagtggaaaatatggaactatcacaaagctatgcagagaatgtttggaatgaaaaaatgaactttattaataaaggaatgttttctgaactgtagaacacatcaatccatgcagttatcaatttgtctcattttcataaacttttaccttgacatgactcaggtaacttttgactttattatttctgttctaaattattcatgtcattgttagtatgctatgtaaatttggcatcctcagcattttagactaatggtcttgggagacaagtttattccaaatggacttgttgttaatgtaaaatattaatattttaaatttatttttgttttataaatatccaggtgggtgttaaatgttaacagagttagaaatgaacttatcaacaatgtatcaggagacttgatctggaaaatccacttaattgtgagggaaacaaatgttttttcttcgagcaaacaaagtcaccaaccttatgcatcagatcatttcttaataaatatatcatagtggcataaatgaatttcagtacaaatgaaaattttttattgtaatgtaatcatgagtgttaggcagaatacaatattaagtatgaaggaaataaatatgtcatatgcttccaaattgtttgtgttattccttaaaatagctttcattctctttctgccactcaaaaaaactttgttcaatttttaataaggtacctctccatcatgattgctgattctgagccctctctctcactttgaacctaccagatttatgcatttgcatcattgatgtagaatcatatcagctttatctttgtttctaaattattcattcagcaccatttattgagtatctttgtgaaccaaggtctgtattaggtattatactttactttggtcttgagggatgaagaaaatttttcagatagaaatgtggaaatggaagttatgaagttggaacagcatttgcaaaaacatgagatggtgaaatgacatgatatcttagaaaaatgtcaatgcttggagcatgaagtccatatactagttgaaattgaagttggaggagaggtgaggaaatctagctttactgtttggctcttctacccaactggattatgtgttctgcaacctagagattacatagtatattattaattatttgagaagttttacatttttttatttcctgggtaaagttaatacaatgcagtaaaaatgttgtggcaagtactgcgggatttctcccaatttgtattctcttctttcccttctatagactctccacatttcagcaggtaaacaagtgtgtgtatgtgtgtgggggtgtgtgggtgtgtatttacacatgtatgcatgcaaggaacatatgttttaatcagcaggttcctgccccgctggaagtctattcaagcagggattaatattttatttcctgctgttccccagagcctagacaatatcaatcatgttgtaggtttgaaaaaattcttgttgaattgatgaaccaattagtttataaaaagaagatagttggatgatatggctttgtgaagaaagaaaatattttcatttaaaagttacgctttgtaattgaaacacataattggaaatgaaacaaataagtcaataaacaggttttccttcacatctgatgaagacaagggtaaaaaatactctccaactgactcatttcttgaggaaaatgaaagagaaatgatagatggaaaaatgacacgaggaagatagaaaaacttaaatgtcaaagagaaaatagatttcaacaaagaaaactgatgaaaggactggttagttactagttggataatttataaaaaacacattgcagaaagaaaaactgtactgttaagactataaagagcaggatggctctgacacccctgagtttagggttttaaattggtatgactttgtgtttaagagagagattatcataccttcccaatgcaaagctgaggttgcagaacccgagagctgaaaatcatgcctgagtttagttttgtaggaacaattttaaaaagataaagtctaatttgtcctattttatgttttaatactgtgatgaaaatggaatttattcaaaaaacctaggatgatttgagtcttcaaataattaaaatgaaatcaccagtaagatatactttcattaagctgttcaaaaatattaataagacttaaactgtgtgcagactctatgcaggatgctaagggaaaaattggtgaatagatagtagtccttgtcctaatcaactttctattcaaggaaaaaagagactgaaacacagtatacacacacataacaaaagaaattaatagtcaattactatttcttgtgaaagaaataatgaaaagcagagagaaagtatgagacagagtgaagctatctgcttaaaaacagcatgttagagaaggttctttgagaagatggatttaggcagataccttaaagtgagaaggtaatgatatgtaaagagattgggaaagagtgttactgacaaacagaatatgcaaaaagtttctcaaaaagaaggaatttagtccagaatcacaaaaacttcaggtgtgtgaatcctagcaaaaaagaagatgggaagaatgaacctgacacattaggtaggagttagatcatgatgagcttctattctatggtgtggcagtcagctttattctcagggcagtggaaagccatgggaagagcccaaagtagggcaatgagctcttgccctcttttctttggaaatcggtgtcaggaattaattaaaatatagctacttgttcagcaacatatccactcatttgagtcggattcagaaaatacctcctggaaatttgtttccatttttgataaaccagagtaagattatttgtgcttcttatgctgaacaaaacttaaaactgtatataggttaattatgttgtatccttttttttttttttttttttttttttttactgcatgcagttatgctttaggggaaatgatttgacttttctgaatctaaatccacaggtcacttgagctgattaatattctaaaaattttcattttgagattttatacatatttatcttgatcatacttacctataatactttgccttgttatatcaaaagtggaatgacaggactaaatgaaataactactcaatctaggtggcttacctacttctgtttgtaaggcatcaagtttgggtataaagcagtgttttcccgaatttataatacttaatcactggcacaactcttatatttctaaatattatttgctttattttgagaaatgagattaacaaactgtggttctgatgtgctggttatatatttttaatacatgtaaaaatgagtgataacaacaaatttattggacatcaagcaaaaatataaaacatactttagagaaaaactgcataaacaaataagatcattttttcatagagctcaaccatgcaccaaaagtatcccttggtggacagacacagagtctgtgcctcctaaaaaatcaatagcaacagaccatgacagagcataagcaaaaaccgagccccaactctattttaataatctgtactccctgtaaactgcgaggcatgggacaactcgacagactgtgtttacaatgcatgaattactgtcgggcactccagccaaaagaagctccaactttcacttctgatctgggtcactagaaacagctcttcagctattgatttggagctcatgactagaaaagactagtgaagagcactgctatcagaggctaagcctgtctcacctctagctcctccacgtgaaacacacacatttggttacatggaagtttttgctgactagcaattaataaattggaacaattaagaaaataggaaataatttcacatcaaaagcaagactaacattgaacctaatttggatgaggcagagtcttggtcagctaaaggcaagtcagataataattgtgttgaaatttgtattagctctctcttaactctctcctcaagagcaggtatgtagtttgtcatcttaaaaggcagaaattcacttgttcagtccaattaaccttcagaaacatgctttaaaacaaactgctcagaagatcaatagtgttacaaatgaaggctgaggtaaaggttaggagtagaatttaccatgataaattctaatggggctttctataatttactgttttcttccctttttcattagaaccatatttcagagtcctctatcttcttctttccctctctccctcttcctctccctctcatattcagattatattttaaactagtaataagggaattttaaatatacactataatatagaaagaatgtcatgatcgcaaattatacgttttaaaaagtgcaaattttaagctcaaattgtgtcctctctgttcattttaacttacaaacatttgtcagtgtgtattatatgctacaatacttcctgttattttcaggataggaaatgactaacatgtaatcactaatctttaggagcttccaatctattggggagagtgatatagacgtataatgcacccacaaagagctataacataaggtagaatgtgatctgagcactaggaaatttaaaaggggtgttgtgatcactagttctggccaaaataatgtaagggacagttttttctctctctctctctcattttttttttaaagggacgggagtaggaattacacttagcctctattccactatctgcagtattttctccaacttgagtccctgatggtcagttctcattactaccacctggttcagtgtttagaaccatgtgacacacataatgattattcagtgaagaaaaactgagaaagtgaagcctgggatatatgggggaaagcctgacaactatgttgtgaacatgaatgtgatcaacactcagaattcttttcatggaactcactgttcactgtcgtaacttttggacatcaatgtcatcaagacattaaggtaatgttcctggaatgatatttgtttatagtttactactgtcccattgaaactaaatgcaaaacaaaatcttgcttgatattatttgaaataggaaataataggaaggtagtcacttcctaccttcctaggaagatagcatgatgataaaataggacttcctatgaacctagcagcttttataactcatattcattatctatttgacctcacaataacctatgcataatgcaagagtgaatcagagaggttcaggaacttccaagaaaaagagaaccagtaatgatcaaagctaggacaaggacccagattctgtctcacattcctttcataaaactacaaaaaaacctctgtgatacaaacttaatcatgaaattaagtcctgccaggattgtcctttttgggaacaaaaaagaccaacagacatcaaaaaaaaaagaaaaaaaatacttcagctagtgcagaatttctgagattcttttttgccattatttcatggggtttaagtgattcatttgattaattaggagctgagtcagctaccttcttttgacgtatttgattgccttttgctgtggcctaggatctatttttattgattgtgcttctgaactctcactattacgttgtcaaatattgttatattaaatggtttggttccacactatgactaagcttcactaaaaggaactacattagtcagaaatttgtcatgatcagatgaaaaactgaatgtttaaatgtcatcatgaacaacctctacgatctgtcatatcacatgttggcctctgtcattagcagtgaagaatgtgtactacaatatttagccttttctccacttttgaataaaggtttgcatgtgtttacatatgtattatatatgtgttatgcatgtgtgcatatattctacacactgtatccttaagctgctttgttattggtagaagatgctgtgaaatagtgcgataacagaaaagttgaatggaaaaagtagaagtcataaatgatttgagaaagaagtaacattacttttagaattattagtataaaaatggagtggtatccacataatcaacagaagagaataacaaaaaaaagaccaggaggaaaaaattatacttaatagtggtatcattgcttcctcgattcacttctagcaataaaatattcaatatctcactggtgattgtcaaaggtagttggacaactcttgccccacttgtaattgactaataccattgtgatagatgtatcttattatttactagctctatttcagccatgtttccttaactgaaaaacacattcaccacaaagatgaattatcccaatgtggcataaattttttctgaggggaaccaaaaaagcccctacacatttatgtataaagcacatagattagatatatagagagtagataaacagatatagagtgtagtgtgatatttaaatttcatgagggaagggttgactaggataacaacgcttgaaaattctcttggaaggtgataatgaaaaaaaattgattgagaactgccactctagacttagtaatcttaaggttatttatgattctttctatgattatgggcttttatgtcttaaatgttatttttttatatcattaaagacactgaggcaaagagaatcttttgagatgaacaatgcaacatcatagttgtatcagcaatgttattttgagcttaaagaagggccggatataataaggtctactggggagaaattaaaggagtataggagatttcatccttttcttatgttcagacatgattataaggtagctgggatctggaactagaatcatcgtattggggtatggtgtgagggaaaaactaaagagagctggtagaatttgtggtagaattcatttgtaaacatgccaatttctgtcatcaatattcacctttaggaacacttaattttaaatgtttgtataattactcttatttgtttctttgatatattatgtaagtagtttcaaacagtgataagattttttaaaaaagaaatgacaaactggcagccattttatattgcttttgtaatttcataatacttggtgcatagaagtaaataggcattgattttcattcctgacttgtggttcaggtcattttgaaggagttaaatgaatttcaagggcatccttttggcctttctacagagatggtattcaccagtatgtctccagccttttaggcatataactatagacacacactcttatagcaacacttttataattacagatgttttaaaaaatacagcttacaatgttaatgtacttagaaaaggctagtaaaatcagagtcctgcctccataaaatacaaccttcattacctgacttggcatactgactgttttctacttttgaatacaactttgccattcaaaacacaagttatggataatttattaattcaaaattttaggaatagatgggatacaacactttctaattagtcaatttagtgagcaaaaagtgtgctaagagtgctgaaaagcgttgtttttgtttctttattttaataggaaggggagttcaattgtaaaacaaaatccatgtgatccttaagatagaaataataaaattacagagttatatatcagaatgaatattatccttttaaaattgtttttataattctcaacaaaatggtaagagaagattttgaaactagaatgccaggtgtgaattagtagacggatgcagaagaataacaatgtaggtttggcatctgggactttgctgtttagaacaatgtttcataattattataaaaaatatattcattgaagatgaaatttaataaattccatttaaatatataagacatttgatatatacatgtataatttatttcacaaatatatatagaatacctacagtgtaatataacactcataattatttttttccagagacattgagaataaactcaataaatacaaagtgttaatttcaaattttatgccctattacatctttttgtttgtgtatttatttgtctccaacttgaggatcaatatacaacttcaacaataaaattaattttaaaagagctaacttgagagtgcacacgtatacactcatccacatactacttatatatgtactgccaaatttcaattacattttacttaactactttggtgccattccaagcacataaacaatatttgtaagccgtttattttagattgatgaagtttctaattctgcacttggaggaaggtacgcctctcaagaatgagaaattaacttttctttaataatttgacctattcttgacaccactgttaacctctgagctcttaacataaaatgccatttaccaagagtaacagtatttacagaaggattagtttgctctttttatttattttcaagttatccagctagcgtgttattgccataaagccaattataaattaacccaatttaattttgtggagttgtgatttgatccagatcatttgagctagatgttttgcaatacatcttatcctttaaaaaaaagttacattagccctactgaagtccaaaaaattcaatattccattttaaatatctgaattcttttaggatcccttcaatgcgaaaatccatcattcagatggactgtataaatgaacatttagtactttgagtggcatcctacatcctgagttgaactggcttctttcagcccctattatcaatggggagaacactgcccctcatgtgttagctctgtctgtaggcattcatcatgagcagagggtgatggtgatgggtggtttgaagccaagcaatcaaaggaagaagatgacatatacataaagacacttaggctaaatgtgtgaattctgtcctctgattaagtttttcaatcatatgtcaaatactgaccctttaattcccatgtttatgtgctatttttatggtcatcatttcttctctgtaacattgggcagacccagagaacttcctggattgttgcaaatagaccctgcagagtggtaatattgtttagagaaagcagaaaaagactgaggaggaagagttggaaagaaaaatttacccatgagtaagacatgttatttttaatctttgaagtctgttttaaaataaaagatagttaagactgtgcaaccatgacttgccatattattttatatctgattctactttaggctaaatctgtaatggaccacctgggctagaaaatgagaggccttggttgttaacgtgtgtttgacagcttaatctctttgaaaaatttcaaacagaaaggcttaggcttcctcaagggataaaaaatagtgcttaggcctgccaggacaagaagctcttatcttagttttgcatctgacttgtttcatccaccttccttctttgtgctcatttgtaaaatgtaaattgaagaattaatttacctctcaagtaatattgatggaatcaagaaaaatggttgcataacattttgaaagtataaagacctagtaaatgtcaaattataatgataaactcagtagcccaattatccatgacaacacttcccctgtttgattaaccagatgaaaaaaattagacatttttcttaaacagcacccttcaaaaatgtacagcttactctagaaggcaggcttttttttttttttttaacacaattcttaatgctcactgaaattttagcggaaaaggtggcacattttgacatctcaaggatgtgcaacctatataagttgtataattaaattataaaaagccatttaatttaaattatatcacctgggtaagattttatttttattaaaggctgaagtctatagactactctgtgccatattttgcttaatttggtgcctggagtggaactcaggtcttagttaaattttaattttgttgtgttttttattaaaaatgccaaacctgattcacttttaggaatgagatttttccaataatattgttggttacttttactcattctaggcaaataagtgatttgtttcattctctttttttttgccatgacaaatttgtatttgctaaacttgtacatatttggtagatcctatgccaggtgatcgagtttataatatatcccttttattgatacataatacttatttgtggggtacatgtgatttttctcacatgcataaaatgggtaatgatcaagtcagggtatttaggttgttcgtcacttgagtatttatcatttctacgtgttgcaaccatttcaagtcctctctcctagctatttgaaatatatattactgttaactatagtcatccgactcagctatcaaacattagaaattatctttctatctatctgtgtgtttgtacccattaaccaatctgtcttcatcactgtcctcctgtagccttcccagcctttggtatacctatgattctactctctacctttatgaagtcccgtttttagctcccacatatgagtaacaacatgcaatatttgcctttctgtgcctggatatttcacttaacataatgacagtttcagtcatgctgctgctaatgacaggattttattatttttaaggtttaatagtattccattgtgtatttgtatcacattctctttattcttttgccattggtggacacttaagttgattccatatctttgcgatagtgaatagtgctatgataacatggagctgaacatacctttttgatatactgatttcttttcctttagataaatacccgtagtggaattgatggtccatatggtaattttatttttagttttttgagaaatcaccatttgttttccatagcggttgtactaatttacattcccaccaaccgtgtatttttaacacaacttcaaagataactgaacagtaaatagttaaaaaaaaacacaaaccttccaaggtcctcaatggaccaaatctatagagaaaaattggtgagtaggaattcatctagggtactgataatctctattgaaagaaataggattctagttgtttttaaagcctattaaaagaaaataacatcttaacaggacagttaacagagcatgttcactgctaaagagctatactttgcaaatcaaatctaagggccaagccatcttctaattcagatacctgtaacaatgctgtaaacagtcatgcctcgggcttcaatggccagctcacgagacaacagtttctaatgcaacctttcctggaagagagacatagagggatgctaagaatcacaattttctttctgttcctgaaaaaatgtatctatgactgcagagcctgtggccatgagagggcactgggtacttcaggtagagagtaggagagaaaagatttaatgtattacccacttcaattttttgctctgaggtcaactctggtagattgctggagccagttcaaaatgaatcaacttggtgaaagacagtggtgaaattgcaatggtggctctgtgtcattagacgtttgccaaaacctgtagaacgtacaacacaaatgtgaaatatgtaaactaatggttttggctaacaataatgtatcaatataggctcatctatgttaacacatgtactacactaatgtaaatgttaaaataggggaaagtgggatggtgggggagagaatgtaagaatatagaaatgctatattttccacttacatttctgtaatcctaaactggtctgaaaatcagtatgttaattatatttaaaattttttaaagaaattatttatactgtcatattttcccccttctgtaatatttttaaaattatttctattaatgaaaaatttggtatgtgctaacatcttattcatacttgtgccttctgtttatcccaatcaggaacatacaccccaccatgttaaaaaaattaataaattaacatttttatgaagaatatacttagtggagatctgataaaaatagtagtcaatgacctattaggtcagagttctgacaactcttcagccttaattttgagtcatgatgtaattcctgcatagcaaatagaatccgatcacataattaccaaaaacaaacaaacaaacaaaaaccgtcatttttatatgctttagatgggacaaactaaaattattttaagaaatagtgttatgaaacacaattaagatgaactgaattcagctaaatgggagacttgacaacatgttctattagtctgctctcatgctgctaacaaagacatccagagactgcgtaatttataaaggaaagaggtttaattgactcacagttcagcaggacagggaggcctcaggaaacttaccattatggcagaaggggaagcaaggctgtcctttttctatggtggcagaaaggagaagaatgagagcccagctaagggggaagacccttataaagcatcaaatctcgtgaaaactaacttactatcaccagaacacgatggggaaaccaccctcagattcagctatctcccccgatcctggccataacacatggggattatgggaactacaattataataagatttgggtggggacacagccaaaccatatcacgtatattctctcactcctcttaaatcattggaaatataggtacaaaattatttataaaagcaactcataacccaaaataatggaatcttttaacagatgaaacatttaggaaatattagtaagtttatcctacacacatattgtatatcttattttttaaacatttaacatatctggatgatcttgccatattagtcagaaagatctaaatcatttgtagcatttctagtaaatttactaatttcctattgatggaacttattcttaggttttttttttgctaataaaaatgtttcagttagcttgaacatatcgtgtataactgaaaaaacatttataagatgaattattaaaagtgaattttgggatcaaagttgtgtgtattttaaattttgacagataataccaatttaataatgtcatatgtttaaaatctaatgaagtattctatagatttagttgacagaattatctgatcagtgaatccaaataaatagtgaaaccaatattgaaacttaaaactgtacaatgctggaacacatagagagtctaatgcaaagttaagtatataaacaattatagtaaaacactacagcataataacagcctctccacaattttcagcaagctgaaatcattttgcctttgtgattacactgaggaaaatttgcttaaattatgaaaatccttttttagattcacaggcagtatttctagtttacctataacctaaagataaccagagtttgaccctcagttggtttgatttatcttattcttatcctactgagtatttgtttattataataagaccttattagaaatcatttttataaaaaaatcaatgatatattcattttctcccctctccatttctgttgaaatgatgaatttgaaagaaaaaatgtaattttaaaaacagttggccttgttctgagaaattcctctatgtaccagtttttgcctttggccacatctttgctgttgtggatcaggggcattgtattgcatataagttctgtgagcgtaatggctagtgcagttacagcccaccaataacagcaggaagccccttcgtctgtggctctgcttacagaactttgaagtaaggagactgtgattgtaacacatacttcctaggtacaccatggagataaagttgaaaaccaccatctggattctttaagagttatgctgagcatgcctaatgatggtagctccagtaatataccccatactgtctggcaacagcatcatattgttttaaatgcacggtatgtaggtcatacagctttattcaagtgaactgtaaaggttgcattctctcactttattaaaaaaaacattgaaattgcctacattttgctggaatagtgccctgaaagcacacaaagccaaatagttaaactaaaaaacatgcttgttttatatattatgcactctcctctacaaagaaccaacccttataaagttttaagtgaactgtgaaaagttatgccattattatccaaatgctgtttaacccaaggttaaccatagtaatgtgagaacagcgccactgagccctaatgggaaacagtaaggttttgtctgcacagacgggtgttctcctgcattttcctaatgtgacagtgtgaactcacacagctcagagccctgatgtggaatcaacctcaaaggtctccgacgtaaaaagctgaaaacattctggagatgcttggagctctgcaaacctttcactacttgacttactccataatgtttaatgggccaagttctcaccttgtccttcaggctgaaggccaaatctgagagtgaggtttgaattcagtttgatctataatcccaatgagctttgtaaagcagtagagcaagagagaaatttgtttcactgtgtgcacagacacaacatttaatttcatgtttttaaacctacttcttttgggatagaatttaagctatggcagtgctgaatgctgagtagagtgcagaaacttttatcccagagatgggcggctaaagggtatctagaaaagctcataattcattgagtacaactctgttcacttattacagtgttctgttcttggggagttcataagcaaaaaactactagcaatgggcttcccatttgtactgagaattgagccatgcttcctcctcatatctattccatctgttcctagcctctccaagagaggcctttgatccgaaaatctttgagatggaagagtctttgcttaatgctgaatcactatctatcttcatattgtcttattctagaaaggagagaaggagttaaggtaaactgagtcctgggtttcaacacttactgtgtgtggcatggtttgtagtgtttttacctacactatctcatttatcctcatagctattttataagatagcattatcatctttgttttaaagatgaggacagtagttttattaatgtatttagagcacactagtaagtgggatatctagaatgtgagcccagctgtgtgacaccaaagcttgtgctttgctttatccattcagctgtactacgtcccaatttctacctgccttgaatcagtgtggaagactgagtgatggggaaaaaagccgaaggtattttttccactaataagaatatgctaaatgtacacataatataattgtagaatgaaaacctaaattacacattaaactgataagtcataatttatctctaatggtgaaattgctaagggtttctttcctttatagttttctgtacatttctgttgagtgctttgaggttatattttttagtttaaaaaatacacaacaaatgatatattaaaaatataagccatagttaatacattcaaacattccaccattcctgtgaacaacagcacaaaagtcacgtttgtagctactctaatatgtttaagaaaaattttctattatataatgttgatagctagaattaaatgataaactttcttcatgagaataatattttaatatttagatgcagcaacgttatacatacttaaaactttaaaaaatattttctggcatataaatagagggaattattttaataataataccatgtcatcattccaccgtttctgtgttgcagttactgaactaaatgctacaggtacagagaggggttcttgcagtgaattaacttttatttttccaattagcttattatagccctcaaagcatatttccaatattatctagaagagaaaatatcccaagtgtacccctagtaaataggaagtatttcccaaacttgtgcaattgcaaggaagatttccttagtagatagagattcagaatagtttcatagaaaataaattgtttgtgatttgtggatgaaaaatactgaggctcagatgtctttattgggcataaaaatgctctaattattaaaaatcatgaaataaagttatctgagtcgagcttagaaaattgctttggcttgataatgggtgaagattttagaggtactttcaagagtaatagatttgaaacgttgggcattttgagatagctaatagaaagactgaattaagaacccatccaaatgagattttcacaaacgaaatactctaccctgcaattaccatgtttcttgcatcttcagatatatgtctgggttctcagctgcactgcagctcagcttcccattgcttaatttattagaactcaatccttgggaggttaagttgatcccttgaggatgtcagtgcctctcacagttgagaagctcaagtttgtcctgcattacacagtggtgtgatgactccagacagtactgaagttaagtttaagcttacttagaaagtgaggaatgtaggactgctcatgaatgttgttgtcatgtaaaagaaaagctattcataaaaaagatctatattccactaaatgtaaatctgactggggaagcaggctggctgaattagtggttgttaaaatgatcactgatggtaactagctacaaggagtggtgtgcagacttcaaggagattaaaatagccaggcacctgttctgggctggttacctattcaccattgtgatgttggaatcattcccctgtatcttagcttttattctttctctcgtttatcttttaaacctaatctcactattttgttggtttatcttggactgtgttgctctctcattggtttgtctgctgtgtgccctagaccctggattaaataccaccctattcacttacccagagctatatagaaggaaaatccaaagtcaccaccagaacaattctttgccagggagatgagtccccgatatttttttttattaaaatactgaattcatagccccatgaaaataaaactgaaaatatacaaggttaaaaagagatttataaaatttttgtgatttggacatttttattcttatatgaattctgattaacattgattgtcctgtttttgctcactttactgttgcttctttgtttacaatgtgaataatctctaatttaatgtcttggcttatctaatattttgctgaagagttttgtgacattcgagtctggaaaagaactaagagtgttcattaatttatataaggaaaatatatttttacaattggactaaatatttgatgttaactagaaaataagttatattttctatatttgtattgagttaaatggctatttgacaccactgtttgaagtgtggcttagagtacaaatagttttgaactcttccatttatactgtcagtgtgtaatttcaccaaataatttcatgtactttattataaattttatttagttatatttagccttttttcaaatatatcttctatggggaaa

SEQ ID NO: 5099 - DNA, 18415 bp, Homo sapiens
ctcaatccatttcattccacaaagcatcaattcccattcagttaatcacataagaaatctctgcattaaaaagaaatttcatgaatctggaactgtttcaaagtacagcgttcaagctcaaatccctcattcattcactccctcattcactcaccggcaaatatttctgaagctcatctatatgccaggtactgttctaagtgctgaagacatgagtggacaggacagatgaggtcctgctctctggcagctaatagttcatgggaaggcaatactaataaattagcaatgaatgatgaatagacggatggatagacagaaaatatcagatagtgataagtgctagacagagaataaaatagagttatgggatagagaaattgtgagtagtgactttggacaggatagccaggaagactcctgtgaggtgatatcctccctacatcagaatgatactgtcatactccatttcaaatgcagttgtcaaatctcattttcatctctgatgatcctcagatggaccaataatatagtgaatttcctggtacaatttcttgtctggaatagcagtatgggccacgtgcagtggacatgtctataatccaagcactttgggaggccaaggcaggaggatcacttgaggccaggatttgagaccagcctggacaacatagcaagaccccgtatctacaaaaaatacaaaagttactgggcattgtggtgcacactttagtcccagctattcaggaggctacggtgggaggatgcttcagcctaggagttggaggctgcagtgagctatgatggcaccattgcacccaagtctggcaacatagcaagacccagtcactaaaaagaaaaaaaaaaaactgtagcagtatgagccaggtattggttggggtaatgcttgctactatgatacagtaaaagatttctcacatcaatccaaaactagttctgtatttctgatcgacaagtgactttgctctgggtggtgaactcaggaccctggctctatccagcttgcgtatggcttccaacatcatcatgcttgttcacatcagactgcaggggaaagagccgtgagggttttgcaagacaggtttttacaggtcaggttggaaggggccaacgtctcgtcttccaacagtccattggccaagactcaggcacatggctgacctaacaggcagaggctcaaaaatgcagtctaaccatgaaccaggaagaggcaaaaaagggcttgctgatgtcttggggcctctgcttatgtgaagcactaggcaaacttgtaacgaaattatctcaagcccactccctgcaaggatgaggtctcggatctcctcatattacctcacgacagcaactgccatgatcgaaatcaaaatcttttctggcaggaggtagggcaggatgcagatgtgggaagcaaaagctagggctgaaatccaaagggttaattcattaaagaaaaaacactcagacctgttgtgctctgagacaactcgagagatggaaggctaatcatccttctggatgccgagttctttgtggagccctcagaatggaccgttcgacccttcgaggtttctctgctctgatctcttgctaatggatagtgttttccaagctgatggtgttttaaagatacgcatctaaccaatgataatacgtctgacctcttgagggagaaccttgtatatcttcctcttcagcctcccttattggctaattacataacttgactagaagttggttttagagaatcaatttaccattgcctaatcacaagtaaagaccataaagttttatgagagctgaagggactgcttttacagaggggaacttaaatgagaattaaaggggacattaaatgataagaaatgaattctacaaggtgttttcccctgactgccacactaaattacagtgctggggatataatccgctggttttgtctccaacaaggcactcagggaagagcggaggagctggcatttcttgataccagcaatgcaattgacagatcccgtgttagtggctttgggtgaagacgcaggcaaaaccccttgagctgccatctactaattgtgtgaccctgggcaagttctctgaccctcagattgtcatgtgcaaaatgcagatgacagtcatcacctcccagagctggaaggatgaaataaataacacacgtaaggtgcatagcatagtgcctggcacacagtgagacttcaatgaatattcctgattacctgtgttaatgataggacatgcttcaaaacaactggggctttgttcagtcctataaataagagctagtattaattatgtgccataaagcagcaacctgtaatggcatctctccactttatacatgaggaagttgaggctcagagacactggaaaacctgtccaaagaacaagactcatgaaggccataattggactcagaacctaggtagctttgccctggaggccatatactggactactgtgtatttttctgggtaaggttcacagaccagtctgcctgttcaaatttatcttcctttataacaagcagcatccatgagtcttgcacacactaagcttgagatgatagaagctggggtgtttcgttgagtttttctttttgagatggagtcctgctctgtccccaggctggaatgcatcagcgtgatctcagctccctgcaacctccgcttcccgggttcagtgattctcctgcctcagcctcctgagtagctgagattacaggtacgcaccatcacgttggctaatttttgtacttttagtagagatggggtttaaccatgttggccaggctggtctaaactcctgacttcaagtgatctgcctgtctcagcttcccaaagtgttgggattacagggtgagccactgtgcccggcctggtgtttcttacaacattgccactggggagaattttccaagagtcttatttcattcaattaccaaaagaattgtccatttctctccttatatctcctcaacttctgaatctttcaccattatcatttctagcactttaatgtctccacaaaagtcagatctggtcaacccaggccatcaagaaaaagaaaagactgcttctccatgcccaataaacagcaggagggtacagtttacaaatatgtgatttatggtaaaggtcaagtatgcactgaatgggaacatgtcccataggcaagcaaggtagttatgacaaaaaacagatttgaatggaatcaccaaaattgctctggaaatattaaatcaaagatcctttttgataactggaaagtggctggtgtggtggagggccaccttccactctgacaagggcctaggaagacaagcagactctgtctgaggtctgcaactggggagaacaagaagggaggccctggggagagccacacatgggatggaagtcgacaggctgtgggaaagccattttttaatttttttaatttatttttattgacaaaaattgcacatatatattgtgcacaacacattattttgaaatatgtaaacatatggaaaggctaaattgagctgatcaacatatgcataactttgcatctgatatggtttgctgtgtccccacccaaatctcatcttgaattatagctcccataattcccacgtcatggggggacccggtgagaggtaactgaatcatggggatgggtctttgccatgttgtttctgtgtagtgagtaagtcccacgagatctgatggttttataaaggggagttcccctgcacaagtctcttgcctgccaccatgtaagatgtgactttgctccttgtttgccttctgccataatgtgacacctccaccgccatgtggaattgtgagtccattaaacctctttcctttataaattctcagtcttgggtatgtctttctcagtagtatgagaaaagactcatacagcatccttaattaaaaaaaaaaaacaaaagatcctgatacactctgctaacatgaaacaccacactgtttaatacggatgaacaaggttctgctgcagtgaggaacaacccccataacacggtgacttatacagaaaaagcttaattcttgcacatactacaagtccagaaaaggctgtcagggccctgttagtctcaatcagagatgctggaagatggaggatccattttgtcatgtgagtccatatcatgatgtcaggagaaagcagggaatccacctgcactggcttgtaaatctcccccttaagtgacagttcatgcttctttggctaaagcaagtcacctatctatgcctgaccaaaaaggagaaaaagcatcatccccagaaggacagacgaggaatatttaacaaagcacaaacgacaccacatctacacatgaaaaatgataataataacataaatatatgacatctgggttgctgggcaattacatcaaatgtaattatactttgcaaaaatttgatcttaaatcaaaatatggtggaattgcattcttttatgtaccagggagagaagatgaaaccccagaaatatcattcaattagcttgacatcttattttgctaaacggatgcctaaggaataagcatgcaatgtgcatttgccaagcagtatttatggattcccagacagtaaccggcccttttctcatatcatgttttcctgaccctctacatttggactaagttgacgcatggaacaacctccctgttccattaaaatacgatgcatatggttttgcttaaagaacaaactatgtactcctggtaagaaaatattagtgggatggacacagaggtcagggaatgaaagatttctgaaagggaactttcactaagaggagcatcatttccagaaagcctctgtgtcaaatgatgggtttcactcacaggcaaagagaggctgagggttaaaaccatccagaaggcacgtgggacctagaggaggccaacgtgcacacttttcaggacatgaaatacagctcctgttttgacacttgtgtaatagcatgttgttcaacctccttgtttctgtggggtttatggtccataaagtttaataacaatcttacagctgaacagagaatacatgaggctcgaaggccactcttaccaaagcggatctggatctaaaattctttcccccttggcatctcaacatttacaagtgcctgtctcttaatgttgatgtacaaaataatcacgtggcacaaggaaacatgaacgactggctgttattaaaacagctttgcaaaaattataacggagaaaattatgaaggtgatggagatctgatgtaactgacttatcttgcttctaacctccaggctgtcttgttcaaagttgatttggttgtaggactaacaactttgagaggaacttagtttacggtttaactttgaaacaaaagatgataacagcccttcccaaaataaacaaccttcctgcctggggactagactgcctttgcaggactaacaaatagccacaagattagaaattagggtttaggagtcatgctgccggaggctgcaagattctgacctccccaaattgctccaggggataatgtcactatggtaaaaccgaacatcagtacttagatactttgcagaccctgcaattgatggatcagctggcaccacccaggtcaataaattactcatatggtcttgtggctcccacccaggaactgactcagtgcaagaggccagcttcactccctgattccatcttaaacctgaccaatcaatactccccattccctgacccccttctactaaattctccttaaaaatctctatccctgagttttgggggagacttatttgagtaatataaaactctggtctcccacacagccagctctgcatgaattaaactctttttttttttttccgagacagagtttcactctgtcgcccaggctggagtgcagtggtgtgatctcgactcctgcagcctctgcctcccaggttcaagcagttctcctgcctctgcctcccgactagctagattacaggcgcctaccactacgcctggctaatattagtatctttagtagggatggggttcaccaccttggccaggatggtctcaaactcctgacctcagttgaaccaccctccttggctcccaaaatgctgggattacaggcatgagccaccgtgcctggacctaaactctttcttatggcaatccccctgtcttgataaatcggctttgcttaggcagcgggcaaggagaacccttgggcaattacactggctcttaagttgtgacactgccacacacttggccatagaatccggtgtaaaactttgaggaaatgaagattacagagccttgttatcctgcaatttgggaacataaactttcatagggttagtatgccagggcttcatccaaatacctggacaaatgagataactcgaaattccttcccaaagcctgcaaagctgtgcactgatcccagcctcctccccttctcatctgttcactggggtcaccaaagccccttgcagttggtgaattcatcgacccttacatgccacgggctttggaacttgctgctccctcgtctttgcggggctggtgaggattctggtagtcctgtttccctaggactggctccattacatttctagatctgttgaaatgggactcctcagagaaaccctcctggccccatctaaggtaatactccctctagtaacttacccactgtctttgctaaatagcagttattaaaactgcctttgcaaaaattgtaagagtaagaaattatgaccgtgaaagagatctgatctaacctagccccatcttgcctttaaccttcagccgcccttagtcattcctgggcttgggccaagctaactttggggggatatttagtacttatttaaatgataatggccctacccccaaactaaactgcctttgtaaagctagcaaaagacaccaagttaggaggaggacaggagcctgaattctgctaaagagtggacataaacgattgcagccattattccagaggttacaagatttgcaatttccccaattattcctgcagataaatcactttgtagaacctaaggttggccttctgaaatgtcttttccggcttttgcattttgaggactggtagccccatccccattcaactggtcctgtgccctgccccccacccagaagggattcagggcacaagggttttacacacccctatgattgcatccacagcccatcagcagacccattctcttgtccacaaaactatccttaaaaaaaccccagtctctgaattttcaggaagctgatttgagtaacaataaagctccagtctcccgtttagctggctctaccaacattaactctttccctattgcaattcccctgtctagataaatcggctttatctgggcatcaggagaatgaacccattgggcggttacgttatcaccacctgccaatagcttatttgcgtaatatttccgtgtttattcacagacacacacacacaacaatgagagcaccatggagttaggagcttgacatattattcctaacttcacctactgctggtttagagcaaatgaataaaacacgtgggtgataaagggtcagaagaccttgtcacatgatcaaaaacaatttcaagttaaagaactttcagagcttaaactgggcacatccatagagctgacaggataaggtccttcccacccacaacaaaatgcaaactttcatccaacagtaacctttatcatcactgaagctgactgcatggttttgctctcctgacttctccaggttctccctcttcccctgaaagatgtatattatgcagttctctttggaagccgtggactaccctgcaatcgtggcctgattttgcacagccaagtgaagagatggggacaaagacagaaaactccctgctgatgacagggctcctgggagagaattttagcttgggggagggttggggagggaaagtaggaaggagaggaaatccttacaggctatatttgcatatcaaagagcacttccagccgggctttctttgcccagtaacaagtcatcttattcaaggccaagaggctttcctctcaagctgccttgggctatgcctcctattcttccttgtggagacaaaacagcatggctatctcaaggcccagggagataactcacccaccagtggctctctgctgccccagatgtccctagatggctgaggtttcgctgaggatttgggtttacagacttccatggcattcccctcagactcctcagtttactcaaggtccctaccaagaagacaaaatactgtagcctatgttattcattcattcattcattcatgcgtcatgcattcatcccaaaaatacttatcaaaatattactaagtggcaagcatgcagctacttccccttttagctcttgggtcctttaattaatcaacataggtgggaaggagccaaggatggtgggtgctccgacactaatgactttgggccacgttttgagggggtggaaacgtgtttgagcaactagcatttgaaatccagattcccccttagctcatggttctaagaagttggttttaactacattgtataaataggatactattctgctcacatttgatcggctcatatcataaagggagttcatggtccatccttttattaatggaaggattctggctgggccaggtggctcagcatctaatcccagcactttggaaggggccacagctggagattcacgtgcatctcggagttgagtccggcctggtcaatatggtgagaccccatttctacaaaaaataaaaaattaacaggtgtggtggaacatgcctatggtctccactacacaggaggctgaggtgggaggattattgcacccaggaggttgagtctgcagtaagccatgattgggccacttgcactccagcctgctgacagagtgaaagcctgtccaaaaaaataaataaataagaattcttccaagcgtcctcaacagtcacttgatttacatttctttctttaaagcagaatttttcttagatttgcttatattggaagtaaatatgtgtgggctcaatatacaactgaaattagcacgcaattttctctccgcctcctcctcttcctcctcctctcctgagattggccatcaacctcatgctcaggcagcagcttggtgtccaggggtataacccctcatagagggtcagttccaaatcagagtcttgaaggcctcattatgcagtatgttttaagtgaccccaagaatacaagtctcagagaccacatttctagctgaaagcatgaagtggaaggaatgaaaatatattttctgtagttatataacactataggatgaggtactctattgggaggtaggacaaggatgggaagacaatttgaaaaccaacaggggcaccaacagggaaaaggaatgtaataccaataaaagaaaggtgtggtgcttctttaaaaggagaaaaaatggttattttctttcctgcacttaattaagaaatatcagtaacatagaactaagcgttgataaaaagaaggtgcaaaggcccgagaattttagaagtactaagtgtgacagatcatagatagggtgaccagatatcttgacatacgcctattgcccagcataattacctgctccccatcctctctcaaaaaggtgccagtgtggatgataaatatgtggtcactgtaatcatagcaccaacacctgggaggcaggctgacctggggaaggggggtttacatttccagtgaccatgccccacccagaaaagacatttatggccaggccggtgctcatgcctgtaatcccagcactttgggaggctggggcaggcagatcacaaggtcaaggaagaagaccatcctggccaacatgctgaaaccccatctctactaaaaatacaaaaattgctgggcgcagtggtgtgctcctcttgtcccagctactcaggacgctgaggcaggagaatgcttgaacccgggaggcagaggttgcagtgagccgagatcatgccagtgcactccagctggcgacagagtgagactccgactaaaaaaaaaaaaaaaaaaaaaaaaggcatttataaatcatctaagtgatgacatcacaagcacctgtaattgctaacttctgctttaaagaaaactctaacagttggactttacatctgttgctagtttaataactgcaaaagctctgcagtttcttcagaaaggtggaccctgatcccttttgtacgtggtgttccctaatttcagacacgtaataacagggtaaaggtgttgatgatatatgattatagcttatagggctgcagccattactacacacaaggaatctccattcattcgctgtgtggctggcccggagaaaatgacttaccactctgtaccttcagacccacctctgtaaaggaggaataacaacagtcccctgccacgagttctgagaactaaatagaatgttcctttatgaattatgttataaatggactggacttcagcatgattgagctagaaaggaacccacgggtgacttttctgagctcctgtactatgataatggatggcagcttgaagaagacacgtgcctagagcgaagtgtccaggtgcttctcaagtgaggctggggaatagaatctgcaggcagggaatctaaagccatttcactctgactcttagaaccaaactgaaaggaaacccttaactttccacgcctaagtaacaaaaggaggagggctactcttttgcaaccccttaccttttctgcagggcagatgggaaattgaaagtactctgagtggttttgctttttgcaaccaatcagacgtttgcataggagtgtaactttgtacttcacttcagcctctgatgggttgctgcccacaaccaatcatactgactggaggcggatcttcgtttgcataaaagagcaactctgtaatttcactttagcctctgattggttgcttccaaaaccaatcagatgtttgcataggagtgtgatatttgtaacttcacttcagcctctattggttgctttctgcaaccaataagactgattgcaggccaccacttcatttataagggtgtaccccaagtggccaatgggaaacctctagggagtatttagactccagaagattctcatccagggcccctgagtggctgcttgggccgttcccactctatggagtgtagttttgcttcaataaacctcagcttttgttgcttcattcttctcttgctttgtttgtgcattttgtcaactatttcttcaaaatgccaagaacccggacaccctccgctggtaacaaaaggactcaccaggaatgtggatcctcgactcagccgcgactcccttgcagctttacaagacactaggggaagtgtcctgtccttgctgtcttttcccttgtattttagatgggaagctaaaactggggggggcaaaaaccaggcccactaaggctaagcctgaggacagggcagaggaaagcacacagatttactttcattcttagaagacagtggatggaaaagtggatttccaccaacaaaaacctggcctttttccctgagcaggaaatactgagctgctgtggtcttgccctccctgcaagccggcctaatggtttagccatggtaaaagcgttgcagccaaagagagcagaagagaaactgggaagctggtgtcagattttctactcgggcatatctttggcctaggcccccgcagagtcacgggggaaggcctggaaagccgcagtctaacaagatgcctgacattgtgaaatgcttaaccctagcctttcatccacctcttagccttgcctctcccgcccgccccgcgtggcctgctggatacaagagaaaaagtcaccgtccccttgtccttgaggtaattaatcagcgggactctttaccctgggaataatatgcctcagaacacttttcattcctgtaatatcaatttgctgcagagatgcagttctgaaaaagatacaaaggcatttggtggggtttggtggcaagtaaccaggctaagttgttgacactacagcacacaggatggtttcagacaccaccggatagctgcaggctgcccgattctccagaagaaaaatgtttcccttgcttcctgcagaggtgatgtagatgctgtctgccagctctgaaatctgcaccatttccttctccaagacgattttccagctctcaactcccgccaacccagtaatttgtgttggtcactatttcatccccttctccatttcctaaggcaaatctgccacttagaaatacacacataatggagtgggaatgggatgatcagcccaacagtgaggtgcggagggacgcccctcacttgatgtacactcagattttaggagaggcccgtgtgaattcacgtcatccctcctctatcctgggcagcgacagacttgattgtacaccagtgtttagaacactgactacctcgctaggcgcagtggctcacgcctgaatcccagcactttgggagaccatggcaggtggatcgcttaagcacaggagttcaagacagcctgggcaacatgaaaaaaccgtgttactacaaaaaaatacaaaaactaacccagcgggtggcccatgcctgtggtcctagttactcaggaggctgaggtgggaggatgacttgagctgggaagcacaggctgcagtgaaccaagatcctaccaatgtactcgagcctgggcaacgagggagatcctgtctcacaggaagaaaaagagaacactgactaccagctacttatgaaagaaggagcaaaacagaaaatgaaacagaagtggttgtggggagagggaaaagaacaggaaaaaagagaaagaattaaagccaaaattccatccgaaatatttccgtgaaaatattcttaatgtgttggatattctaaagctttcatgacatagtcttattttcacaaacacatacttgtgatcttttgtcctcccacaaacctttggatgattgccagactattgctttcaaagttatgtcttcattcctttatctccttcagcacctattctcatggataggaaggaacccgactctgcattttgccctatgaaaatggactctgaatcccagcttgaaggagaaaggtaatactgggagaaccggaacttctagatgtgtgcaaactctgatacaagggttgggtctgaaagagagcagtggtccattctgtagaacatgttcttggaaacttcaaaatatgaacgctctggaaactgtggtacccttctagagagattaattagtgctcttcttgggaatagaacataaagagaatatgggatgaatctgtattgtagccatctcccacaatatcaactatcttttcttttttttttttttcaaaaaaaggctctgattaaaagtacaattttatttaatatcctcaaataaaaaagagaggttattacgttagcatgaccactatgaatattcttgaaagtggactagtagaattgttttttatgattccattgattcaaaatgaaaagtggcatttgccaacatatgatctgatgagtaatagatttacaaagcaaccaaagaggaaagacaggctggaagaaaatctatctgattatgactttgtggtttgtgtactggttacaaataacctgaaggcacgaaatatccaaattggaacctctgcttagaaaattcttatgtgaatagggacctctggggtttcttgaaagttgtgaggcaggatcttcactgtttcatgaatcactttcctaacaaaagtctcatttttaaggaaaaataaaaaacaaattatttgggtgcccagcaaattacagcacagtttttaataatatgagcgtgcatacttgagtgacagttcatttgggcttaaggatagatttcaacatgttcagtgtatggagaaaccaggctggaaactttccccttcagtgctgagctgacacaaaacaggaggagaaaagactttaatctcgtcataaacaaatgtacagtctgcatgaaggtttacaccctactctggcaaaatgatgaacggtttgttactgactcttcatttaaaaaaacagtaataaagaaataaaatagagaaggagcagcaacgctctctgaggaaaaaaaaaaaaaaaaaaaaaagtcaggagggcttgtatattgcacatctccgtttggtagcccaaggagggaatataagcttaaagtcctgaatttaacaaacctaattatcaagcttaattagtaccaagggtacagcttcatggaacacctgcagacttaatttatgtcctacagagaggaacaagtgttaatgggctgtatttatgttaatacctgaaccttaggagccgtggaacaaaacagaccacgcgctagttttccaagctacaacacaaatataaaagatttcgtcttaatgctgctttgcacacaattcttcagggatcacagagatctacttaaactttaaaactaaaaagtggaatatgaagaagtagagccgttctgggtatctgtaaaagtcttaaagatcaactcaccaactagtcatcatatcttttatttaaaattgacaatggcggatgtgccaatgttcccgttgttcaggatgagtgtttctcaggacgctgaaatataaacccacttttccacagatgctgtaatattaaaataataactaacatttatggagaactcactgtgttcagtcattgtattaagctcttcgtacacattttccagttacagataaaggaaagtgactacggggtaaataaacaggccaggtttctaggaagttcaaagatttggagttaggtttcggaacaaatccttttaaccaatgagctaaactccctctaatatgcagatagtaagaatagaaaaatataaaacatatatatatgaacacatttataaaagaactctcagcaaactagaataaattcaaactccttaatctaatgaagtataggtacagaaaacatacaactaggatccatataatagagaagtcctgaataaagcaatgatgtctgtctcaaaacctctgttcaacctgtcctacaggctatagccagtgcattaaaacaagaaaaagaaacaaaagccataaaattggagaagaagtaaaactatattcagagatgtagagaattctacagaatctatttaacaaaaggaaaaggtgaataaataaattttaagatcacaggatatgagagcagtttgctagatcaactgtatttctatatattagaaacaaacagttggaaaaaagaaattttataatgcatttacaatagcataaaaaaatcaaatgtgtaagagttaatttaacaaaaaagtataagcctccacattcaaaatcatcaaatatcactgaaatgtttataaataaagaagccttaaaaaatggagagatgcatgctcatggatggtaacgctcaacactttcaggattttgatcctctcaaattgatcaacagattcaataccaaagcaaataaactcccagcaaggctttttaaagaaatggagaagctgatcaggaaatatatatgtaaaaggaaagtatctaaactaacccaacaatcttgaaataaagaacaaagtttgaatccttattattacctagcttccaggcaacgagcagtaagtataagaaaaaaaattagatcaatggagtacaacagtctagaaatacaccacacatatatagtcaactgatttttgacaaagatgccaaggaaattgaatagcgcgagattagtctttgaacaaatagtgctagaacaattggagagtcttatggagagaaaaataacctctaccattacctcacaccatatacaaaaattaatttgagatggaacatagatctgatgtaaagattgaagttatggagtgtctagaagaaaacataggaaaatatttttgtgactggtgattggtaaaggttcttagaacaagaaagcactaaacaaatgaaaaagataaattgacactatcagtatttataacttctgcttttcaaaagataccattaaggaataaatagaaagacaaaggagaaaattcacagtacatatgaaaaaaaaagaatgtatccaaaatatattagaattcctataattcaatattaaaaagactatctaatttttagaaaatggccaatactaaacaagcagttcacagaaagaaaatatatgaacggccaatgagttcataaaaagaggattagtcactaggaaaatgcaaaataaaactagcaagagatagcgtttctcacccacaaaaggctataattaaaaagactgaaattacaaagtgctgatgaggatgtgaagcaacataactcttacacacttctagcgaggggttaaaatgatacaattactttagacaactgtttgcagcattcttacaagttaaacactaagagtcaataatttcacacctaggtatttatcaaaatacataaaaacataagggcataaaaacatgtatacaggatttatgaatattcgtggtgctttattcataatagccaacaaatataaacaacccaatgctcatcaacaggtgcacagtaagcgaattgtggtgtattttcaccacaggatactatccagcattgaaaaagagaaccctaatacacccatcaacatggatgaatcacaaaaacattatgtgaatcattaagcagaaacgacacatacaaagcagtaggtatgatttctattaaatgaagttctagaacaggtaaacaaagttacaatgattgaaacaagaatgcttgtttctgggaataaaaggatttattggaaggagaatgagatacttaccgacgtgatgggaatgttcttgtttttgtttttttggttttttttttttttttttttttttttttaaagacagtctcactgtcacccaggctagagtgcgcagtgccatcttggctcactgcaacctctgcctcccaggcgatactcaagcctcagccccagagtagctacggttacaggcatatgtcacaatggccagctatttttttcttttttttttcttttttttgtatttttagtggaggcggggtttcaccctgttgcccagactgatctaaactcctggcctcaagtggtccaccctcctcagcctcccaacatgctgcgattacaagatgatccactgaacctggccctggaatgttctatatcttaactggggtggtggatccatattatgtacacgtatacatttttcaaaatccagagaactgtatatttaaaatatgctaatttatagaacataaattatgtaaattatgtctcaataatatatgtatatgtatgcatatcattttctctctctctcacacacacacacacttctgtgaagagaattattccacaggccaattttatattagtaaaacagaccttacttttgagtgctacaatccaatcgacaaaaatcttgaaaaggttaagattatttatgaaaatgtttactaattactatctgagtacatcaactttgtggaaagagagtaggcttcagtgtcatatgtcccaggtcattatgatgcgtttgttctcattagctatgtgaccttatgcaagttaatgatcagcctcagacggtttttgacgaaggggtaggggaagcaacgctggcctcacaagtttgcggtgtggcttcagtgtgctaaggatgtagaatacacgattcagggccccaggttttgttattaccatcagtggtcccagccgtttttgataactttgtaaacaccaagtggttttgggaagccagtcattctacaatcctttcccaaatttttgtctctgaaaatgactaagcaaatttacaaaaacaattggaaacacttggtgactttttttttttttcaaatgggtaagtgcattccggatataattatgtttaaacatgattcagcacactttatttcttctgaagtatttctatttccttcttttataaaactactatttctatcttatttttaaagatcaattgcctgcatgttttcagagccctttcaaaatatctttggttattactcatctgtgaaaaggaaatttaaacaaagtttgagaactgtcatttctcaaaaaagacagtggaattgagtatctgtttcctgggatgttaagtcagcgcaagaccaaattcatgagattgttttccaaagagaagacaggagtaatacgaaagaatgctgaggtttcatgaactgtatcagcttcctggcatgagagcactcgactttatatagtcgatactg

SEQ ID NO: 5100 - DNA, 14082 bp, Homo sapiens
agatttacaatgggaccacaggtaagggggtacatttcctcccagcccacttcaaaatgaagttgcaaagagtgcagctgatcactttcattcaccttttgagtaacagttggggctgggctagggacgtgtgcagtgatgaggcatcatatcatccaaactgacagaatactgtcaggatgctataaagagggcaagaaatcactttgctttgcaagccataattaaaaataatagctgctgttcagagggagacatggtcggcacgtctctaatttaaaaccaatacagtttactggcatcttatgattatttatgtgtttcagagccctagctgcatccactaattttcagtgatgagagggagaggggttgcaagagaggaccggaaaaggtaactgaagataagctcgccccacaaggaaaacactaaggaactttgattgtgggggaaatggctttccgacccgaccaaagcttatcatttttctgcccctgcagggtttacattgtgaccatgcagggtgcttatagaggagtttccctcaaatggtctggtttgcaatcactatgcttgcattctaggatcctgggagagtcaggtccatactgagaaatagggtcccaaggaaggtgttacgacgtgaagatgtgccataaggcagacttgggtttgttgttgtcattgttgtttggttttagcttcttagtgtcaggatatctagtaacaatggagttggtctgaaaactgaatggtcaaatgcagtaagtgatacgactctgggcggggtgtggaccgtgagtgagacaaagacttgggttttgaaataactggctgcttgatgatactggacaagttccactggtcctgaatttgaataactgcatgacttgaacttaatagtagctggtttgttacctccccaatctccctccattatcatcccactccaaatagccagatattatcctggattcagctgtttcttttcccattgatttggtggctcaagtctaatggaaatgagttcatgtcatccaaatttcctttcactgaattatattcctaataaccctgagcttagcacctggcacatttatctaaacaacttcaaggggttatctggctcttctgcatcccatgtggggaaaagggaagcagaagtgcctctaaagacaattggagaattgagatgctcatccagctaactcaagccaagtattattttggcctggaatttagagttctggtggagatggtgttttgtatcaacttccagatatctgtcatatattttattttaccttgcagctgccaaaacgaccagagtggccaagtgacttgccattaactcccagtggtgggagaatccagctcacccatttcaagtccagcctcccgccctctatgccacatggttatactattcagcattcaaacgtcatgacagactggcctttcactgttctgccaacgtgaggaaagaccaaagcagtccgtttgggaaagcaaaaagcagaattcttcctaaccgataaaatattttgccactatgacctactgtaatgataccacgttgcactcttgcattatggaatggtatttttgctaagaaattctgcagtcccattgattcagaatgccattgttgaggagctggggacctaccttttccttccacggaatctaaaggcaattacaactggcttctttcatgccaacctacatttggctacaatgctgagagccatacctttttgaaaagcctactttttatcaggagatggctttgattcctttgccactaggcttggggtgatttaccatcaaattccatcacaagtggctctggctttgtagaacacagtacacaggaggggcacccgaagcaaagacgaccttctctactccaaaaatcaatcgtccacctttggcaaattctcctttcagattcatgcttggtgctcatgggtactcactctactttcctcccttgctggacaataagcagtaacaatatcttgttggtcccatacacaccacacctttggtctcttggagaatttcagccgtaccaatggcaacctctgagtgacatcttaatatgatcagatgtgatgacatttagtaacaggttctcatttttggctcaccagcttttcggcctacatatcatcagaatagactgaggcacattagtgaaatctcaatagtaaacaagcaggtactgccaataaaagaaaagcattcttaaactgattaaaaaaaaaatttaaagagcactttaatcaccatcagatactttcattcataccaccttttggggcatcagttcataatgcagaaaagatgaaagagcatctaaaggaaataatgttaacaactccgttataaaatatctgaagcaataccttgccattgtcatcaatgcttactgatccattgtgataaataataataccttgacatacaaacacggctggagctatgggttcccctaaacgatttttttttttttgagaatcaatcatttatcgaagcctgtaggttgtatatggttgctaatcatgggaaacgggggaggtgtctatcccgagcaatggcaatgagttaggttgttgacgacacaggactgagaatttctgggaagcccaaagaatctttttaatcatgcccgaatgccatttccgatctagtcaaacatttgtgagctccagaggagaactgtgcaatcaatcttgagagtatatgtaaaattacccaggactcttgttgggattaagagtatcttggtaataaggattcatcattctctttcaaaaatcatctgtagatttgcagcacaatcttcaactacagaaaggtgggatttagaaagcagttgctgttttttatagttgaggccctcagatctaaattatccatccttccaaaactcggtgttgggataaaatgttaagtagctgcttttcatcaacattcatttgataactgctagccatcaattttagttgtcagcacagaatacaaatgaatattgactcctttaaaggaaagggtacagaggttctgataaacaatatatggtaaagaaaaaaaaaagcacccacatattgatatttgtaagcattggttagtactctaatataatactcacagggacacatgttacaccgtgttttgcttcaggtttttctattttaaaatgcatgctcatttaaaagaaagaggagattcctgtcttaagtagacttaactatgagatatataaaaaatagacacaatatcatggcatatctatatttcaatgattgtgagagagtagatgttctaagattgctttcttacagggacattgcacacaaatgctgaattaatccacttatgcaaaaagtagagttatgaaaggaatgaaccctggagttagattaggcttggaacaccaagagcagggaaggagaacagcccttttgaagacggagtgttcccatgactaacgtcccaggacaaagtggtgatctgaagtgagcaggtttggcaaaaggaaagacacatacctcttcaaaccctgcctacttccattgttactcatctggtgctgttggacaaagcaaatacttctcaaatgcaaagccagccaccttatccactgactcttgaatacaccactaggaacagaatcatttatcagagagctacatttatcagagagctgcgcggtggagatgagggggtgagccctcatgtcacaggtggaatagatggccgtctacacccctgtctttccctgtctcccagtaacactcccccaggagaggctataaccactctcccgaacagtgcagaggtcatctccagatacctcggtgcttgggatacagccattcctcacaacaattacagcttcaatctctcattggaaacacaaatgaaagcaaactgctccaaaaggcacttgttccctactcactatccaagagcaatcttttaggggacacatttgccacaaatgcatttgttcataaagtaatgcagcctatacaggaatgaggctcataggcctccctggcaggtgaccacaccagtaagtcaccctcttcttccaccgtgatacttctataatgaaatttacaattcaatttggaataagtgctaaccaacgaacacaccaacttccaccaaaatgatggaagcagcagacgagaacagagatgtctactccaaagtcctcagccctgcaaactgccggctttttcagtgagttgtagccaacgagtactattcaagtgacatcaatgactagcattattgagaggttacgatttgccaggctctgcatggagagctttgtaagcattgttgcctaccctcacagagctctatgagccagggacagttagtatttccatttatttagagagaagctacctgatatcagagatcaaaagcaactcgtccaaagccatacagataattacgtagatgagtgacttcagactccgtgtccgttggtacatgaaacctgctccccaaatatgtgaccaaatatttgcacgtggcccatttcctcatctatgtcttccacggggctccggcttccttgcctctctgcctgctctgccgccttctcagccaggccatgtctggccatgaggtgatgcctaacatggcctaaaatgaaatgtgggggctgtcgtgtgttcacccgagaaatgttaaaggagatttttttttccattgatttactcatggagctaaattgaaatgatatccatttgatgaacaaaaatgaagactcagcacccccttcgatgatccaacagcaagtgacccttacaaaaaggtcgtccgattcaaaatgccatctccaggtgccagatttgcagaactaagaaactactctttgatgatagaattttttcaaagcaccgacatcccatacaagtgaagtggaccaacccccatcttatcagttcccacgcatgtaggtgcgggctctggagtgtttcatcagtttgcagagaaaatactgatccatccctctgactccctctcctccaatgattcctaacaagtcattcctacaaattcctgacaactgactcccacaaaggccttcaacaatccagcctagacacatgcaaatacttcctgtaggtattgaaatgtaactttcttcataaacctttggagttttgctaactcacaggctattcttaacctttattatagaagaggaatgcactcaattcccaaaaagaaacaatgaagatgatcaggaaagcaaatatttgttttcaggctttagagtgtgagaaagtgttctggagaatccatttagatcccatgccaactcttagccctccagagagaacatgccctccctaacaaattagacgtggacaatgtgtttagatgttgatctttgccacaaggaaaaatatttctttgctagcaacaggttcacaaaggtagaaaaacctcagctccttttcagttgcctctcccatgacaggtgaagagtgtcattccccaggtgacactaggacagtgtctatgacaggggcttgatggccgtggctcagagagagtaaagtgccagtcatcaccataaatgcaacaggttcaagcacagaccacaaccacaaattacaagggacacctgagagaaacgcatgcagggggaagagtgccatgcagcttttaaatgacaggcacgtgccacaggcttctgttcagagagaacctgtgagctgtcctgtggcctttcctgtttgcggtcagccatcccaaatatgatgcccccaaatccgagtctggctagaaggaagtgtcatacaaggccatgccattctccctgacaaaagacatgagtttcttgcaagagcactaagaagtttaagaggtggactcgaagagaggagaatgaattggaaagccagcaagaatgtggctcttctcctctgtgaaatatttgcaggaacgagcctggagaccagcaggttcaggatggaaagtggaaagaattctttcctaaaacttaagttttagagaaaaataggcagccagtcccaacacccaaaggcgtccaaagccatgtttgttctgggaaggccaaggcatgggaggatgttacttgggctatcagcaggattgaagggcagggtgaccttggtacgctgtcagggcctgtgttccaagtcgacaaactgttctgagcttttccatgaaacgagtgaagcccttttcatactccttcgtgttccagaattcttgccatcgatgttccaaaggatctgtgatagatttatgctagccttaaatgggacgagttgtaacattcagaattattttatctttctgagacctgcattattgtgagaccctagacatgctttgctggggttagggtgagggtactcctaacgaggaaggaaaaagaaacggcttcaaggcaatccatgtgggtcattacatgcacacttgttcatcttccatttgtgcctgcccaaagcgttctagaactgaccggacctgagaggctgtctattagaactaagagaaggtattgttgatgatgtcttatatccatggaagaattccctggcattccctctgatgctgcctgggatacctacattgctcaaagtacagtttctttatgaaagggatgaaacatcgcattggggtatctattcttccatggttggtttgaaatagccaagagaagtgccatagaaatttgccaacaaaataagcatctaactgatagtgtcgtccttctcatggaacaaatctgatggcatgtcactgaaattttccaactgggccaccttgatgccctgctaaaggactgctgggtgtttataagatataaaagaagatatttagtgtgtgtttattgaaacattttacatttttactctacttctttaacctctgttatggttatagctagctctgtactgcgtataaatgtatgcatctgtattcgccatctacaccaaaataaacctttgaattattgccaggcagaattaatgagctcagttctaacagcgcaaagaatatcttcatacacaggtaaaacaaacagcttctcccttcccttcttctgcacagaatggctctacgaagttgcctgcaaaattacgtcttttagaaaaccaagtagctggctgttttgtgagcagggagatttcaggacgaaccacaaacaagctgtttgtttagattttaaggttgacagttcatttcacgtatgccccataagtattctataacatagtcctgaaaaagcactgaagaaaaaaaaaaaaaaaacacaaggtctccgctggggccacatcatgggaaggaattaactcttaactcgccttccagaaacaaattaagaggatgtactttgcaataattcagatctcacaggtaggccccaatgtccagccccgctatttcaaatcgggcatgtctgagttaggtgtgtggatttcatacagagctcactggaacagaccatttctcaggttccaagacgctggccttgttaattttcatttagaacatactgtggagagtgtctcatttatattacttccataattaatggtatagcttaggcactgcctttacacagagagatctcttcacagtggtcgatgggtaatgaaaacaatagatatttcattcaccagcagcgtgttgctagttagtaggaaatgatcgtgttgctgttgctttaattgcccgggtaaataattctgcctcggtgttagtgagcattttaagcacttgatgcccatagactagaaacaaacaaaaattaaccttgattatgcaacaccttgcatagaaagttacaaaggtatgtctttttcaaagtttgcattctatcatgcaaatatttctaaatatgcatgtgctgactactcatctactgtattttaggaaatacaattaggctgctttctcttcccctatgtagactgtaaataactgtagatctttctcttgtttccctatgaaatatatgtaaatactaacaagctatgcatgctgctattctaggcaatttcaggtactttataatatgaaggcatgtacttgaactcgtttgttaacagaggggaaaaaacgctctcaactctttaaagctgaatagaaattaaagatttcttcctagactgttgtggcttctttttttgccttctcttgccggaatcgagtgccccactccagctctgaccttctcccagcaaaacacacagcacacacaggcccgggaacaacagtggaaggacttggcttgggctttttcaactttctttgggtttcctaaaaaacatctagaatcacaaggtaggtttctttggatcttctagcaaaagaatctcgacggaatgtaattcctatttgttgttcctttaccgtgtgcctatatcccaaaacactactgagggtcccgtcattcccatctcaacaatacggagactgagcaggtcaaggccaatgacaaaagtgacaacactactaagtgccacccaagccctcattcttcctgtatataataggtcagtaaactacttctgcaaagggccagagattaagtaatttggctctgtggcccatataatgtctggcacgatcactcaactctgctattgttgtgaaagggccatcgacaacgtctacccaaatgaacgtgtctgtattccaataaaactttatttataaaaaaaaggcactgggccagatttagccggcaggccatagtttgtcaatctctgctctcacacgattaagactgttattaaagactgagagcatttccctttttaacttgtgtgtttatggatcatggaaatgatttgatcaaatgaaaattcttctttttcctgcaagtgtcatgaataaacaggtgaacaaaaatgaaatcacctgagcttataaaacaggctgccttcctctacaaattacattgtcaaggtttcaatttagttatctttttgttttcataaatagggatgaagaaaaaagtcaggaagacaaaagtgaaaaaaaaacaggaaaaaagtaactgagcaacttcactcttcaatgagaggaaggaggctattacctcaggtatccatggaaaccaagcaggcataaactttttaatggttggaaaacagcgtttgcgtttgaagatgtttttcccaaattgatgcttcagtgtaaatgcattaattgacagtttccttcgggacttttttattgaagttccaaacttaatttgatggcacaagggactctctggagcccttgaagaatgctgcaaagtaggtctttagaaaaccgagccagctcaggcatcgtgtacaaatccaactctcttgcaagcaaatgaagaaacagatcttattccctgtaagtttcccatttaaaaaaaaaaaaagaaagaaaagaaaaaggaaaccctctctattcagctagggaagggagaggccctttctaaccctatcaagtgagaatcaatatcatctcttcagtcctggagggagctgagaatcagcaggggaagatagatccaggtatttttgcagatggggtggcaatatgggatggtaggaaaatccctgtgctgaagccagaagtccttacattggactcctgtctttgacacctatgacaagcactgagcctcagtctcctcatctggaaagtcgacataataatataaccttcatgtggttttggaaggatgagtgataacatttggccatttcctgggcacacaacaagtactagttcaaagcagctataactctgatttttacaagtttaaagcagctataactctgattatcacaatttaaagaaggaagcatacacatcaaagtatagatgaagcctgcacctccattttttggcctgccgtatagagactcgcctgtcacctggccccagcacctctcctttagccagaccatgagcccaggtacaatatcagcacagaggcacttgccagtcctttcaccatttctagattcccttccaaatcatccagagtttttcatgtctttgtccagggagtgtgaggctcaatactgcttagggagggttagtctaatcccaactgtaatggccaaaaaaaaagacgacgacgtggtgatgactgctggttactgagagtctcttaggtgccaacgacctgttattacttctattcgcacaatatcctcactccccaccaggcaggtgttattgtagtggaggggagacagggctaaaggaggtgaagtaactcacggccaagcaacggggcagtgctggaactcagattaaactgaggtctgggttcaaaacccatattcttgttgacgtgtaatgttctaactccatctctataccctttgtagcaccccagaatcatgcatacacttgaaaatctggcctcagattgagagcgggatacttatttcctgcctgggccatttgatccctctggtggccaaggcccctccacagaccagcagggacctttctcctcctttctgagctccatttctagtgcctaaaccctggcttcccaccaggcctctggcggatgtcatgtgattttgaacagtacagaccagaggggtctatggtgcctcccctgcagtgttctcttctgcaaattgctcttcgtgcaaagaggtcctgaaggctggcagggctcaggtgaggagcttggcatttgtggatcatctggcacaaccaccggggcagtctcacaacaagccagttgcaattggaactctctgcccccacagtaacagaaatgatgaactcatgacaatggggtacaccaaggaacatcttattcttctcctgcccctgccctctggctgccatacctgttaggattcatcctcttagaaatgcctggcaagggaaggcacacaaatgcacattgctactcagggaggtgtcagcgaggaacacaagccgttgtgtagctgaccttcgaactgtcaaggggttgaaaatctgtcctctaccagtacacctctggatccctaatcaaatgactttacaaggcagtcctcttcatgtatgaatcccataaggggccaggataccttctgtgacatgttctaggtggcaaggtggagaattttagctgactcttgcaagagccctatgaagttactacagtctcattgtattaataggaaaactgaggtcaagtcagtaaatgacttcataacataattctcaatgatgcagttttgattttgtgcccctggcggcctcctgctaagagattcgtgtgtctttgacgctttctgtgagggtccacctacgcatgatagatcctttagggggaattctgcacacattatccccagttaaagacagggaggcctggcaccatggctcacacctgtgatctcaacactttgggaggccaaggcaggtgatcacttgaggtcaggagttcgagaccagcctggccaacatggtgaaacctcatctctctaaaaatacaaaaattagccaggcgtggtggcgcacacctgtagtcccacttacttggaggctgaggcgggaggatggcttgaagccaggaggcagaggttgcagtgagccaagattcaccactgcactccagcttgggtgacagaatgagactccatcttgaaaaataaaataaataaaaacaccggggactgaagcccaaagaggcaaagttttctgcctaggtcaaagagcagtgacagagttaggagctgaaccaaatcacatggctctagacacccagtctcaacaactcactatgataaataggaacatgtccacagcacaagtgaagcaggaacatagcacaccttaggtcaggattttgagccatcatcatagtgacctttcaacaacaaagactagcaaacatttatgagggtttctggttcacattaagtgtttgatgggtactatttacaatatttataaaatatggtatttccatctaaccaatgtggaatcaaaagtccagaaaagttaagcaacctccccaggtcacacagctactacgtaggggtggggaaatttggacctgtgtcatctgtgccttgaccccactgctactaagcatcctgagccacagaaatcagacactcacaatgcattgtcaattatcccgtagtatgattaatgtctctagttaggttgctccaccaaggggcaccgagactcttaggtttgatgtgaaaactgcagtggaggccagggctttaattgcccatggaaaataataactcaaaccagtgagcagaggatgcagccatacccatgaaggagcaaaaaagcgggaggatttattttctttacttgtttttaatcttactcttttcttttctttactttctctttttttgagacagtctctctctcactcaggctggagtacagtggcgcaatctcgcttacatcaacctccgcctcccaggttcaagcgattctcctgcctcagcctcccgagtactgggattgcaggcacatgccaccatgcccagctaatttttgtggtttttgttttttttttagtagagacggggtttcaccatgttggccaggctggtctccaactcctgtcctcagggatccacctgtcttggcctccccaagtgctgggattataggcatgagccaccatgcccacccattttctaaagctgctcttgttcctcagattttggtagatgaccaattgatttaaatgttgtacacataagggaagatttataactgccccagatttcagttctccttaactccttgctttcctagaggctgggaagcataacttcctgctgattggaaagtgagagccttatacaggacacaagatccctggagtcctgatataaggacttcccatcatcatggtgggatgaactgcctcccatcgtcatggtgggatgaaccttgccctttgtcctgggtgtttgtgtttcaccacaatccgtagcaaacattgggaacaaataaataaattaccaagcaatatgttttcatgtcattacagaactgcctttctaaagcgatcaaaaaagcccagattatcaccacaacacctgtttgtggcagtgaggaatctaatgaaatggtctgataattaaatttactttccatgaattgctttgcttaaaggacatgtctacaaaaagcagggttggtgacagtggtgtacagtaagtgttcaagaactcgctcactggaggggggcagtgcagggggtgggtttgattacagtgtctgccaattcccatggtatgaatactctcaccacaagcaatttaaactgaatcagagttgggaggaaatgtacacactcagctcttggaagctgctatgatccagttctagagtcccttggtgatgacctgtggaatacagctgtaagaatttttgaggaagatcaagagtatgataaaacagatcaggacctcaaggtcataaagccattgggatgtggtaggcactggggaatgtataaacccaaaccagcttagggtacctgaaggacagaatggtacagacttggaattttaagcatgtttcaacttggtccctataacctaaaagttgactccactcaggtactcccctggcccaaggtaactatacttcctactgggtcaatatgagccctaaatatcatctagaaacggtgcaacgttgcctcagttaatactgcagcacctctgcaggtagataataccccatttcagagatgaggagactgaagttcaaggaattgaaagatgctcagggtgacacgaactcccgaaatgcattgccaggattcagatccagatctgccagaccttagacttcatatttccctagctctccagggaattgtgctccctttgagctctgtatccttgaaaatagacatctctacaacaagtgaaatctacatgttgtaacaaataatttggctccccctaaaaaaaaagtctctcattgggggagacaggatctgaatccctgggggtctggaggtagtgtaaggatgagaactggagggtgggggaagaaggaatggagac

SEQ ID NO: 5101 - DNA, 12700 bp, Homo sapiens
tccactgacatagcaaaagaagatatcctcttagctaccattgacacaggagatgcagaatctcaataacctctgaagtctctggcacactaaaggacagcagtgctggtgttgctgagctcctgcctttccacgtaaaaaggatgaagctgatatgagcaattataattcctccataaatccaatgtccctgctgatgaggctgtccaggtcactgattccattattcctgaggcgaaatccctcctgctcctgaagaaagcttcactactattccagacataactgcccttgagaagagaaaataaccgaaattgacctaagtgttttagaagatgacaccagtgctgtggcacattaactgactctgatgagaagtttatcactgtgtttgaactcactacctctgctgaaaagacaaagataaacgggaagatactctgctaactgatgaagaaactaccgagggagcagtatttggatggagagagatactgcaaatgaagcagagacccattctgttttgcttacgctgttgaatccagatatgacttcgttgtccctgcatcaatagctacaaacctagtggagaatcatctacagaagaagatttgtctgaaactgataatacagagactgtacctaagatactgagccattttctggaactacctctgtattagataccccagactataaggaagacactccacaactgaaacggatatctttgaactactgaaagaagaacccgatgagttcatgattaaaagcaacaaaagggataccatgtagaattgtgcaatagtctagccagctagccttacatctaagaaatttttccaacaagcaaaaacctttagaaatgaaagaatgtgggcatttaggcaagtattcgactcaataaatgcagatgcttaggactacaggtcatgtaacagattacggaaacttagaaaaaaaaaccgcagtgtaagggtccccctagtatcacaaagtttcatattctaacaattacttaatgtaaaatttttcgtcctagccttcagggagtatgaagacgagcaatgtaggggctcatttctacaacatttaatgatgcatatcatttagttaacagtaatattatacttaagtgagaattaaggatatgaagagaagcaaattaacctctccaaaaattaccatagcctaaaaagttctcccaaaatgcttgttctaagcaattttttcattagttttcatcagtgattctcttctatttaaaaaatttttaatcctcatataagaattaagacattcagtaattgtttagcacccacatgtaagatacataagatttatgatagggttcttgcacatgttagatacaaactaaagcaaaatgatattttacaaatatgcatatttgtcagaaaatgttctgtaaacatatacatcaatttaattttctttctgttaaaatgtgttttctgatttttgtccatgttttccaggtcttaaacactgaatatcacactcttcttatgactctgttagcgattcaaggacataaatcttcattcttttctggcacagactacttaaatgggttgttttcactttgctcatttttcttcaataaatctttttggcaagcaactgatttactggtgtaggtgtgtttgatattctactacagacttctcaaattaggagaaataaagagaaagaaaattcattgtttgtttaaagaataatatagctctaatccccagaagtaaaattatttatagagattcataattgtattacactaaaaaaagaaataagaacaatgccaaaacaccagtgaatgaaagatattatgtacggggggtttgtatagggatttgcaccattagataaatatagactagaataatcacaacagtgtgttaaaacccagaaacaaattacgaaacaaaatttgttatacagtgaagtggacttcaaaaacatgggatataatagttaatcttacttgacaatcagtatttgggaaaaaaatatgttggaataataaacaaatttttaaattctttttagaccatactttaaaataaattctacatggattaaatactttaatgtaaaaactaaaacatacaaaaacttaggaggaaatgtacctgtatatctatccaaatggacctgagaaatgtagcatatatgaaaaggtgataagaagattgataggtttgacaccatgaatagttaaaatctgaaacaaagaaaattaacataaaattaaaaagtaaataactaattttattttacatacagtgaaaagattactatcatttttctataaaagtttctacaaagtattttaaatgaacgtagaaattaacataattcatgaaacacaaattgttaatgaacatgtgaaaaatattcatagacatattcaaaaaattaaaataaagctagtacacatcagttttagccatttgaggatgacagtgattattgtacatattcattgttgactcattttccaaactttctccaaattttccagcctttctggaaggctggaagccaatttggcaatacatgtagcaagcattttaaaattggaagttttggcccagttattttacatattttacatattttagccctgagaattttctaagaatcagaaattattaaagttccagcagttattgagctctgactactggtcagcaagttgtgtttatatttagaataacatttgatcctcatgataccctagaaggagaaacatactattctcattttagtgataaggaaacagaaaagctactcaacatgcaccaagcttcaagttaatatgtagcaaagaacgcttctaacccaggcagtcttcatccagaacccatgctttttaatcactatactgtatgggccctcagatttaaatacaagaatgttggcaaactctacactgaagaatgtgattttacatgttcataagggaaaaacactgaaaacaatctacaatgtagtcacatgtaattaattacacttctgtatacccatatgaagccatagcttgcatctttaaaatggttctaaggaagaatatttaatcaaatggatgatattttcatacaactctagcaaatttacacagtggtatgtatgcaatatacacatgcacacacatacacacgcaagagaatgtctggattacatatatcacaatatataatctctaggaaggactgcaggtgatttgtttcattctctgtgctttcgtgcgtttttaaatgctctccaatcatccagaacataactgtacacaggagaggatgaatgtttgtcaaccccattaactagaaaacctggaagccagctaaatctttcactcttacttgcttcccatacccaattaaaatattacaagtattttggtgttccctatgtatcagacactactttatttttcatttacaaggcatgtatatgcaccactatgttccaagcaccatgaaagtgttttgagacactgtagtgaatcaaatgacaccaccctgccttcatggaaattaatctaccataaaagacaaattttagacaatctcaaataacacacaggaagaaatgactacatgcaaaatatggtgggtgtttcaaagaaaaaacaaaaattataattgcagatttcacatacatttaaggccaagaaattgtctctgagggggtaggtttaagctaaaatattgaaaaatgtggagagataaggaaacaacatctccaaatccttgggctagatttttcaaggatatgaacagacacggtatcagctggaacataagatgaaactgaaaggtaggaaagagagaaattatacagtacttgttaaacatcctggatcttatctgttggaagatattaaaggttttaatcattttatcctcaaaacagtcttagtactgagagcatgcctagctgaaaagcatcattattttataaactccaactatacttctttcaagggcttgtttaggaaaataacttgatagtcccctttgcttggaggagatgaggctctgaggcataaccaaactgcaacagttaaacaattaaaaagataatgtgctgtacaatacaagttaacaaatttggggctagggcttagaaataacaagaagaacagcacactggcaattggttagagccaggaagatgagtgtccagtgagattcctggtggtcaatgaacatttttccaagaaaggtgcctaattatgtgttttaccttgcgccatttcaaagcaaagtttctccttgccctgaatttgattaaacgtctgtaagacacaaggtcttaaatatgcacttcttgaaaaaataaaaaatataggaggcaaagaagaaacagataagtaattagagaatgaatatgagacagtcttcttcccaaatattctaaatagtgatgacctgagaaaggagtgatgggcatacagtgagagacatttagaatagtcacatttcacagataaccaaagtgaaacagaaaagtcactggcccagataacgatgctagtaagtaacaaagctcagctccagagacttgagtggctccaaattcaagttcaaatcacactgctttgtgtgaactgttgaataatgaatcattccatctcttatcataacccttccccttgatccattcctgttgccactgctttggttaaggctaatggtgtcttgtagctggtcatctcacctctggtcttgtatttagcaaattaattaagccccaagcactcatctctaaaccgttttgctcactccctgttcccacatgccttgccacagtcagaagaataagcacatgaaccagtcagagcaaaggggacaagaggaagtgctttggggagctctggggaataagtttctgaaggaaacttctgtctaaagacatttagggccgggagctctagaatcaccttggatgacaaggagacaggttgcttgacagtaaagtgaacactgaggtattagagacaagaaatataaatatgaaataataaaagaatgtgagactagtcacatccgtagcaagcctaactagtctgcttatttacctgagacaatgcattttctaattaaacaatttgggttatgttttttgttgtttgaaaccaacacaccttaaaaactgacaacccaagtatttcaagtccctgtgtctatttatttatttatttggtagagacagggtcttgccctctgcctggaatggtctcaaactactggcctcaagcaaccctcccaccacagcctccctaaggctgagattatagtgcctgctgttctcccagtgccacagtctcatgtggtaaatatcgttttcatattcacctcacatgctatcttctttaaccacccctcggtatgattacctgttggtatctcactatatacattctttaatcacactacctataatatttcattgtatttacttataaaagatcctcctgtgtcacaagataatcctacccatagtttcctctgacacatatactctgtccaaagttccctctgtcctagtgtaacccctgtttataatccccactgtacccttccctacagataaccttaccctggggcacagcactatcctccaagtcacagggagctttgaccacaaaaagagagggagagaagccaatcttaagaggcaaagactcctgaccatgagaaagaacgttaccctgaggagattcccaaagttaaactagctctacatgaggatgcataaagaacactcataacttcaaggcaccaagaacagtgggaaattaagccagtgtctttgagtatatgtgcttccaccaattctacctattgcaaattaggagtaaacaaaggatacataattacattttgagtctatggcctttattttcattacagcactactggtgtgttgttttcttttctcacatgtatttcaaacataagagaaggctgaattaaaattggcatttcccttcctcaaatttctcctcttctaatattctccatctcagcaaaaggcactatcttcacagtgtccaagccagaaactggggatcagccttcacttccctctcattctccatacctaataatacaaagtttttaccgtggcattctaaatacagcagaaatccatttgccctccttgccatgccatttctttatccaaatctctatcaagcaaaagtggaagtttattacacaaatatacatatcacttccacctcctaattcaaaaaattatccagtgactttccaccaactttaggtgaactccaaaatctttacgatattcatcagagtcaccacaatggaaaccctgcttatcatgcagccttgtaatatgctactatcagtttctgttctgaaatttcaactatatagatccattttgatcatccttagaacataaagttatgtcttgtatcaggatcaccgaatgtgcttgctctccctgaaaaattctgtaactcaccttttaaagtacacctaaatgtcacttggtagttatatcctccctggaccctaaatttatataagcccctgtattcttctgtcatatatattcacagtacactataccttgctttatgtagcatccataattatttcaattgcatgtttattacttttttcacactactgtaacaaagtgccgcaaactgggtggttaacaacaagaaaatctatatcccccacagttctggggtatataagttgaaatcaaggtgttagcaggacatgttctctctgcagtttctaggggatttttttcttgtgtttcttcctagcttctgggaccaactgctggcaatccttggcattccttggtttgtaaacaggtcattccactctctgctccttgtcacatgaggttctcctttgtgactccatgtcaagatgtctctctatttataatacaccagtcattggattaggctcatcctaatccattatgacctcatcttaacttgattcatctgaaaagacaccatttccaaatttggggtctcacaattactgggggttaggacttagcatattttgcgggggaggacataatttaacccataacctggttaatgcttattttcctcccagactgtatatctgataattaggatgatcacatcatttgttatgaaaaccagaactttttgagactgaaagagacaatataataatgactccaaaacaacagctgtaaaccagatgtcctaatagagctatccacactgtattcaaagcaaagaaaccagacactattgttcatgctcaattctgagagcttggaacacaatagatgctcaataaacatctgttaaataaataataaaatgtaccagtaaatgaggaaatgatgttttcatttattagactgaatgctctcgaagagagatggtctgtactagatgattagaattgaataccagttggccaagacaaaaagagcttgctggttgcaagctggaaaaggggaaggtcaaaaacacagaagcatgaaggcattggtgttattaataactatgaagtaagcacaatgggtctgagtataaatcataacaaaagattgtaagtgatattacagctttacaagcaaatcagaaatataatcaaattgtatcaaccatgcatattaggcaggattctccagagaaacagaaccaaatgggatatatagaaaggtgaaaaagccaggctgggaattcaggcaagagttgctatggcagtattgagtctgaaaccacaggggaggccagcaagcagaaaactcagaaagagttctgtgttacattcttgaggacaatttcttcttttccaggaaacctcagtctttgctcttaaggcctccaactaattagtaaggtctacccccattatgaagggtaatctgttttacttaaagtcaactgattgtaaagtcacagtaacacctagactagtggttgaccagacaatagggcatcatagcctagcctattgacacagaaaattaaccaatcacatcttgtgtagcaatttagtgttaaaacttcataaactaacagcccatattccctgaactagtttcactgaaattagagtttcagggtaaaatcattgatgaaatattggaatgaatttcctggagtctttaaataagaatgtatgtaagaaggttcattcagctctatcgtcatggagctctagtaaactcctctaaggataatgttctgaacatgttttgggaaatgcagatatagacaatgggaggcaaccaaagttttaagcattgatttgcatgttagattgtattttagaaagataatttcggtaaaaacataaaagttggatgggtgatcgaggaagctaaaaacagagatacaaccaactatggcattcatgtaagaaaggaaaataaagcccaaaagaagagcaagaatcagtaagaataattattaacattttaatattatcaaggtattccaatcacactgttaaacaaaatgatgatgtaataaagcatgagctaactacacagactcctcgacatgaacattttacgttgaaatctgaaagctctgaccagcctgttaggtatggtaggtgttcctagccaagttttctaagcaagaatcttgtgtattggatcctgacattttctcttagtctacagaattttacattagaatcatttgcaacaaaggaaggaaagaaaatttatttttatatatacatatatttacttggtcaaaagcattatatttacctagattaatgccaggaaatctactaattgatagagccacaaaaatacctaagacagctctctctgtctacaacttattcaccataatgattagccagaatgtctcacaacaaaagtaaacatacataagaatatcttggtgcagaggaaagaaaaagctgtggagaaaaaaaaatggattcaaatattggcttttgaaaatatgagcaagttattaattttctcaaattttgggtcttcccatacaaaattaccatctatgaaaaagcacacggatctagatctacatcctgtttatactttaggttgttctcattgtttttagtgatcctaaaataatttttagaaagtagagtaaactgaaaatccaataaccaaagagacgttgcacctagtgccctccaatttaccttgggataaaaagtctagaggtccttctccgttctttcattcatcacaacatgaattaagccaagaggatataccactgttaacagctaacttgaaagaaaagcattgaaaatctgatatccaccagtaggttttccagatgatgtttttctgtctttctggtaacaaacaagggcatttcatggaaattaaagcttgcatcaaagcaaatgtcaaactactacaatgttcacatttgtattggttaataactgtcacatttcttctgagcaaggtttcttctgtgatacaaaaccttgtgtaataaagaattattctgaatctagtggtaaaagatgtatagtaaggggtctcaaatggttcattagttgcctttttctctttcttttttttttttttttttttttaagacaggtctaactctgtcatccaggctggagtgtagtggcatcatcacagcttactgcagcctaatctcccaggctcaggtgatcctcccacctcagcctctgaagtagctgggactacaaagcacatcaccatgtccagataatttttttaattttttgtagagacagaaaaaggtacctgcccagctaatttttgtagagatggagtttcatcatgttgcccaagttggtctcaaattctgggctcaagcaatcctcccacctcagctaattcttgcgttttctctagagatgaggtccatcatattgcccaggctagtctcacactcctaggctcaagcgatcctcccactttggctcccaaaatgctgacattacaggtgtgagggccctttttctcatttttatgttaagaaatgtgagaaaagagcccattaatgtttcagttgagctaattttataatctctaaaaattacttcagcaatattttactttaaaaagccaaaaatgaacataaaagaagctatcattttaaatactttctcccagctcagaatacacattagcatataatagccaagcattatattataatagcagagtacagttaaaaagaaagaaaacattttaagccttgggtttctggtcaagttcattaattattgctttgcaataaaatgttaagtaatatctgaaatgaaggaaagagtgattcaatgtatcacatttaaattataatgaataaaccttcactttttctaatacacagtaattaaccatgacgttcctgaaaaaaatgaaaaggacaaatgttaacttttaaaaatttacctgtcctttttttgtttcaggaaatgatttggattaacccagaggcaaaggctaaataataataataatattttgcttcacaatatagaagggataaaggagagaaaaaataacctttataaggcacgaatcacctgtgctctttcactgagcttccagatttcacaagctgagaaaggctgacatttctggacaaacaaaaagaagaccccctcgttacagtatctttttttttaatttcaaaggcttaaaaatccattttctttagtctttgattatatgcagtttctaatagtggaagtatcatgaaatctcagactgctttccacataattccaacagaaaaaaatgatttgaaaggaaatactgtaaacagaaaaaaaattgatactgatttaataagttctcagctactagttttatccatttttaacagtaaaatggtaagaatttcaggaaaaatgataatataaaaatagcctgtcctccagaatctcagaatctttaaaatggccctttctagacatatgccatattttagttttgaacctataaaaatgaaaatgttctcagtggcagaaaaatcatgtactaaatgatgcaggaaatcattgggcctgattttatattagttgattgcctctatttatttatctcttttgttacaaagggacctacatattaattttgaaatgtgtctcatatttgcttgagattatgactgtttcatatggaagcaatacacttgttaatttggttttctatcttatttttggggtattgaaatctgaccacttcatcaatcaaaaaataaatcaccttatttaaaaattagaaaaataggcctctgataggttaggtaatatgaccaggatttggcaataaagctcttagctacttttctttgggaaaaaaatgaatgttagcaaaaaagaaaaaaggagagagagattcattattgaagtatcatgtgattgcaaaattatgaagaaagaatattttataatagtcttcaaataattaccatttgagatggatttgttttttacattttgtttgatgagagaattcagaagtaatgattgtatcaaaaaaatgaaagtttaacagaaatactaattttaagagttatttgttgataataaaattaatgctgatggtaaaattaaatgagtattcatatttctaacaatatatgtattttaggttatgagttaacattaaatttttctgtccgtgttttaagtatgtaaggtgaaaattagagtcagaagatcattttagtggaaatttctaggttttttgtgtgtttaaattatgatatcaatagaataccataaatttttttgagaacgaaaatccacacataaattacacaatcatctcatatctaacttcatttatgcttacattttctgtcatctatgtggataatttacatatagcatgatatttaaacatttaccttattaaacataagcatttttcaaatttccacaaacttgtatgattatgagtattgatgattatggcattcatatttttaattatgattatgagtattcatatttttatgattatgagtattcaatttttaattatcagtaacactgaaatgaacacaattgggtttgttctattgcttaattgttgaggatgatttccataaattaggttttgaagttacaggtatcaacattttcatgttattttgtgtattgttatacggctattaaaaaaattagctaaattaatagaactaatggtgtgtaaaaggtcatataccttaccacattctcaatcttattttgggtttgccttcttaataactgtttagtaatcataaaataatagataaaaaggtaggctcaatatttgttttcctacaattaaatgagaaattttgtcaggattcttcatttactttatgtagtgttattagaatcactattcttaacctttgctcctatatgttgaactccatgtttttcttttaaattgtagttcttcttatgccatagatatgatatatgccatagatatgccataatagacataagtgttttccattggttaaaatttaccaaaaacaaatttttatttctttttttgtctcatcacaatgaagctgcttggttccagaggacccaaagacaagatgaaggctctgattttgtttgaatcattttggtctttactgcttacctcacagttatataaaatattttacatatatttatttcttattcagttc

SEQ ID NO: 5102 - DNA, 26757 bp, Homo sapiens
agagatggttccaaaaacttaggctggtcgatcaggagggtttgtcttagggtttgttaaactcgaaaatgcccccttgaagcaagaaaagttaatgtcaggcctgaatcaaacaatgtttccttccaggccccagtctgtccataaagaatgtctgatccaaaggctagaaatggaagaacaggctattctcatgctttatcatgaccctgtcaacagcttcttcggaaagaatctcattgcaactgacccattaaagagtatcagtcattttctccacaacattcctatgtttgagctgcaaaggaggttagaataatttagaacaaaatcctcaagttactgatgaagaaaaggtccagagaaattaagtgacttgcccaaggtcactctgctagtgaagggcacaggcttgttggagcccaagatctctggctcccaagaactgctttttccattgcatcatttaagaagcacaaagctattttcctggaattgtgatttaaaaaaaaaaaaaaggtggcatgcccttggatcccaagtctcttcctgtagggcaatgctggagatagtatttattgagggggaaccagagaaatgactacaatatatgcaacattttatggatttatttttactataaaaagatcctaaacaattgcaaacattaagcaaattattagctgctcaaacttttctggaacaacaagaaactctctcccactgctcagtagcagttttgggtcataacatttgcacctgcttggacgtttccacctgtgatgtttcacttggcccctcagaaaaagcgctgccctgggatctttgattcagtgatgcaagagggatgttggctggtgagaaatgcttatttgagagggaaggggaggaggagaaaatactcccatagcacttttctttcttattttccttattttagaaagccaaatctgaacacattttccatcccatgtagtaatatatctcacataattttggttacggagggtacacaacacaaatctagcaagctttcaaaatcgatgtgcccagcctaaattgcgggctgtcactgggactgtcaatgatggaaaaatgaatctgtgtctgagaacgccacacatttcctccaagcctttaaggaacacactacccaaacccttgtcacaccgggttctcagatctgcaagctgcagtcccgtctttcatttcgctgtgagctccctcacagcccaggagatgcgttttcccagctcttacctagctctggtgctttgcagtaaagtgtatggagcctaggcactttcaagccaaaggaattccccctccccccatgacccaaaacgatggcatccgcgcactcgcaggtctctctccctcccttggttgaggggggcgggcaggaatcgcgggccaccccacctggcccgcaggcccgcagccacgtgcgggactccctcctgctcgcggatctcagaccggaagacgaaggaacgtggcctcgtagtaaaccgtagtaaagagagaagggaaaaaaatggggctcgtcacatggttacggcctggatttttctcaattaaaaataagagcaatgtgtgtttccggcccccgtccgtgggctggttggactttttcattcttaggattctgaccaaatgcaagaatacagctgagggcacaacgtcctcagtcggcgggcgcggtgcagaggggcctgcggctcggcctgcgggcacccgcgggaaagaggtgccaggcagggtggcagaagcggcccagggacgcccgcccgccaccaccgccaggggacccgcggagagccccgcccgcgcccgccgcggctcagccgtttcacatgctgattggctgtggtgggggccaatcagccccaaccgccccgcccgcccgggacccagagccgcgcggctgtgcccgagggcggggcccgcccgccagcgccgaccacgcggcccgggaaggggccccaccgccctggatgacccgaacgggcgggggcgggagacccgagggcggtctggctgcagattcccccaccccgggcgaagggggctcggaagagggaggagaaggaatgcaggaagcggaggtgacccggaaaagggaagtgccagggccgagagggtttgcgccagccaaaaaggccacagggctggggaaagggagggaggggaggcaaccttggaggtacggaatccttgacatcacaaaaaaggaaactgatgaaaaagaaatggaaagagtctttttctgttttttttctttttcttttttcttttaaaggggagggcataacaaagaatgacaaaaacaaaaaaactgaacccaaaaggcatggctgggtctgtgtctttgtcagctgcagtttcaaaactaaaagataaatttgatgccaggtaaggtggcagggctgctatgaccgagtctgagaggctctttttgccctgcttcttgggctccaatttactctctgcagagagtgggccacaagtactgcgaaattctgaaaaggagcaaagaaaaaaaggataatgtcaggaacatgaaataagaggtggaaacaaagggatggcagggatagtactagaaaacgagcaagccagaactaagaggctatgcaagagaaagggcaggcaaaaaggtcactggactacaggtaaagcagacaggcttccaacaagtagagctcctgagccagtgcttcacaagtgttctcctcttaacagacaatgaaaaattttaaacaagccgagagtttcaacagagcccacgcctcatcatacctctattcctttcaccgagtctcaggttttcctgagaaatgaggaaaagaagcaaagacagcaattgctgaggaagtgaggaaaataattttgcacacacattcggagcagaagctgtttgccactcacaggtctgacttctgtctgttcagatagctatagaataacatctttggactcaacagggcacaggcaagcaagcagaatgaggatgtaaatgtgccaggtagcatttggtgcctcactttaaacaccaacacaaacattcaaatacgcattgtagaattttcctggcactgtgcaaagcatggtcgattgttactccgaattattagaaataggattatatgattattccagaatattttattttcccaaagaaggtaaggatagaattttgtagagtttttgtttttttaatgcatccaacacataggagaatttattttaaagccctttttaaaaatgaaaattctagttggtcatcaattctcttcagagcaacatcatttattctactctataaaaagaaacctaaacaaattaagatgacaagtaagaaaacttattctctttatctcctttaaaaccaaaattttagttctgctgggctggttttctcaaattctcattattttaccaatgaggcactttataatacaaatgcttaaagtgttgaggattctgactcccaaaaacatcatttgatataacaagatttgtactactgatgttgattacacaattaaatctttcttctagtgaatgatgaaaataaatgttgaagtaaatactgacaaataaatgctttttgtaacatatcacccaaaatcttcatttgagtgttcatataccttttcttgttctataaaatagagaattatatggatcaaatattggaaacagaattaagaaactatgaacacatgataaataaatacctgtcaataggaaaccagggcacagattaatttttatgaatggacacaaattaagaaaaatcagtgcttttaaaagctcattctgtggagcaagataaaattcacaagataatcagtttgtcagagtaaagtgtttccaaatgctggaaactctgcattgccaactcatcacattatttgcaaactgtactctcttctacccacaattataccaccagaaaacaggatcaacagaacgaagggcaggctaatttcctattacaaatgttttcatttttaatacggcattagccacagaagacctaaagccaactttcagcatttactgggtgtctacttttgaacttaaaggcacacagcaaataaccctaaaagtggagggtatacgtttagcccttctactcaatgcaaaacaaaacaaattaaggcatgttcctgacttagtagcattcttctcaacaaataaaagtaattttacagaagatatatagtagcccccaaatgaatctgtaatgtctcagtgcaagaagagataactataaggcagacatcctaggatgaactccataactcttaataatgggtcccagacacatacagagtttcctgcatatcctgtacaaagaggccaggcccgtgggatggtgggtcggtgtgtgaataatatttcacaaatcctggtcatgaacaaaaggagaacgtcacccataattactttcttgagagatcacaaaatagatagtacttctctctaaatacatatttctaaaaagctcttactcctgatctttttagggcagatgaatagaaatcaatgcttcccgctgctgtttatgttgccctagtattatgaaatcacgaacaaaagtacagagaacaacttgataagatcacccttaagggctcccagaaactattagatagtttaagataaggaagggtttagcccctgtgttaacaaatattttttgtagaacgtcccttccaggggctgacctaaatatatagtgaaaagaaaacttcaacaaacaaatcagcttcttacggaggaactctacaaaacgcagaactggcataggatatatgttttaaaaaactgcagtaactacttcacttgggaattctcaaacgaaaaagccctcctgtggctgctctacatgtttgtttgactctctgccagatgtcagtgtggggtgagcatcttgtgtgccctagaatgtaagtgcattctccctgaggaagcagtgggaaagaacaggaaggggcagaggcaagaacagaattcaaggacaaggttaaaagcagttttgtcttctgactttgtcaccatgaacgcacctgctgtgatgtccagttgagctactgacggtcctctggctgcttctggaaatgatgctggcataggcgcttaaatcctcacttgagcggcgggtggagctgctctcaccgtgcccaggggttgatgagggggtgggggtgggggaggctgcggttcaggggtgcactccgagggcactgtttgaagtccttgaccaaatccaggtctatgtagttaagaccattctccaacccccagcagccccacacagtttggctggctccttgggggctcccccaagctccccagcctcagccacacattctcaaaggaagcagagctgtggcgtttcacatcctcgctgctgtgctgctaccgccaccgccccctactgctgcccccgctccaaagggcactgtgttgccccccgggtggcactgggtgttgaggagaaagtctcggagctatgcctccgccggcaccctgtgggtctgcacggatcactttggcactctggttgcggttaggactgaggttcacccggtgaaggcgctcatgcccccaggtccttgtgggccccccagcagggacgagtgggcagccgctctgctgccccttgaggcccagtcggggaagcagaggctgctgaggatgaggaggcacagccatggtggccctgggcaggctcacctcctctgcagcaatgcctgttcgcatgtcacatagcttacaggggcagctggcgaggtgtccacgtagctctgacggggacaactcatcgcatggtcatgtagtcaccccggctgctgggcactgcccgggtaggcctgcaaatgctacagccccgggaggtgcagggcccagtctgcccatctcgaccccagtgctctcctgccagctgccctccggcccggccccaggtccatcttcatgtactcctcagtgccagtctcttccctctgggagctggctggagctgggatggacacctgacagaaggtgagctgtggaaagccccgggccagacaagtagccagactgatcactcccaaattcaatattgacatattcccccggctcttgggctctggagggtgcagcaagggctgctgctgctgctgctgctctcgggccgaggtaaggtgctggccttgggatcccccagggacagcctcgtgggccgggccaggcggtattggtctgagcagctgtgtccacctttcgaggcagatggggctgcagaacctgatggggggatgtggaaggctgggctccagcctagccccgcagtatcccccacccaggctgtcgtgctggtggaagaggaagaatcatctgctgttgcagcatagagaaggcgaccagagctatggaaaggcggaggtgctgatgccgggcaccctcctccggctccccggggcgctgggtggcttaaaggatcttggcaatgagtagtaggagaggactggcttgtgctgggggtcctcaggccgtagtagcagtcggaggggctgctggtgttggagtcccccactggtgacatgttctgtagtcacctgtgcaaggtaagagcttaccaccgctgctctccactgggggtttgggggaggcaagacatgagagtggtggccccctaccccgtttgtccacagctttccatagctgtcccggaagggacggcgttgctgctgctgctgctgctgctggggccacctccaatgtcagagagcagccaccgctgggggacatcatcatgtagccattggggtccactctctggggaggcgtctgatgggattgatgatctgctgtggggcagatacgctcttggggctcatgggctatagtctccactgccctttcggccactgggcactggggccacccctggggacatgggctgtagccatcatccgtgtggagggtggagctgtctgggcggtggtgccccccccgacgcccaaggggtgcatttccagaccctcctctgggtaggagcgggtgggcacgaaggcggaggcctgtgtcccggcagtcggcctccactgccacctcctggtgggtaggcaggcatcatcctgtgtactcctcaatggaagccactgaggactgggacggggtcttctggtgggtaatgtaggggatgtgcctgccgagtgagttctctttcggaaccgattatccagatctgcagcatggctgcttcatccccagccaaggctggactcgtgcccaagcctgttcctggggtgcagggtggccattgccaccccgagacaaaatgtagtgaccgttgggggcggtcagggtggaggccccttgccacccatgcagatatagttgcttagctcctcctcaccgcgggctggtgggtgtggcccagggaatccggagtgacactgcggaaggaactccggaaatcgcagggactgagccatactcatccgaggagatgaaaccgccatcgctgggggaaccagacaccgaagcatagatcgccgtgggaagagacaatccgaggtggagccatggccactggtgctactggacacagactgaccgggctggtggccgaaggcgagcagcgggaagccggcatggggatggagggctgtggttgagcggggggtgcagccgggcgctgccccgatgccggtgggcgtgggtttgttggtgctgggactcacagggctgccgtccaccgaggctgggcgggacatggtgcctcgccgtcactggaggcgcggacacggaaggagcctggcttcccgcccaccatgctggccgggaggtggcggtgatgctctcagtgcgtgatcggcgggtcagccccacctggctgggcggggattgttgagatggtgccggcgcagggggacgctgatggggttagagcagttggacaggactggctcttgctgcgagggcggaactcatcactcatggcccgcatggcctccaggtggtctcgtgcatgttctgggccaccacagagtcatccacctgcatccagaactccccggccccgtcacggcagaacggcccacctcgatgaagaagaagttttccgagtggccacaggcctgatgttcatcagctgcagcaccacggccgctgcctccgagttcagcttcacgaagtgatggtcttgctggtcaggcaaaggcggtagataccaatcaggttctttgtctgacccggcccttgggcttcaggatcacttgccagacctctttgaatgcgggtcctgggggcacgcaccgtagctcaagtcctccccagcctcaccaaggccggagctgccgctgcagctgccccaccacctcccgccccgagggccgcagctccgtcgtggtggcccttagcacggttgtgcgctgtaggagagcctggtaccagctgtcttgctcggcctcgctgtccgccgcgatggcaagtgctcgtcccgggtgtagagagccaccaggtgcttgttcttggagtcagcccgcttgtgatgttgaagcagctctcaagggggatcgagcgtttgggggcgctcgacttgtgccgcacttcttctcgttctcgtagtactcgaggcgcgccgggcccccagcctcgctggccgcggcagtacgaagaagcgtttgtgcatgctcttgggtttgcgcaggtagcccaccttgcgccgtccgagaagccatcgctctccggagggctcgccatgctgccaccgccaccaccaacgtgagcagagggaggctccgaaaaacaaccgggtggggggcggaggctcctcgccgcggccggcacatgcaaacagggctggaggcagcagaaaccccgactctgaaatccacgccgcccccgcgccggggaggggcagctgaaggaggacgcagctgctgagcccaggagagagcccaccggagttttcgggcgcttcacgcccggcggggaggcagtgcgtccggggtgagggcaccccgatcctccgagagccaagtctcctctcagccgccgccgccaccaggaaggagcgagatgcatctctcgtcgccccggctggagtccggcacagggaggcgacagtcgggggtcctgcggtgcccctccaggagcgcgcgcgcgcgcgcgccttccctcctgagttcccctctgaagcagcgattcccgaggcaaattaaatatccttgggcagggggaggcgggttgccaagcccaacgttgcacggggttctccctcctccttcgcctcctcccaccccccaaccgtcccgccgccaccagccgcccaaataccagctcagtcgcagagaccgcggcgctgcggctgttctgttgctgctgctgctgctgctgctgctgccgccgcccgcgggcgcgtcctctgcagccccatccgggcccatctcggcgggtggagaaagtggcttttccatgcgaaacgataccggcagccactgcagctggggaccggccggagggacagactcatccctgcccctcgctccagcggctggggaggaggggaggggacaagggcgagaggggatgggggaggtttgggaaggttcggggaagacgcctgttcctcgggaggcgctgccgctgcagttacttctcccctcctcctcctcctcctcctcctcggagagttgccgagagccccaaccaaaacaagcggcggcgctggctctgcgcgccggccccctccgaccgcgccgccgtctcactcggaggagaaaaaccgtgacggagcctccgcgctcggcagccgggcagccgccgccgggaggctcccgcccggtctctacattccgggccgagcccgccccgcgcccgcccctctccgccccccagccgtgcgcagcggcgcccgcgccgaccccggcgcagcgctaggacagcgcccctgcgcggccgccgctccggcgcagcgcctccctacacgcgcgccaaccggggcgcccccggcccgcaggaaccccgcggcgggcgcaggcgggggtgtttgggtggctacccgaaagcacgaggggagtcgggaaaacgggagggggcgagctcgggaagacgcaggagtgagggtggggggccacggggggcactgcggctacagagccccgagtgggaggccggggggaggcgggggcgccggagcgggctgcctcttacctatcaggtaagactgacccacgggagggaggtttctagtcaaggtgtttcccccaggaaatttaaaagctagatttcggcttcagggcgataggccatggtgagggatctgtattttttaaggtttttctaaaggacttctgggccagccttccaccttgggtccccagatttgctgccgtgaggtacctggaaggaacagagggacgcccaagggcagtgctgggggcagttatggtcactacaaaaggagaacagggatccccaggaagtgtctcacgccggcgctgtggaattagttgctgatcaagtagggagaaaatgtaaatatcaccttttccctgctccccttgcccatccgtgtgacggggggactcacacctaaggctgagggcatggggaggggaaatgagaggtcccttatcatattccgaagtctatccgtgactttaaaaagcgttagggaccttcagagggttcataaggccaaaaccctactgtgcaaatattggctgaatgtttgtttcacacacagctcccacacccattgaaccaccctataagtttttaaccttgccacaaggataacagggagaaaacaaggatggtgccagctcaactgtacaggaaaatggtacttcatgagtggaccagatcagcagcctgggtctacttgaagcgcccctttcagggtaccttgcggtatcagtctccccacaaacaaacgctccccagagtttttttattttttaaccgacctataaacaagcagtttgtccctgcttgctcgcctggcactaaggacccacagaatgtcactcggtttaatgctgtctcattttgatgcctggcccgtttggggttgccgccctttactacgccgggaccctcctcggcctcaggctcccaggcactgcaggatgctggctggcactcagcagtcgaggcgctgggcatgctcagtggctgggacccggcgggccgcggggagcgcgcctcggcccaatgcggctgaggggcggagcgagtttcccggggaggcctgctgttggtgggatggcctgtttttcaagccttgcactgcagagggaaggtgggggtagaaggttgagggtaccaaggtaggttgcaaagcgtagtaaaaaaagaaaaagaagatgatgatgtgaaggagaaaaagaaccataggcgccattcaggggtgtgcgatacgtaaattagggggttgggcatctgcagaggggctcctccccacccaagcctgggagcctctcgtttctcctcccccttcctgttcccggtcgtcatgcagcctcatctaaacctggttaatctataatttggtacacatgttgaattgaaagccctcccttcttttcctctgacagcttggtgatgtgggacacgtgcccactacagcaaggctattaatagcagatatttggaaatggaagcgaggcgcactcacagtgaccgaaattctgggggtatagagtgccttacagggggtagggcagggagtgcagaataaagaagcctgaagttggtggaaaagtgtaactgtgtgcctggttttacctagacaagaaaaaagagagattataaaagggttgtttactagtaacaatgtaatccagaaaggccaaagggcttttcacaggtttgatgtttagcgctgggatgggggtagtggagtattaacattttgtaagacaacaaatcaaatccatggacatttacttttcaaatggccctgccctacctccgtccctccaccccccaccccccaaaaaaagctaaataaaggtactgtactctatgggggaaaaatactcttttctggaaggaggggagggttggaaaatttatttgcagtacctcacaattatcttcataggaaggattttgatcataaaaagctaattatgataataaccttttaaaaaatatatctctcagtgttaaagcatttctgctttaaaaaacacaattcagttgctaaatattcgataaaaattatgaaataagcctcactgctgtgacaaattatgtcagaccaatgggtttcctatggaagataatcactgatcataggatattagtgccatttttctacttgctgatgttttactaccaatttaaaggtggttaatatttgttataattatatacagtaaattcaattgttctctacaattgttttattaatgggctaactggaaattcattacatttggttcatgtaatatatagaatagaaagagacgcgtttgtgggaactcactgagtaatgctgagcaggtatgggtattattctgtcacctaagctaaattagtcttttggtgattgtaatgaaatacactgtatgaaaaatttactccccactgaaaattcacggaacagagaacaagctattaccaaaatctgttgctcaatgctgccatctataggagagttagagccatttgtgtaatatgctaaggttcattttaaaagagggctaaaatagtgatttcatcacacattgcaacagctacgttgatgtcactaatacagtcctaattcaaggagttaagggtttcatgctatggacgcactttggggcaataggtctacaactagctttaaaattgagttattgtttatgtatgatactatcaggaaaataatgcaaaatttatagattattacatatatcttaaagtgcttgagttgggtggatgtaaaactaaacatttcaaaattataaaacacttttgtatcaaaacatatgttttccttaagatgtatgggtcataactggaggagctatttaaaactggcgtctcttagaattaattttggcaatttagaacagtgcttgaaggacaattgaagtggattttctcactttaagatctgtttttattttaagatggctcaatagtaataagcattgaatgcttactctgcaaggcaatatgaaatagataaaaagacagcttcttacagcttgatggggtaataagagagtacaaaataacaatagttgatgactaaaatgtgtgtgtgtggtgtgtgtgtgtgagagagagagagagagatgtcaaataacaagtggtatttactttcagatggatgaaataactacttaatttttacagaagagaggagccttaagcttgaacttgaatgggctataactcagataaatggcaattattttttcccactcaagttttttggaacactacttgtgttaggcactaggctggacactgaggatttagatatcaaagacatgctgccccaggaaacttacatcgaaaatggcagatgaacacaattgcagagcactatgatctctttgtggaaaaaataggcacagggcaaatgagatcacataacaaccaactgccttctgacataacattatcagttacagacagtgcaatttgggaatctgaaaggtgcctcttcccttaaaactttgttttctcatgtaattaaaatctttcatctgttttatttaaaaatatataaaatggccaattaaaagagagctgaaaagtcacacttggcttgtaaatcggctagatcagggctctcaaacccgaggatcttgttataatgcaggttctggttaaatgcagaaggtcaagggagtctgaggcagtgcatttttaacatactctaggtgatgctgattctgctgggtaagtacatagttctaatgactgatgattaattgaaagacaataatttggtgctgtgacatgcaacaaggcacttatactttagtattatatacatatacagagagaacaacagcaagaaaaatctacttaactgaggcttcattgtatttgggcttctctcttttcaatcacaggcatcaaactttctggtaagcatgaagagttattatcaaacagttgtgttagtgttttccaaggtgtattgaaaatggagatttcttacctcatcccagtcctgctaaaccaaaatctcttagggaggatgggccccccagcattcacagtttaagcagcattacaggagattattatttacatcaaatttaagaatcattggcttaaacacaaagaaaaaaatgtaattttattcttccagaatggcaaatgcacagccttaaccagtcaacaaagatcttcacctgtgggctgtttactacgctgggtggagcaggcaatgacccaaacctgcatgagtctcccaatatgaattgattttctttgaagaatatcaattactggcaatcagctagtgagaatccagttctgctctcatctgatttcatccctcatctcttctagagaactgagggaaaataaatgcaccaagaactaactgggattttggaaagacagtaatgccctcaacagatgatttcaaaacatttgctgtttgggagcaaataaagcatgaaataaacaggtggatgaggttggaagaaaggagggaggtgaaactccatgccactgtttaattctttcacttcagaaattctactgattgattggtgattggggagtggtgaagagaatccataactgatatttgtctaaaaaacttggtcctggtccagcatagtagcttatgcttgtaatctccgcaatttgggaggcagaagcagaaagatccttagcccaggagttcaagtttgcagtgagctatgatcatgccaccgcactatagcctgggtacagagtgagactttgtctctaaaaataaataaaaagacaactagctttttcttttttattttcttgatttccttaactattatattctcattttcttgtttgataagaatcaggggttgccagtcaatttgttatcttagacaatgccactaatgtttttggtcatttaatccagaaaagaacccccagctgttttgtttgtttgtttgtttgttttgttttgttttgaggcagatcttattctcacccaggctggagtgcagtggcgccgtctcggctcactgcaacctccactcccaggttgaagcaattcttctgcctcagtctcctgagtagctgggattacaggcatgcctaccacgcccaggtaatttttgtatttttagtagatacggagtttcaccatgttggcaggctagtcttgaacccctgacctcaggtaatccacccgccttggcctcccaaagtgctggattataggcgtgtgccaccacacccaaccactgtttctcatatttgaagagccaagtttatatctagataagcatatgcttagaaagatttgcagactttacaacaccttttgctgttttgcccccttctttatcttaaatttgtctttttggtgcagtgcactctaaactttctaatttaaatttatatttaaaatctaaaatttgatagcccaaaaatgtcttcacagtaatcctcaacttcatttgtttattttttaatgtgaatttcagtaatgatgaatgtcccatgcctctattcagtgggcaggatctagaggtagagctagttggttttactgttggtcatattacaaagaattgctaggtcaccatgtccctctcattcttctcacatcccctcctcaattgaaggcaaatcatcataactttttctcagtaatgatggatattccgtgctctctattcactggcagggtctggtggtagaactagttgatttcactaacaaagaattgctgggtcaccaggccccctcattcttcccatatcctctcctcaactgcaaggttaacgaacatctctctcctctctttcttcttcttctttttactgggtctcatcactccaaggttctttattttaagaagaaaaaaaaaactgactagaagattaaggacattagttttctgtggattgggaagatcaagttaatttgaacttaagaaatttgtaattgcatcactacctgtggtgttgtccggttgactctacaagtgggcagagggttacccatatcagaatcacctgtggaattgttcaaacaaagcttcctgtgtcccacctctgatccttctaaatcagatcctctgtaggtcaatgttagttcccccatttcccattcccacctccatgagttttatgtatgctaagatttgaaagcactgatcggcctatctctaaaatcctagattacaaatgaagacattaggaaatatatgaatattaacctccagcaactgtcacaagtttggtcaatagtttttctgaaatattttacgcagtgactttaaaacttttgaccatgacctgcagtaaaaatacatttataaacacattaacatcagtgcgcacacacacactcagactcacttacaacgaaatacaacttacccttatacctgcaatgcactcagatctttttactctttcttatctctctttctctcaatctcacctttctctttttcttttaatgctttctaagacccactaaattaatttcctagcacactaggtgtcatgacctacagtctgaaaacaccaactttctatatgaatatttctgaattcaaaacagaacagaacaatgatcatctctagatccttggatgcaccaccaattgaactcctaggaggaaattcacaatgcttccaatggattcgagtttacctaagattatttttggtactaccaagaatgattttttcactgcttttttttcttaagtggttgggcaccagtctgtcccactaagcaatgaaatctgatgcacttacagttttcatacagtggaaatctgaagacaggaaaaggcaaattaagaacactgaatgtgattcagttactattttaaaaaatagacattttcatcacttcccaatattatttcattgtgataattgagctaatgttgtttgctatataagtattggaggaaaataagttagagattataaatgtatttaaaatatattcttgtaaattgtattttatttttgcatcagttttggattggggttaaaggagaaaatagtggttttctttataaagaagaaaaattttaaaaactgcttaccaggaatttaaattattagttttattataacattagtttcataaaaactagataaaatgttgctattttgtatttcttaatttaccaacataaatgtctttgattcctaggaaattaaaattttaagggctaattccccttcattaagaaatatttactgtgatgaagacatgttccatgcagaggaaatggccaatgcaaagacccctgactggagggcatttggcacattctaggagagtgaggaggtaagtgcagtgggacagagtgaggaaggggagaataggaagaagcacgcttagtgaaataacagtggacacaacataagggatcatgtaagcctttgtaaggactttggttttcgctctgggaggggaaaccctggatggtatataatacagcagtgacgtaatctgacatattttaaagacactctgggcgggcgctgtgactcaggcctgtaatcccagcactttgggaggccgaggcgggcatggtgcaggcacctgtagtcccagctactccagggggctgagtaagtagaagcacatgaaccagcaggtagaaattgcagtgagccgacgtcacgccactgcactctagcctgggtaacagaggagactctgtctcaaaaaaaaaaagagacactctggaagctctgttggaatagactgttgggggaggacaggggtagtggcagaagcagacctcataaaaggctactgcagaaatatgtcaagagatgatggtcattcgtaaagatggtgagaagtagtaaagttctgaatatatttgagggcagcatcagcagaatttgcaggtggtatggatgtgacatggaagaaaaagaatgaggatgactccaaggttttttttacttgtacaactgaaaagataaaatcaccatcaactagacaatgtatcagttttctatggctgggttaagaaactactctaaaggaataattatgaacatcaactcttttattatgctctaggattctatgggccaggaattcagacagggcacgtgttgatggcttgtctgtgtcctggctgggatggctcaaatggttgtgggactatttgcttgaaaggctggagcctggaatcatttgaaacattgttcactcatgtgtctggcacctcgttagaatgactgaaggctacatcaactagagtacttacatccggtctctccatgtgattggacttttcacagcgtggaggctggatttcaaaggtgagtgtctgaagagagaccattcgagagttaacatgccaagagggagcttctagagaggaggtgttccaagagaatcagaagaaattgtgtagccttttatgaccttacctcagaagtcagagcttcatttctactgtagtatcctattgatcaaagtagacatgagcccacccagataaaagggcagggaacctagacacagttcttgatggaagtagtgtcaaaaaaaaaaaaacttgtagtcattgttttaaacaccacagattgaaatactgtggctgaacaggaatggggaagatgggggaagatcaggagttggttctagacatgctgagtttcaggtgcttattgatcctccgagtggagatatcaagaggcatttgtgtatataaaccagagttgaaaagatgagtctgggcttaggtataaatgtaaggttgtcagcctatgagtaggatttaaagcccatgatactggataaaatcatcaagaagagaaagtagatagacaaaagaagaggacaaagatgccagcaagggagacagaagaacaccagtaaagttgctctcttttaggcaggaagacaccatatcaggaaaaagagagtgaaaactgagtcaattgctgctgatggtcaagtcagaagaagacttggaattaacataagattagcatcatgtttgtgttatgtataagatattaacattgattgcagatgcccacaatgttatgatctgactgaattctttagtggaatcacaaaagttcaacatactcagatgtgtacgtaggttagtagagtttgtagggataattatggcaacatattttatatttcctaaataatttaacttgaaaaattcctatgaggacagagatactaaagtacagtggatgctatgtttgtctcactatgcaatttagtcttgtctctaagattagacttctaaacattcttaagatttgagaaagagagggagagagagagacactcatattaataggaaaaattgccaagatatgcctaatttttaaaccaaatattttaaaatattttagacaaaagtttatatctaggaatcacttctagatttattagtctttactgatttaaaactttacaaaataacaaataatagcttcacctttttaaaaactattttaaaagactaatgtaaggtaatttactgcaaaagacaatatcaataccaacacctagttttaagttggaaaatgtgaaataaaatcttatgtaaaatcatcaatacccaacaatataataataatgtaacataaaattaccatgtcattggtgggaacacaatttactaaagtgtaaaaaccataacataactcttggaatctctatagaactacaaatatagttgatgcttgaacaatgcaggcattaggagtggcaactccacaaagttgaaatctgcatataactttagactctccaaaaacttaacttctaatagcctaccattgaccaaaactttactgataatgcagtagattatcacatattttgtatctgcattatatactgtattttaaaataaaataatctagagaaaagtgagtattgacggggcatggtggctcatgccgtaatcctagcattttggaaggctgaggtgggtggaacacctaaggtcaggaattcgagtcagcctggccaacatgacaaaatcccgtctctactaaaaatataaaaattagctgggttggtgtcaggcacctataatctcagctacttgtgaggctgaggcaggagaatcgcttgacccagggaggtggaagtttcagtgagccgagatcacaccacttcactccagcctgagcaaagagcaagactccgtctcaaaaaaaaaaaaaaaaaaaaaaaaagtgaatgttaagagatcataaggaaaagaaaatatatttactactcattaagtgaaagtggagcatcctaaagacttcatcctcatcatttccagattgagtaggctaaggagggggaagaagaagagggcttgtcttgctgtctcagtggaggcagaggcataagaaaaacgtggataaatggatccatgcgttcaaacccctgttgttcaagggccagctgtatgcttaaacacatccctgggggttgtaaactaatgttactgttgttttcattttgcaatttttccatcttgatataaaagcaaaataaagctaatctatgtacaatttattataggtcaactgagaatggcagaggactcatccacctttgccacatggtgacttgccccactcccccaggtgaccttgctcgtgcatgtggaatttgctcagattaagaatgtttcccacaaaattgcttactctctttcattctgtccgtgttgcttgtggtttatttgttgataactgagactatttaaagattgccaaaacaaaagcatttcttttctccccgaatagcctcattttttctattccctttttcccctcctattaactttctggggactctaaagcagagctcaagatggttcaggaccacggagagcgcaaggaagggaactaccaaagcactttagtcatgcaggtggggaaagagatgatcctaaaattgttttatttttctgtttttttgagagggagtctcgctctgtcacccaggctggagtgcagtacacgatcttggctcacttcaacctccgcgtcccgggtccaagcgattctagcgcctcagctcctgagtagctgggattacaggtgtgcaccaccatgcccagctaattttttgtattttagtagagactgggttttgccatgttggccaggctggtctccaattcctgacctccagtatccacccccctcagtctcccaaagtgctgggattacaggcgtgagccaccacgcccagcaatagtggaattgttgccggacaatatttatttaaaagacattattgtaaagagtaacgtgtaattctggctccttgaaatttgaggggaatgatttttctggacattcgaccagtgtttctaaatttctccactgaattctatctaatgacagatgagaggacactgaaagtagggtagccataagtcaccagtgcaaaatgtcttttgaagtttgcatttattgattgctacctttatgtaaagttttacagttttgacagtcatagggttcaccaatccaccatagaagagattaagtcatgcggacacagcagggtttagaatggatgagtagaggagtgtgtgcaggcccagtccccaaagtctctaggactgtcctagaacctgcagctcatctgtcaattctgtcactactcaggatcctctcaagaattatccccccatacccaccttttaaatttcctcaagtagtttcatttgagttttgtcacttgcaactgaatgagccctgctaatgcagatagattaattgagaaggggaattctaggctaggagtacaaggttacaggcaaggagacaggaacaagcttgggatttcctggggcagtgagaaaactgactttaaaaaaatggaatggtttctaaatgtttgtacaacttctctgtatggcaatggggtaggagtataaattctttcagcttctctgagggcagctgaacaagaagtataaaaattttgaatgctgataacatttgacctagaattccatctctagaaataaattctacagtagtaatcttaaaaacgtattcactgaaatttattttctcatagaaaatgtcgaaacaacatatgtgtccatcaatagagaacttgctaatgatttatactacctttacatattgaaatacgcatagccgtggaagataatttagtagtctatatgtcccattatggaacaatccccatggtggggggaaaagtaaggtgcagaacttatcatagatgttctctctctctctctttttttttggaaagcacatgtatgcttttataacacagaaaaattctagaatggcaaacaagatatctttgcaatagtttttttctgggagggactcatttaaaaaaattctcccatattgcttgttttgttttgttaaagacatccatgattcctacttgggttaagccatgataactaaatatgattaaagttcagaacaataaaaacttagagatgtatacataaatatcacttgcttaggaatttctaggtaggtactattttagccctctacatatattatttcattcaatccttggagcaactctaggagggaggtgttatctctaattgcagatgaggttgatgaagcttaaagagtaatgatgccttgagtccatccttggctccaaagcccttgtatttaactgttctcccttttgcatccctgtgctaaagtgacttgctataatatccacaaggaagaatttctgtgtaaaaattagacttccttgcaggcagctatcagtgatatccaataaagactcaataatggctaacaatacaaaccacacacacaaaaaaacttctccttttgtgccaggtacttagattaggtgtagtggttttcttaaactgatatcaaggtaaacaccacctcatacatttcagcagagagcagtggtttctctctccagcgtgggagccattgaatcaggacaatgccacacagttgggctttcatgttagatagatcatcttgtggttttgggggatggcattataagagaggagactggagacaggggggctattgcatgcagatttgttggatgtccacccagcattcactttttccatcttttgccaggggtaactacacaacatcaccagtcatttcatagaatggcaattagattaggcttaggtctgcatgccttccttcactccgctctgtcacttgccatcattgtaaatgctgacaacttagtgctttcatgcttcaagtatcaataagataggaatagtaatagtatcacattgaattattgtgagttttgaacagatgatacttgtgttatcagtgctcaataaatattagctgtcctcttcttattgttgttgtcctcaactatgtattttaaatgggattagtcacacaactcctcattcccccacccattaatacctgactcctttgcaaaacaaagcatagcatatggtggtgggattacaaaatcgttacagaaatttcatatgtaaaaaaggggcaagagttggccagtttgcacttccttaacctattttatttttcttaaatattacagtatcaccagatatactttcttttatttcttctctgagagtatgcaatttgtctgatgtgttgcctgctgtttttgggtggtgataaatatgagttctatatagggggtgaagaaagcattccatgagtgggactgtataacaatggagaaaagtcatgaaggaaagatggcattccatgtggactcgagtaaagtgacatgatatcttgtctataagggggatcatacatttaaagcattcagcaacctgtaaccacacaacagtctttccaagaagaagagagtatgagcttttagaggggaagaaaagtatcccttcccttgagaagcattcagagcatctagtatcacacttgggatatagcaggcatttgtactcaattaaagaatagaatgtgattaaataactttgagggcccacatggatgactttaatacggatcaaaagtttggacttagcttgtcagtaatgaggagcctttggtatgatcacaggagaagtaacatagcacatctgagatatagagtaaaatggaaaccttgagcaaaggaggctagttaggagtctgtttcaatagaccaaaggagatggagagcatgaggggctcagtagtcttgtggtggtggaaataaagaggaaaaagcaggtgcagaaaacattcagaggagaaacaatgggctgttgaaacaaattggatatttgggacaatagcaagagaaaagtcaaaataactgggattttaatcctgagcaacgggtaggctagtgagacatctaatcactctcccgtctccttccctgaaagttaattactcacagaaaaagcattagccagaagtcagcatgttacatcagttccttaaccctgcaagtccacattggtgatgcaggtggccaagacaggtctgcacacactggattacagcatggaagaggagcccagggtcatggaggcacccagcaatggcaaaatatgggcaccttgacctactgggttgcctatgtgaccagctacagaagctgtcagtatcaggagctggagctgcctgcaatctggccactcagcaagaattttcagagacgtttctattccatagtggatgctccatccaacaccattcttttaaagtgcgcacatctgtcactttccaagtataaatggcctgaatttattttcctttctttaccaaaatccaacctagtaatttttttctttccatactccttattcatgaactctaattgttggtaactttgaggcattggtcatcttaatttcttaccactaatgacatgacaagttaatttctgcaataagacagctaaaattatttttatatcttctaacataatattttgtcatgaatgctttcctagatcttccttctggaatcctactttttatgtagtttggagattctcttttctaaaataaaattagcatgtaagataataaagttattatatatttcatccaaactgtaaaaatacattgatattttacttcttaattcctctaggtaatataaaagtattttagacagttttatattgattaattgaagcatatcaaagttgattgatttctaaagactgtgaactcaacccacatagaggaggcaaaagtaaagattagaacttgccatttctattccagtccattaattctagctaagctatttctgataagtgtgtactctggagaaaaaaaaaatgttatttgaagagtggcactatatttgtttctggcaaaactaaagttttaaaattccagttcctcaacaaatggagatggaattttccagttcttcaaagtatgatttttaggacttgctactaaaggttaaatttctctctctattataacatattcatggatcctttagacattaaagtaaagttggagtgaagagtagaaaataacagaatctatttattgctttaggttttcttatgaattgccccctctctgtctctagtttgtgacatgatgctgatagcatgtctgttagtgtgtaggtgacgcgccttcagctagaagctggattcaacaacattaggctgacttgcaggctacaaagcctcgactaaggtcatcacatctggcaccagatttgatgtcaggagctgatgttcttttcacctcttcccccatgaacttcttaacttagtatttctaaggatattatacagtggcatcgtgtgacttaggctaggcagtgacaaatttaatgttacttcacctctgccagggtgaattcagacccatcaccgtgcccagaaacccaatagcacatttgaatattctgaactgcaaacctgttgcattaacaagaatagtatgggaatggtggcaaaaaaaaaaaaaaaaaaaaagaaaaaaacaagttgtgcaataaattatcagtttattttctggagaaggttactttgaaggtccaaatttcttctgtctaaggatccttggaatggtttaagaaacagcctacttatggtcaagttaagaaatgaataatctcttaaactatgccccatatccaagactctgttgtttacaattataccaagaaaatataaaacataggtctaggccaggcacagtggctcacgcctgtatcccagcactttggcgggccaaggtgggtggatcacctgaggttaggagtttgagaccgcctgaccaacatggtaaaaccctgtctctactaaaaatacaaaaattagctgggcatggggcaggcacctgtaattccagctactcgggaggctgaggcaggagaatcattcgagtccggaggcaaaggttgcagtgggcccagatagcaccactgcgccagccttggtgacagcgcagacgccatctcaaaaaaaccacacacacacgtctaatacctttttctgagggacaactgcattttagttcatttctcactgaagcaaaataacaatttacatttaaattgtggttttcttaaacataagaaaatgtatagttcttga

SEQ ID NO: 5103 - DNA, 61487 bp, Homo sapiens
agtctttgttgccagggacactatttgtgtccttcctgttctatgatgcctaacaaagactctaactcagggtgctgcactgatgcagactggatgctcacagaattgccagacttcaaaaagggggctcagtacattggtcctcaattttacatgcttagcttagtgaacaagaaataagggacatcttcagggatcagaatatgcggaaaaaattaaaggctacagggaaacttcaaaggttggcaagaaagacttgttccctcatatggatggaagaaaaacagaggtatgttaaaccaaaaatctggaattcaggtcttccacataacagcggaaaaacagatcttcagtgaatgctgcactgggaaaaacaatttgcccattagcaaagggagaaaacaaggaagctgattgtccctgagaatctgaaactttacaccaggcttcatttggatttgagatgaatattacaccacctgccttggataggaaccatcacagactttcaaggcatagaaacaaacattaaaatagtaccaggttgttaattacttctgaggtgcctggcacaggcagaaacaaagcaatatggaaggatggaatctctatcaaaaatcctcagagaaagctctattagcaatttaaatgacaaatatgggaggagacagctcactgttagtaaatgtgggcatcacaaggcacagaggattcaatgcccccacagtcccacccctgaacttcagagaggaaggtgaatagaaagaatgaaggtagaataatctcggggcttaaaggaaggaaagcatgctgcaattgctctctgactgaagcagagataaatattatgtaagctcctgtatttgtggatcatgcagaaatatttatcttcaaacaaatttggaaaattctggtttccacagagccgaacaggtggttctactcagaacttctcaaaatcttcagggtgttaatgttcagcttgctgtcagaatgttgtacaatgtttctcaaatgtgcttgaccatggaaccctgagacagcacaagtaacattggtcagacagtgtttgggaaccccctgtttaactatttgtgtctattttgtataatccttccaagaccgaaaagcattggaaggaaagataaaacttttctgtcccttacatgtccctccctcattgacctgaagatttttttttcctttttcttagaaattactgaggaaactatttaattgggtttttgccatggaaggtacttttacaccaacctaatacttttcttcatatagacatctctctgaagtgttttggaattgttattcttcatttcattattagttgttttcagaatttcctttttatttaaaaataattgatccatgtttttactgtaaaccattttaatctttaaaaaaataggcagtgtatgaattttaaattatccatgttgtattatttcattttccaatttggaagtagacattccgcacaatttatgacagaattgttaaacattaggctatttgccagggtttaatccagtgtaaaaatacattattggtgagattctttcattagcttcaaatgtctcgtttcaataagaaaatatttcttcttattacaaaaaaccaaaactttcactggatttaatttctgcttgtggaggttgaaaaaagggaaacggagctatagactgtttgccagcagttaatccagtgaaaaatacattattggtgagattattagcttcaaatattgttggttcgtaagaaaatgtttgttcttattacaaaacacaaaactttcactggatctaaattccgtatggaggttgaaagaagggaaacgaagcaagtaacaaaaagaagttgtggagtttattttttggaactttccacgattgtctatctaaaataatgatctacttaatttgttgtaaattactggagaaaggtcctaattttttaaaaatgttaataacgctccctgctggtttgcttcaaagggagcaaactacatcttcactgaaatttgtttaaggaagacaacaaaggaaaatagaggaatttgttaaaatcactttttaaaatacttggtgcattttgatatagtatagcggagcatcagcagaaggctgtttcattaggagagctctccagaaatttcataggaactcactaggttagcgcaacagcggagcccaaaggtagttttctagtgccctctggtggttaaagctattattactctgactgagattctgcgttgctggaatgggaaatattagaatagtggaattcctttctttttttttttttctgctcagcggttgaaattaaaaattgtaaatttatttacagttatatttgacatgttgttatttgaacagtgtatataaatccaaaatgtctgatagttaccaggttgagccacttaaagtagctgccattctatttggacccataaaaatggcattttataatacagtgcgttatctaaaaacaggtcacatatacttatttatcagttgaatttgtaaaaaacagaaccatttttttaagactagtttcttgtctttcatagctttcctggtttcccgaatactttcaagggggaatattatagtaagtttttgctatcaggagattttcagacagaaagcatggtataatccactctcaagaagaactgaaaaaatttggcctaaaaggcgggataactaatggtcacatttttaaagaatttcttggatgaagaaaaaggaagctgaataaaacaaaaacactggggttagttataagtcaaattaaattagaaataaaagattaaaataagcatgactgtctaagaaccccagctgaaggcttgactaatcatatctaaaccccgtgtcttaccatcctcttcaaatgcagcttcactcctagaaggggtttgaaatggctttccccagcttctcctctttcttgatgttttctcagccttgtactctggctaccttatctgcttagcttcttccctttggataccatccttcatgccctggaatgttatctgctattcttgatattttctgttattttaagttcctctttgaaatctttacaaaccccaattaaatctatcacccccttgcttaactctgctcaataacttcccactgctttcagaagaaagaaggagcaaggcaggaaagaaggaaggaaagaaataaaatccttactttgcttacaaggacctggtgatctggctccttccttcctcttcaccttcatctggtgccattcttccctccttcacccctgacaacattcgtcttctttccagtgcttggatggagaacactcacctgtcttaggctttacgtgacctttaccctctgcctagcactcttctttagagcttggctgactgacactagtgttttaggcctgagttacaaagtctccttctcagagaggatttctcagccactctactgaggagtcatcaactgtggcctgttccctaaatgagagctattatattttgtatttcacttgacttgcttatttgtttataatctttcttctctacccaaattaagctccacaagaaggaaccaagtctacttcattcatcaccctgtaatccaagtctgaaatactcccagattacggatactcaatagatatctgttgagttaatcaatgaacatgaccacttggtagcctcctcaagtttacctatatttaattctcagccatgctttgtcccatctttgctcatacttgtgtttatttataatgtaattactcattctttccacacatttttgaaagagattttgtgtttgtttttatggagtaagattttaaattgccacttgaacttaccacaccactagctctacaatgggagcccttaagtcaggaaagacattctccaagtaccatttgaaacttttgcattcagtttctttcgcagctccctttgctgggtgaggttgccaacatctagcccttggtcatgaggtggtctccgtggccatagaacagctccttatactcatccagccagacctcggcacccgcaccaagttccgctccactgtcttcatccggtctttggggaaggaatatggatttcatttctgaatatatggcccactcgggagcagggaatgatctcaatttcaccaccacaatccacacctggaagaatttgatgataagcatcaattatcaaatgattatccacaaatctcggcacttaacaatgacaagaaaccaccttgtttccccctacctgaagtaatactcaattcaaaaacacttttgcaatagaaaatcaaactcaacaggcttatttaattttgtgtatgctgtggatcattttaggattagtaaaatgtaattttttctttcctaactttcaatgtagttttttttaatttgtaaataaatcttcacagaatcccattttgtaaaacatgagttctgttttgattgaatcagggaaagaagtatagatgtccatttgttcacgttcctctactctatttttgggaagaaccaaaaggcttgtggaacacaactcaaaaccatccttcatgatcacagctccaaaattacacccttttacatacatacagaacacccacccaataggaaagcaatactttttggacactctctactactgctgttgccaaggctttctcagaagttaatcaatattgtataatagattgtataaagtgcccaaaggagctgtactataaggcacacctgaccgttggtgacctgctttagaggtattttaatgtacttctgtcatttgtgttctctaagatatccattacagattgagtctattccttccaacattctagacagatgttccaggagagttttttgtagcacgtatgactcccacagcatttactctgagtggcagaaagtcatttccccatatttataagcagaaatggtgttgtgaaatattagggaatgctaataaattttatgacgcaattgattcttccaaattcaatctgagatatgaaaaaattaatccagagaccctaaatttctgtgaaatttcctctcagtggcagtcacatacctgattatggtagtaaaatcaaacatttaaaattgattaactcattatcgtaaagaaaagttgggaaacacctggtaatacctgaatgagagctccatattttccccaccccaaacatcaaggccagggtcgtatgttccagttcaaaaaagtaacttttgtcaatagaaaacaatccaccagccatgacagggcacctaaaaaagaaaagtttgttttttaaacttgcatctcatgaaagctcgacttttagagttgtcctctgtacatctgtacgggaggtaggaggcttttcagaatagctacctgatgcagggagccctgggatggagtcacaaatagggcttaagtgatgcgatccctggatcatggtggcaagctagattaggttcagcaaagatgcatcctggaactagtattatttgtcctttatacttgacacaaactgtccaggaatgttatttttaacacttattcagggctaagggagtatcagcactattgtaagtattatatatatattccagcccagacttcacaaaaaatcttgtgtggcaattattaagaatctgcaacactggatgtgagggcgatctggctgcaacatctgtcacccattgattgccagggttgattcggctgatctagctggctaggcggctgtctccttccccctcaccgctccatgtgcgtccctcccgaaagctgcgcgctctgtggaagaggacgacatccctgatagaggagggccggtcttccggtcttctggtcttccggtcttccggtcttcgtcaagggtatatgagtagctgcgctctctactagaacctccaagcaagcgctcaggaatggcaacacggagaaggtaagaaactttcccaaggacagtagacaccttgggtttgctcgggcagtctgaggggacgctgtgccactcactccactgtactgcctctcagccgttactgaaggaaggccgtgagtgtgagttgtccaggttctgggtattttgaacaaagagttgaaaaaacacactaacaaaggaacgaaacacatgaacgaagcggcacaagcagggattcgttaagcgggaaagcgctccacagggtgggagtgggccggagcaaacggttcaagggccgggtaccaagttttctgggtttcaagtactcctttcgaggtccctaccagctgccccttatcgaatggaggatttggttggctaatgaaaggctgcggtgaattggcgccctgtgcagatgagggaaggtccctgcttggccagtccaaggcagagactctccctttccttctgagatgtgtggaaggggagggctgtagggagagtagccgttgatcctttgttactcgggtgtggggaatggggttttccttctggtttagctttaggaagtgggtgttaatcggccttagatccctgcccctagacccaggtgttttccttttgatccaggtttgggaagtcagcaggaattggcttagattccctgcccccagaccttggtgtttttccttgattcagctttaggaagtcggatgaattggccttaagcttcttgcctccagaccctattctcctgcctcacaaccacacaaaactttactgacagcgtgttatatggcaagcacctttcaaagcactttatatgttatcgattcagttcttaaaacaatcgaagtagcagctacttttatgagtctttatgtaaaaataaaaaacagaggctcaagatgataagtaaccttttcaagctcataccacttctcagtggacagttgagattcaaactgtctccagaaccttcactaataatattgatcatggaggataaaactacattttagtcagcagttagccaagactggaatcacttcctatggtggtcaccatcagccagctaaagtagtttctgtggagagcctgctttgtgcttagggtatacagtgattcaagggggagataattcctgtcccacacctctctcccctccgccaccatttatgttcatttctttctgctctccaattttcctactagactatccagaacgcattctcgtcctaacatatgttgaatatagtctgaactcaaccactacattggccctcaacatgagagtatggaagagcagaggttctttaggtgtaggttcagaataagagtgttaaatccaggtaattctggtttgagtctcaaattcttctttgattagctgcgtattcctgggaaaattacttaatgctttaagtctaaatttccccatctctttaaggtgaattcttccacctccctcctagagttagaagagagttaggtgcctggcacagagtgctcaataaatggtagaaccttcacttctttcttggtggaataattctgaaggcatcacacctggcaaggaaggcgggtatgactgattgggggtaagtttggggaaaacacgcttcggtgcacggtctgggcttggctttctgttgggctggcttacttgtgtctgtttaagtggtcactacaacagggaaagtttaagccccctgcgctcttcctgtggctggcttaatgcttgtgctgcaggcttatattctgaagaagtaatagaagcctccacttcagcttcaagtctaagctgtgttcttcaatgcagtttcttggaaataaagcccaaacttgaattcatatccagcttctgaatcaatttttaaatttattcatagatttggcacttttctcatggagggggtaggattaggctgtaaaagaaaatcctaaccattctatcattagaatgatatttctattaccattatttacttttaatttgcacttatgtttatttaatattacatgtgtttgtatagtatgtatgcagcacattttgctagtttgtgtttctaggttgcaaatcctaggggacaggatagcattagtgaatttttctgtgttcaggcctggtagggtacaaatgaccagtgaagaatgagttttgggaacgaatttctcaagaacactggtttgctttggtaatctattggctagaactgtgattcttaatgttctatagaataacaaatacagctgttttgtagaattttttaatgcttttacaaaaagatacatgactgctttctgtcttaaatttcccacacttaccttattgtatcagtttctttaattctgttttttgcaagacatctggaggaattgttctccaaccaaagttcatgggccacacaaagatgcctctttaaagttatccactgtcatgtaactaatccaggaaatgaaaaacaaagtgttatctgggatatatacatctttatatactttatcgatttggcttcacgatgtaatcaaatgaatgaaaaagtgcttttgatgagtttagatcaccaccttttaataatagttcaagaatgtttacaatacaatttgcattagtaactgattggcttatttgtgcttaacttatacttttataataaaatatgctagccagttttgaagaaaaaaaatacaagagcaacttaaaagcacatatacgttcccacagaaataagaactaaatttgaggtaaataaatatttggggttcagctaaataaaaggggaaaaactaggtcatgagtattaggatttattggtatttagagttaagaattttagtgaccagatagattattgcatcagcagactctgatcccaagatatcgaccatgttttccatttatttaagtagataaactgtatatgtcttggattttgaaaaaacacacatattggcatatactcagcactttctgctgcttgtgattaaagatgtgcttgaaagtatcttgtgaatgtgtaaatattacctcatatccttatcattgatgacttcgattactggacaggccctttctttctacttaaataaactctttccagaagaggttccaaccaaccaacgttacatccacatgagaatctaaaaatgtcaacacatcacctagagggccaaacacacacaaaaaattagaaaatacgatatattgaatgtgtgtacttcatgttcaaaggtattgatgattgctcagaaatgtggctataaatgcagtgaccttttttttttttctgaattcgtggtcactatatttcatttcatactgaaatgagagaaactttgctcctaggagtcctgtggtgcaaacaaatttatgtttggaaaaaattgataagccatttagaatgggcaaaagaatctgaaaagatacttggtattaaatgtagttgctgaagtcccctctgagagagtgtgcccattaactctggggtgcaggatttgggactttgtttttaagaagcagacagactgagatgacaagtttgccttaggaatgatgaagaggaaaaattacttcacacaatagggatgaaagaaattaaagggacaaaccagcgaggctaggaggtaatgaaaagagttataggagacaggagtggggaagggaggttactgattaatgggtatggagttttatttttgcaaggtaaaaagagttgtgggattgcacaccaatgtgaacgtatgtaacactatgggcctgcacacttaaaaatggttagatggtacatttttatattctatgtattttatacaatttttaaaaagacttagaggaggaaaaaaaaaaggaaaagaaacttggaggccagaaatagtattaagaactcttttatttcctgttagttgtgtgaagtaacactctctctctctctctccattgaaacctcagtagcattacattgctccagaggatcttatacaagtgaagtgtgtgtgtgtgtgtgtgtgtgtgtggtgtgtgggtgatgtgatgtgtgtgtgagagagtgtaacaacccaggaaataagctcctgtccacatcctatgtgtgatctttcaggcccaaccacaggtaatacaaaggctctacctctggggctcatgggggaaacctgctttctcactcagacttggtgcccagccagtgtgttaagtctctaaagggagttgcggtccaggtctcagaccctccactcggctgcagcacttgtcttctgcctgtctgcattcctaactcaggtgcctccattcaggccaaaacctctgccagaccactttattggagatggaatgggtcttgaagacactttgctcgactctgactcactttcagtgctttcccactcctagcctttcgctttcttactctggatcccagggccacatacagaaggagccttttgtgctgggttccttgggcaggcagtgagatgcccctcttgtctgtctgttctgctctgatccatcactcagcaacattccagggggaaaaatggaacataggagagccagtgccttctcctgttcagcctcctgttgatactgttgcagtaagggattaaggttgactactgctttcattttggtttatcattttaattgactactttgatacctgggtgccagctcagctcttgacatacctgtaagagcaaccatcatctaagtgcttgttctatgccgtctctgttctaaacattcttcatgcatgttttatgtagtctttacaacaaccctgcagatagaactaatttttattcccacttaagagacaaggaaactaaagaacaaagaccctagtaacttttctatggttgcgcagctaacaaacagcaatgtgatattagaaaataagtagccattccatagattacattctttaaaaaatgctagaaggaggcagagctttgagtatgagaggcttagagaacaagatgaggatagttatctagatgacagatcattatcactgaaatcgcaaactacctctcaattaatagaatttagcatcgtattaattacttggttaacaatggatttttgcatgagggcaaggtattggtgtggagtgttcttgaggattctgtttagtgaaccatctgtgagaagcaaacccgctccatgtagtcttctgttcttggagatagcagtttctctcctgaccaggctggaagggtcctattttcagggcattaatgcttgtttgacaatgaagggtattgtcccctgcatggtctgaatgtacgtgtcaatccaaaattcatattttgaacctaactctaagatgacagtattaggaggtggggcctttgtgataagatcatgagggtgagtcttcttaagtaggattagtgctcatatgaaagaggctggagagtgtttgtgagctcttttgcccttccaccatgtaaggtcacagtaacaaggtgccgcctttgaagcagacagtagctgtcactagacaccgaatctgctagtgccttgatcttggacttcccagcctccaaactgtgatcaataaatatatgctatttataaatgatctagtctaaggcattttgttatagagcccaaaaggactaagccatctcctaagggtgtcctttggggatggcacctttgggacgctgtctcccctgtcatgggaagactcacagagtcatgtaggtgtatgaagcgtggcctctaaagtccacttggctagtggtatacaatgtagtagaaaaagattcctggccgggtgtgtggctcacgcctataatctcagcactttgggaggctgaggtggtaggatcatgaggctagagatcaaggccatcctggccaacatggtgaaaccccatctctactaaaaatacaaaatcaaccgggcgtgtgtgtgtgcctgtagccccagctattcaggaggcctaggcaggagatcacttgaacccaggaggcggaggttgcagtgagcagagatcacggcactgcactccagctggtgacacagcaagactgtgtctcaaaaaaaaaaaataataatacgatttctacttgggtccattcagacctagagtttaaagagcattctttactacgccacctgtccctatcccatagcagccttatgaagtcaaaggggcctggattatctttctcagtccccagtggcagcggatgggtccccaaacctgcattcacttcccacctggcccagatccctatgaaaattctattcatttgctgccaggacctaagggaagcagcatctgctcaaaacatagtctggaatttatattgttttattttggggaagaggagaatcctcctgtgcatgcatgctattgctctatttcagacactttgttttaaaataagatcctaggactatgttaggtgagaaaacagggactctctgcgtagctgactcttggtgggatttctgattggcgtggttattgtctatggacttgtacgcactgttcctgattcagagaggggagaggcacagtgaaataagcatagcattaagttacatacaacagccttcaatccgagctctgcttttcctagccaggttagataagtacttaacttttttgagctttgccctatgaagatatttctaagagctacctgatatctaattctttaaaaattgctagtataatttactgtcagaataatcaacccaatcacttaaaattttaaatgacacataataattgtatatatttatggggtacatagtgatatttgatacataagtgtgtagtgatcaaatcagggtaattagcatatcaatcacctcaaacatttatcattatctgtattgggaacattcaaaatcctctctgatagctacttgaaaatatataataaatattgttaactatagtgaccctatagtgctacagagcactagatttggaaagggtaggaagaggggatatagggagaggcgggttaaagaatataaaattttagtccaaccttgattgtacctgttaggattttctgttttctaaggataggtcccaataatactggattgtttacaatgggtttcatttgtaacttaaaaatctggggggggggtgggtggtaacataaaactgtcaatgtgccaaaaattttgggtccttgttgagcatggacccccacttatatccagtgtacagcctggaatattgctgctgtaccagttaatgctagatggttatgtctaggattccttagggatgttggcttggcgtgccgtttaattttacataatgcctcctaagtaatgctaagaaaaaatttttacctgcagcagatacaagttataaaagtttgcagacagatgtctactgtgctttttaggagaccttggagtttgctaggagttagatgtcacttgtccagttacttaagttagccaagtgattatttagaatgctcatagaaatgtcaggaattttgccaaatgcctgtcatgaaggaaatgaaaacctaatatttactttgactctctactgcctgactgtaaccctcttggcagggcagtaaatcacttggtctgttccatactaggaagggatatgggtgactacttcttccctgatatctcatttactctatctttttaattctgttggcttcatataggagcaattcttagagatccattgccccggcctacctgtcaattttaaaatcctacttggcctctcaacctcctcattcacagcaagcaactgattggacctaatctttttgcctgaatagattcagatgaagaactaacatgccctggaaactgaatgcatagtagacattgctaatgtaaggccgatcactgcttggccccttattattttgtagatgattgcagactttcagaggcctcttgcagaacttcagagagcctcataataccctgggaccaaaataggccatctgattctatttctgcatgtctttggatctctggatctcacccttgcctgttacttccctttttttgagtcctaaagggcaaattttagggaacagtagcatcaaggcctgtcagattctggctcagattcttatctttaaactccttgtttggcgaggcatcctagagaaaatttttgtcgctgtctttgctgatctctaatttacaggaactcttcaggaggcccttagtctcttactatctctactcttgagagctgtggcacacccaggggagtttgagaggacccaccacgcctccatctctgctcaatgccagtctctgaattacattctctgctaaaactgatcctgcattccttgaattccccacaggggacaggtgtacttcccagcattggatgtatccttgggcaagatacatcgagacaaacctttcttctttccaaactctcaggcacccaagctccactaatctgctccaagtgtaggccacagaccctgctgtctacagggtgatagcaatagaaattgaaacaaatattttgaaactttatagcaatttgtcaaatttataaatttattatttatgtatgtttttatatacatgtagatacatatgcatatatatgtatatatgtgtttgtgtatgttatatatatatatatatacattttttttttttgagacagaattttgctcttgttgcccagctggagtgcagtggtgtgatcttggctcactgcaacctccgcctcccgggttcaagagttctctgcctcagcctcctgagtagctgggattacaggcacctgccaccactcccagctatttttttgtatttttagtagagacagggttttgccatgttgggcaggctggtctcgaatcctgacttcaggtgatctgcctgccttggcctcccaaagtgttgggattacaggagtggccaccacccagccatatatattttgtatgtaataaaaatgggtttgtgttttatatattactttcctttttgggtaattaatattgattataatttacaaaggggtaggtcaataaaaattggaaattaggggaaaaaaattccttttcagatagtttgggaagcatcactctactggcagtggcaagcaattaagatacacctagctggggtttttcaaactgagagctgtagatcccttagtgaatcaatcactaaatcaatttattgagattggctaggatctaaaacataataacatagaaaagaaggtattagaatctattccacatgttatttgataaaatgtctacgtagttatatgtgtgattacacatgtactgagttgtgatgaaacatttatttctacacagccattgtcaaaatggtttgacagttactgagctaatattctcaaggctgttaatgaattgaatttacattcagatttgctaaattcaaataaattacattatggatgttaactgcaacacttgagcaagcagttgcaactgctttaatcaagctcataacaccccttctaagacacccacccatgttgtctaatagtttggactgtgttggaggccgttactagcatactctgtgtccgtgcaggcagagagaaaatttttaaataagtaacccatatttggttctgtattctatttctgtgcatgaatatctcattttcatctcaaatttatatggacaaaatcaaaactcactgcaattccaaacctgctcctccagttttgagcctaccacccaccaagttgttcagatccagtcctagggtttgtttctgattggtgtcattcttactctcttcacatcttatctgaggcaagtcctatacgttccatgtgcacaatctatgatgaagctgaccatttctcccattaccctggcacctccctggtacttggacaactatagtagcctcctaactggcctccctactcctttttcatcttcctaatatccattctctacacagtggccagaatgagctttgaaaagtacatcagacagtttcgttcctatttaatattcttcattggcttcaccttatactgagataatgcctacaatctttaagtgatgcacaaaactttagaaaaatttgcttttttcttttccccaaatgaatcttttatgactctccccatggtcagcacccatgagtcaaaatgaactatttctttaccttgaatatgccaagctcatttcttcattaggacatttgtacttcttgtccatttgcttgggaatattcttcacccagacctcagctcaaaaattacctatttaaacagttcttgagtatcctatttttacatcatttatagataattactttccaaaggaaattagcatggaatgccattaaatttttctgaatgcagtctctcatcaagaatcttaactgtcatgcaatgccaattttggtgtgatgtatttgttgcttacttaaaatttcctctacaaagaaagacatttgttagcaaaccaatgaaatgagaagagcttcaaatatggggtccagttatagaaaattaaactcaggtaagcagaaaacttcccatcagaacatgcttgaatttaagctgtggagacctgtaaaagcagggcttacagggccagagtggtggctaaatgtctagaggctcaaggtgtagttgataagaggacggactctggggtcagggcattcaggtgccagctttgatttaccactggctagatgggggagcttgcataaggcacagcctcactgtgcctctatttctcatatgtagaatgaggatgtgattgtactcatctcatagagttattgtgaggattaatcagttaatacacaaagtattcagaatggcacctagcatataaatcagctagtattaagggcacagatccttccatagaaatgtatgaacatgaacccaaatgtttgatgttgttttagaatactcataaaatagattcacttctcattcactcaccaacacctgcacactaaaaggggagaggaaaagaaggcatatggcctttggggaaggcagaaagaaccataggaagaaagacatgggtcagagaagagaggggtgaggattatagaattaaaacattacgaaatcttaaatattgatgggtcaggtcaaaagggcacaggcttgaagaagctcctagtggtcaaattgggacaatttgaacaccaacaagaataatggtgatataatacacatttaatttctgagcataaatccatatcgatgaggggatgagagggaggggagagggagattgaggggaaaggaggaagagttagaaagcaggagagggagagatagagattttctccttacacatgaatgcagctaaataaaaaagaatgaattatagaaaagcaaattttcagtcctcagtgtaataatgatttaagcaaggatgatcaatggatactaaaaaccattgggtaaaacattgtaagaaaacagaatattttcatggatcaatgtgtcattccacaaattacttcttaatcccaaagtaaggtttagctgtcaacatcttaactaacaaagttagtatcaacaatactggtgatattagttatattatatgcctcttgatgagatgtataccatttctatcacctatgtagtagcatctatataatattttcactccaaaaacatttatcctgcaggtaacaagaggaaatcaaaatttcagaacatggtcactggtaccaaacaaatggcatgaacttaaaatacacacacacaacacacacacacacacacacacacacacacactggtatttaaacaaagtgtgtgaggagtgacttttcagactaagaagaccaaagtatcaaatgcagagtatgaaacttaattagttccgaatttaaaaaaacattttgaggcctgtaatcccagcactttgggaggccgaggcggcggatcacgagttcaggagtcgagaccatcctggctaacacagtgaaaccccgtctctataaaaatacaaaaaattagccgggcatggtggtgggtgcctgtaatcccagctacttggaggctgaggcaggagaacggtgtgaacgagggaggcggaggttgtggtgagctgagatgcaccagtgcactccagcctgggtgacagagcgagactctgtctcaaaaaaacaaaaacaaaacaaaaacattttgggaacaatgagaaaacttgaaaagagcatatagtaggtattattttagttatgaaagctgtgcttatttaagagaatgcttctgttcttcagagctgcccacgaagtacttaggggtgcagtatgatgatgtctgtaacttctttttcaaaggttcaggaaaaagtatatacaataggtgtctatgtgtgtttatgataaagcacatattataaaaactgttaaaattgatggaactaagtgatgcatatataggcatcattgtgctggtctttcacattgctgtatgtttgagaaacattttaaattaaaataaaaatgtaacaaacaaaaaaatgataacttcttacctgttgcattctgtgctcctgccagcctggcccttattaagccatgtcctctttgaggcgaagaatccgaacttttggaaactgggacatgtatttatccaaattatttttagatagtctacatcagagtaaagataaaccaggaaatacttgaattaagtaagtcggatagtatcagaagtgctccccaaagtcaaatgccaaaaactatgacattaccatcatactgaattttattccttgggtcataattttattttctgatgtcattttcttggaaggatctatctggtttcagtattcaaagctgtctgatttttcaaaccccaaatgtttgttttcatgttgtaaggtgatgtagtggagggcacacctttctgagtatttgtcaaggtgggggcaatttgccttaaaatatatgtagctcaggcttctgcacaattctgcctctactctcagcccacctcttgcaaaagccccttccatgacccaaggaagaggctaaacaatgtgtgcaaatagaccctttcattctctactctgacatccccttccattacaccttttctctcttattagtggccatggagggatccagctaaaggaacagttttccgggggctttatgagctatgttttgtgacttacagtcatttctgtgtgtaatcaagctattgacagctatcctaggttggaaggcttccagaaaactttctaagaaagtttttcttagacaggaccctgaaaactgaataacttcaggtcccacagaatctggacctgcccctcataaagggactcctatctacttactattgggtactattcctgtttatgcttccaaggccacattttatgtttttcagccagttttctctatcatcccacagcttcttgagctcagtgtgattatggcagaaactctgaagctaagaaacttcccatgttgctgtggtcacagctcaagggtaagctgttccattagcattgccagtctttgctattttctaaacttttctgaaaaatgggttccatttgggaatttgtaatgggctgtcagaccacctacatacacaggttatttgacaacccaaagagtgagattcttcatgtaataagcaaaaatgaacataaaggctatggtggattctggttttgaactttgttggatcacctcatctctcttgtcctattggcaatttgtcttcttaacacttaactgaacacacatatgccttgctctcaaggaagaagccataagatcttaatttctttgccttccatagatctaactgtaactctagttattaccagtaggcaaggcctcccgttaattgtgattccataaaagggatttgtgcaattgtagaggacatctaaactccactacttctaagtgcccatcccaaggagccatagttagatcattccaacatggtagcagagttacaactgagacaactactgaacagagctccagatgacttttaacgtccatagatgcttagacttatgtctctgagctccacgtaaaacaaagcatttgtacgatgtttatgcttcatcaaattatcctataatttgccatccaaactgctactaaactttgcttctgccaaactttgaaatttcaagagatagctgagtggttttcttacctttggtgctgaagtcatctaccagcagaatctccttgatgagtgtggaggagagcgattgatgacactgtgaacagatctcaggagagtggaccacacttatccacaaagcacatgatgacactggtggttgggaggttattgtgaactagctgctctgacatctgggccagaatataagcagagcacaagagatgtgctaaggagatccacaagatattttaaaagtcacagagtgcgatggtgtgcatatacacacacacttaatctgtcatcgactgtctggtctatctatcatctatttatatataccaatgatgattttattatttatcattgcctttttttggggaggggtacatgcaaaataaaaaagcagaagaattacccgtaacctggttgttataaaaggactagaaatgcaagacatgagaatgtcccatgcagacatcacatgcagtggaaaggacagggtttacaggtagttagactctatttcaaatctcatggccaaatttctcaggtctttaaccattaatgccttctttaacttctctgtgcctcagtttcctctctgcagaatgaggtaataaatggttcttattcaatagagttttgtagcctagtgataagtacatacaaagcctagcagggttcctggcacaggaatttatgaaatggtagttattgcatcattactagattatatgctagaagatagcattctgacttatttaatgttcccaagtgtttatgattgcctttccaactggctgtctgccaactgccatgggatttattcttttctccattctgcttgtgtatgtacttatggcataatatatatgtgccaaataattaaactcttttagcttccgtatccggggcttccttgctgatactctgctacagaatagccacagttgaaaaccattttgctggcataggaatgcaatccaggctacagtgggagttagtattcaggtggttgcaactggcctgggttttttcccatgccctgcagaatacactgcctcactgctggattctttcaccccctgcctgtgccactcttcataagcagtgcccagtggaacctcacaaatgtatttgccatcttactaacacagctactgtcagtaatgtgataattaatgatgatctaaatattataagcattctatattatttcaatgtcgacctcaaattaccagcatctcttccctttttattggtgaataatcaaaatcatggaaagactagtccatgattctgcagttataaatggcagagctgggactcgaacactgatccagtctggctccaaaagtaaccattgagaagccttagatccacaagaatagaagcagctggcagtagatgcgacattttgtgagagtggcacttctgccaaataacatggttatactttacttattccataaataagaaataggtagagcaaaaacgatagtaaagcaaatcacatttgcatgacactctagtgttgccaaagtctattctgtacataattgaattcagtcttcataacaactgcttgagatacatattattaacacttcttcaaatcttgggaagttaaatgacttacccacatcatccacctagataggaatataaggaaatatgaacaaataatgtttttactttactgctggttttttttgtagaatggctttggaaatagatatgtgctcaaatatcagtttttctaattactgatttggaacagtttactacttctttgaacctcaatttgccaactacaaagctgaaattaaacatgtaccttaagattacatataaacattatgtaaaactcatctaatatatatctgacacatagggggacttaagaaatggtagacaaatccagctgtgcttcataatttcaatggtttcctagatgttgtttatcataataattgacaaagccttagaaaaacataaatatccaatcctcagcccagaaaatcaatttacaaggtttgctgagggcccaagaatccatgtcttaaaatacaaacaataaaagaaaacacaaagaaaccaacccaccaacaaacaaaagaatgactcacaaatcttgattggtgagtttaagaacttgagctcaagataaagttaatttattcttattatttgggctaatattaaaaaaaataaattgacagctgataggagcatgtcctaaatgttcaagtacagagaattaaaataacacattttgattcactatcttcatgtagtgatcaggtatctatgctaacttaaaatatcagactgtctaaactaatattagtctacactaaggatccatgcttagcacttctgaataatatgagaagatattcctctcttcacttaagagctttatcagttactttggccaccataacaaattactgaaaattctgcttaacagttccttcctgaatgttctattttctctcacatttgtactctgaacagaaagaagatatcagtatgcaccttcaaattttgcttggtactctcctcagctaaatatccgatttcatcattggcaagttctgctattttcacatgactataggacacagttaagccaagctcactgccactatgtaacacggatattttcttccatttctcaatcatgtgctctatatttccttctaagcctgcaccagaagtcttacaatgctcatatttttgccaacattctgctcaagatagcatacatattttcaaagtgattgatagaagctttctttctttctttctttttttctgaaatagagtcttgctctgtacccaggcgggaatgccatggcgcaatttgataggagctttctctactgtgccgctcactccttctgagccctcaccaacagcatccttgatattcatattgctaccaacagtgacttagggcattctaggctttttctatgatgcttcacagaattcttccggcctctacctattacgaattccttggtgtattaggccatttttgtgttgctacaaagaaatccacctggctggcacctgtaatcccagcactctgggaggccggggtgggtggatcacttgaggtcaggagtcaagaccagcctggccaacatggtgaaatccagtctgtactgaaaatacaaaaattagcgggcatcgttgcgggtgcctgtaatcccagctacttgggaggctgaggcagggagaatccttgaaccctggaggtggaggttgtagtgtgcagtgagctgagatcgcactgctgtactcagcctgggtgacagagtgagacttcatctaaaagaaagaaagaaagaaagaaatacctagactagctaatttgtaaagaaaagaggtttaattggctcacggttctgcaggctgtacggaagcatggctctgccatctgctcagctcttggtgaggcctcagggagcttttacccaggcagaagacgaagtgggagcaggcatgttacatgacagagcaagcaagagacagtaagtgaggtctctgacacttttaaccaaccaaatcttatatgaactgagggagaacacacattcaccaaggggatggcactaagtcatccattatagatctgcctccgtgatccagtacctccaccaagtctcacctccaacattggaggtcacatttcaacatgagatttgaaggggacaacatccaaaccatatcacttggctattccttggatgatacttctgtatttttgggtactgttatagcagcacctcactccttgataccaaaatttatattagtttcttctgactgcctgacaaattaccacaaacttggtaacatattctgtcacatttctggggtccagaattctaaaccaagatgtcagtaggacctcagtccctccatatgttgtaggggacattctgttcctgcctctttcagcttctgctggcagtctttgacttgttgaatcactcaaatctctctcttgtcttcacatcactttctcctctgtgtctctctgggtgaaacctctgcctggctctctttataaggatacatgtgatttagggcatttggggcttatctgggtaattcagggtaaattctcctctcaagatccttcatcacatctcttgcttcagaaggtaatattcactgtttttcaggtgaggtaataatcacaggttctgagaattaggaagtaaatatatttttggagaacatgtcttttagcctgacacaagggcttaatgagttaaggcaagaaataggctgggtgagtagctcatgcctgtaatgccagtgctttgggaggccaaggtgggtggatcatctgaggtaggagttcgagaccagcctgacgaacatggagaaaccccatctctactaaaaaatacaaaaattgaggtctgttccaagatggccaaataggaacagctccgatctgcagctcccagctgattgacacagaagacgggttatttctgcatttccaactgaggtacctggttcatctcttgagagtggttggacagtgggtgcagcccacagagggtgagccaaagcaggttggggctcacctcacccaggaagcgcaaaaggtctggggatttccctttcttagccaagggaagcgtgacagattgcacctgaaaaaatgggacacttctgcccaaatactgtgcttttcccacgtctcagcaactggcagacccagagattctttcctgtgcctggcttggcaggtcccacaccatggaaccttgctcactgctagcacagcagtctgagatcaaactgggaggcggcagctggctcggggagggacgtccaccattgctgaggcttgagtaggtaaacaaagcagctcaactgggtggagcccaccgcagctcagcaaggcctactgcctctgtagactccacctctggagtagggcatagctgaacaaaaggcagcagacaacttctgcagatttaaatgtccctgctgaccgctctgaaaagagcagtggttctcccagcacggcgtttgagctctgagaatggcagactgcctcctcaagtgggtccctgacccctgtgtagcctaactgggagacacctccagtaggggctgacagacacctcatataggcgggtgcccctctgggacgaagcttcaggcgaggaaggatcaggcagcaatatttgctgttctgcagcctccactggtgatacccaggtaacagggtctggagtggacctccagcaaactccaacagatctgcagctgagggtcctgatgttagaaggaaaactaacaaacagaaaggaatagcatcaacatcaacaaaaaggacattacatcaaaaccccatctgtaggtcaccagcatcaaagaccaaaggtagataaaaccacaagatggggagaaaccagggcagaaaagctgaaaatcctaaaaaccagagcacctcttccctccaaaggattgcagctcctagccagcgatggaacaaagctggatggagaatgacttgacaaattgatagaagtaggcttcagaaggtcggtaataacaaacttctctgagctaaagagcatgtttaaacccatcaaaaggaagctaaaaaccttgaaaaaacactagacgaatgctaactagaataaacagtgtagagaagacctgaaatggcctgatggagctgaaaaccatgcaagagaacttcgtgatgcatgcacaagcttcaatagccgatttaatcaagtggaagaagggtatcagtgattgaagatcaaattaatgaaatggggtgagaagacaagtttagaggaaaagaggaaaaagaaatgaacaaagcctccaagaaatatgggactatgtgaaaagaccaatctatgtttgattagtgtacctgaaagtgatggggagaatggaaccaagttggaaaaacacttcaggatattatccaggagaatgtccccaacctagccaacattcaaattcaggaatacagagaacaccacaaagatactccatgagaagagcaactccaagacacataattttagattcaccaaagttgaaatgaagggaaaaatgttaaggacagccagatagaaaggttgcttacccacaaagggaagccgatcagactaatggtggatctctcggcagaaactctacagccagacgagagtgagggccaaaattcaacattcttaaagaaaagaactttcaacccagatttcatatccagccaaactaagcttcatgagtgaaggaaaaataaaatcctttatagaaagcaaatgctgagagattttgtcaccaccaggcctgccttacaagagctcctgaaggagcactaaacatggaaagaaacaactggtaccagccactgcaaaaacagaccaaattgtaagaccatcgatgctatgaagaaactgcatcaattaatgggcaaactaaccagctaacatataatgaaaggatcaaattcaaacataacaatatcaatcttaaatgtaaatgggctaaagccctaattaaaagacacagtctggcaaattggataaacagtcaagacgcatcagtgtgtgtattcaggagacccatctcatgtgcagagacacacataggctcaaaataaagggatgaggaggatctaccaggcaaatggaaagcaaaaaaagaacaggggttgcaatcttagtcttgataaaacagacttcaaaccaacaaagatcaaaagagacaaagaaggccattacataaggtaaagggatcagttgaacaagaagagctaactatcctaaatatatatgcacccaataaggagcacccagattcataaagcaaatccttagagatctacaaagagacttagactccccacaataataatgggagactttaatgccccactgtcaatattagacagatcaatgagacgaaggttaacagggatatccaggacttgaactcagctctgcaccaagcagacctaatagcatctacagaactctccaccccaaatcaacaatatatattcttcttagcaccacatcgccttattctaaaattgatcacataattggaagtaaagcattcctcagcaaatgtaaaatacagaaatcacaacaaactgtctctcagaacacagtgcaatcaaattagaactcaggattagaaatttactcaaaactgcacaactacatggagactgaacaacctgctcctgaatgacactgagtaaataacgaaatgaaggcagaaataaagatgttctttgaaaccaacgagaacaagacacaacataccagaatctctgggacacatttaaagcagtgtgtagagggaaattttagcactaaatgcccacaaaagaaagcaggaaagatctaaaattgacaccctaacatcaaaattaaaagaactagacaagcaagagcttacacattcaaaagctagcagaaggcaagaataactaagatcagagcagaactgaaggagatagagacacaaaaaacccttcaaaaaatagtgaatccaggagctagttttttgaaaagatcaacaaaattgatagaccgctaacaagctaataagaaaagagagaagaatcaaatagatgcaataaaaaatgataaaggggatatctcactgatcccacagaaatacaaactaccatcagagaatactataaacacctctatgcaataaactagaaaatctagaagaaatggataaattcctggacacatataccctcccaagataaaccaggaagaagttaaatccctgaatagaccaataacaggctctgaaattgaggcataattaataacctaccagtcaaaaaaagtccaggaccagatggattcacagccgaattcaccagaggtacaaagagaagctggtaccattccttctgaaactattccaatcaatacaaaagcaggaatcctccctaactcattttatgaggccagcatcatcctgataccaaaacctgcagaaacacaacaacaaaaaaagagaattttagaccaatatccctgatgaacatcaattgaaaatcctcaataaaatactggcaaattgaatccagaggcacatcaaaaagcttatcaccatgatcaagttggtttcatccctgggatgaaaggctagttcaacatacacaaatcataaatgtaatccgtcacataaacagaaccaatgacaaaaaccacatgattatctgaataatgcagaaaaggcctttgacaaaattcaacagcccttcatgctaaaaactctcaataaataggctttgatggaacatatctcaaaataataagagctatttatgacaaacccacagctaatatcatactgaatgggcaaaaactggaatcattccctttgaaaactggcacaagacagttgcccctctcaccactcctattcaacatagtgttgaaatggccagggcaatctggcagagaaagaaataaagggtattcaattaggaaaagaagaagtcaaattgtccctgtttgcgatgacatgattgtatatttaaaaaactccattgtttcagcccaaaatctccttaagctaccagcaaattcagcaaagtctcaggatacaaaatcaatgtgcagaaatcacaagcattctatacacgaatagcagacaaacagaaagccaaatcattagtgaactccgattcacaatgccacaatgagaataaaatacctaggaatccaacttacaagggatgtggaggacctcttaaggagaaatacaaaccactgctcaatgaaataggacacaaacaaatcgaagaatattcatgctcatggataggaagaatcaatatagtgaaaatggccatactgcccatagtaattttagattcagtgccatccctatcaagctaccaatgactttcttcacagaattggaaaaaatcctttaaagttcatatggaaccaaaaaaagagcctgcattgccaagacaatcccaagcaaaagaacaaagctggcggcatcacgctacctgacttcaaactatactacaaggccgcataaccaaaacagcatggtactggtaccaaaacagatatatggacgaatggaacagaacaaggcctcagaaataacaccacacatctacaaccatctgatcttcgacaaacctgacaaaacaagaaatggagaaaggaccctatttaataaatggtgctgggaaaactggctagccattgtagaaagctgaaactggatcccttccttacactttatacaaaaattaattcaagatgattaaagacttaaacgttagacctaaaaccgtaaaaaccctagaagtaaatctaggcaaaccattcaggacataggcatgggcaaggacttaatgactaaaacaccaaaagcaatggcacaaaagccaaaacagacaaatgggatctaattaaactaaagagcttctgcatggcaaagaaactaccatcagagtgaacaggcagcctacagaatgggagaaaatttttgcaatctaccatctgacaaagggctaatatccagaatctacaaagaactcaaacaaatgtacaagaaaaaaacaaacaaccccatcaaaaagtgggcaaagaatatcaacagacgcttctcaaaagagacatttatgcagccaacagacacatgaagaaatactcatcatcactggtcatcagagaatgcaaatcaaaaccacaagagataccatctcacaccagttagaatggtgatcattaaaagtcaggaaacaacagatgctggagaggatgtggagaaataggaaggcttttacactgtggtgggactgtaaactagttcaaccattgtggaagacagtctggcgattcctcagggactagaactagaaataccattcccatagaaataccagtgatcccattactgggtatataccaaaggattataaatcctgctactataaagacacatgtacacgtttgtttattgcggcatattaatgattgtaaagacttggaaccaacctaaatgtccatcaatgatagaatggattagaaaacatggcacatatacaccatggaatactatgcagccctaaatgatgagttcatgcctttgtaggtacatggatgaagctgaaaaccatcattctcagcaaactatcacaaggaagaaaaccaaacaccacatgttttcactcataggtgggaattgaacaatgagaacacttgacacaaggtggggaacatcacacactggggccttttagggggtggggggctggaggaggatagcattaggagaaatacctaatgtaaatgacgagttgatgggtgcagcaaaccaactggcacatgtatacctatgtatcaaacctgcacattgggcaggtttaaagtatattattacatttattaaagtataataaaaaaaatacaaaaaattaccctggcatggtggcgggtattgtaatcccagctacctggaaggctgaggtaggagaattgcttgaaccccagaggcggggttgcggtgagctgagattgtgccattgcactccagcctgggcaacaagagcaaaaattgtctcaaaaaaaaaaaaaaaaaaaaaaaaaaaagcaagaaatatgctgttttcaaataaaaatttaaaatggcttccctatccctcaacaaaatgtaggtttattttgaatttacagattgttagtcatgctgtttttttttccctaaatttgaagcttcttttaagtttgaggaattgcacattgaagtccacgaaagtgttaattggtgataccaaattatgaactatcatatgaaactctattttagaaaataaagataattagaaaaaaagaagaaagaatataaattgaggatttccaagaagtactaaaaaattggtctatttggttgcataattaccaacaattccacaattagaggacaattttggaactggacaaactttagactctgaaatgtttttcataagcaaaaaagggaacatctccaaaataagattctaattctcagaatctcttgtgatgaccttaaagaccagagtgatgagactaaagtttcccaacgagagaattggtggggctagagccaatgaactgcaaagtaaaaggtaaatgaacaatgagacaccatctcataccagttagatggcagttattaaaaagtaaaaaaacaacagatgctgtcaaggctgtggagaaaagagatgcttatacacttccatactgtcggtaggaatgtagttcctaccaattagtttagccacgtagaaggcagtttggaggtatctcaaagaacttaacacagaactaccatttgagcaagaatccaattactaggtatatatccaaatgaaaataagtcattctaccaaaacaattcagactattcacaatagcaaagacatgtaatcaacctaggtgcccctcaatggtggattggaaaagaaaatgtgatacatatatatcatggaatcctatgaagccataaaaaataacaaaacatttccttagcagcaacatgaatgcagctggaggacattatccttagcaaattaacacggaccagaaaaccaaatatcacgtgttctcacttataggtgggagctaagcattgggtatcatagacataaagatggcaatgatagacactggggactactagagagggtaaggaaggggggtaacagttgaaaaactaactgttgagtactatgctcagtacctgggtgacagaatatttgtgtcctaaacctcagcagcatgcaatataccctgtaacaaacctgtacatgtactcctgaatctaaaatgttgaaattatttaaaaaaggagtaaaaggtaaatgagggaaagatagtattttgtggacaattttgggagaaaacctagaaaagaaagaaataggagggtagtaggtgggataccaggaaaatttgtcatccctgttctcccttcctctgttgagtagacaggacagaatcatatttatgagcatcagagtaggtacagatagagctgagagttgaaaaaaaatcagtaattgataggattatcaatgaagcaaggtctctttatattaacccaccttaaatggcagttgatgcaattaacaagtctagtttcctttggccactctctattttttaatttttgtcccatgagacactacaccctcctagttttcacccatcattcactggcttttcacttcagtttccttcttagctttcctttcctcttaagaaacacaagattctcagagctggtctggggctttgttttcttctatgtgtgatatgattgtatgagcccatcatgctcacagtttaagtgtgataatatcttcatagtttatatacaggtcagatttcccatctgaattgcgacttaacttatatccaaacaatttctgaacatcttctctgcatgtctcacaggcatctactcataatgtgtctgaaacagaaaccttgacttcaccccactcaacccaaccagctccctgcatttccctcataatggcatcgccacccaccttgctgcagaaatatggattctcattagacttcaccctcttcctgaccataaatacaatcaatccatcaacttctattctgtgtttgccaacagatatctcagctataacatctttatacctccacagttgcctcccctagctttgagcatccactctctttctccaggattattgctggagtctcctaaagggacactactccacagtttgtcagatcaacaccactcttctgtttaaaatcctcagtcaatttctatggacaaagtgaaaaggaaaaaaatccaaattctttagtgtataggacccctgctcaactttcaactgcctgtcattccactctcccctcacacactccaccttggccttctttcagttcctgaagaacactccagcttttgttatttgcttaacttctagcatttttgctacccttccctgtcttcgcagctggctgcttctattcctttagttcctatcttaaatattcccttcataagatgccgtctctgacaacgctttcacattttttttttttttgagacagagtctgggctgagtggagtggcgtgatcactgctcactgcaggctccgcctcccgggttcacgccattccctacttcagcctcctgagtagctgggactacaggcacctgccaccacgcctggctaattttgtgtatttttagtagagacggggtttcaccatattagccaggatggtctcgatctctgaccttgtgatccacccgcctcagcctcccaaagtgctgggtttacaggcgtgagccatgcacctggcctaccctctcaaaattaactattcttttattattctctattattgtgttctgtcacagcattcatctatcaatcttatttccttatcttctgcatccaaaattttctggggtaggacaaatctgccttgcttactacagtaccacaagcttccagcacagttacacataaatatttgataaatatgtattgaatgcatgaatgaatggatggagatgagatggaactaaagcttaaatagtggaagaaatatttccctttgagatagaaagtacaaaaaggtggtacgtatacaaatatatttatgcacatgggatgagaagttgaaaatattcatagctcatatggaggaagggttatctgttaatgtaataggctaggggcttgaggagaatggagaatatttggacagatactatgggcaatgggagagaatgctggccagctagctaggatttcagagggcagtgagcactttcctgaaactggagatgccaaaattttatgaaatttcaatatatgtttgctccaccagtgcctgccagcctgcgtgtaagaagagataaagcaaattgctggataatatgagtctaagggatatcagagcacatgaggtagaaagagaatgggtagtgaggttgaggggactggtgtaaggtggttgaatgttccggcatgggctctgggtcagggaaagagaagtaaagctaaggggagtttaatagcctgagtgaaagggagggtacagaagaaaacagtacagcctatgacttcctcatctctaactttataatataaattaatgagaaattcacattcacagttacattttttttaatggtatttggtgctgaaaaaaaaatcaaatcagttctgaaagaaaggatcaattacacaaattcggcataaaccaacaagcccggctgtgaagtcctagagttgctttatggttaaaatttggttggtctgagaaacatccagtgacaaaaggaatgtatcaggaggagttaactaagcaggctcatgcaaatgactcttcctatattttaaattgtagagtttttgtcctttttagaaggaagttctaaaaagtgctagacagtctaaaattgaggtaagaaaaattctcagaaatttgagagatttggggaagacacctctaatcaccaaaatctaatcctctattcccccgattatgtcatggtgccttaatttcactattagtaccctcatgggcagatcatgagagattccactagatgctaatatcccagcaaataagtagtaccctgccaattgttgacaaatatatatcttagatgtgtttaaagaattacaatgaagaaatctgtggaagattatatggtacagatcatattagtgcctggtaaaagcaatattacaggagggaaagagggacccaaaagagatgcctgagatttccaatacaaagtttcagggtgtgcttgatttggggtgactgacatgtcaaggcactctgacatttacagagacctgttctcctcattactaaacagattaaacatgtttccgggtatctagcaaaactagtgtgcttgttttttcaaaggaacagtgggaaacccccgcaaagctttcagcattttaaactcttactctagctttcatactggaagaaaggttacttgctaatgtaatagggtaggggcttgaggagaatgagaatattctgggcagacactatgtcatctagttggcataggttgtaaaaaccatttcagttatcctacaccaacctaattcaagcaagtttcctttatttcagtttttccttaattctgcctatatcatgggaggagaaattgctgctaaagtctaatttgaatgccagatattttaggtttgtaacttttttgaggctaagaaatcacatttatattctatatgcctatttatatacaaattaggtatttagagtctactggtcccatgctatacttaaaaaattaatccaactctttgtcttgggggggaatctaggcttagattactgcagccaatccaagttctaaaacaaatggggcctctaatgtggggagtttcactatcctgcacttagctgacatactactgggtggacagaaagactctggacttgagaaagatgacaagagactaagtttttagttcatctagcatttattggccctatggccatgggcaagtcagttaggcccctagaaccttagttcctcacttttaggatgaagattacaatgccttcatcacagaacagtggtgaagatttgagagataatggatgtaaaaatattttgtgagcttcatgctgaaaaactcatgtgagaaccacgattacccataatgcaaatacacacattttgagggagcacactgcctttttctgaagagtcctttaatctgaatctatcaagtgctcaaccatttatcgagagacccagaaagtgagcgtcccaccctcctggcttctgtgtgctgaatgctgagccactaacctgatttgaatgagcctatcaaatagagaaggttttaaatcataagattgagggaatgataacattctctctttctatgaatttttcattttattccgagacagtcaagatgtactatgtgggtcaagtccagccttcacaggtttgaacagaaggtcaaggagaatattttcttaacttctatttgcattcaactactgccttcatgtgagccttcaggggccttcactccccaagcactgatgtctaggaacatcaggaggagaattgagcacacagctgaagagctctgcctgggattttattctttctcccagaccttagaattgttggggctgctttccctctcactgataagaaggtacatgatataaaaactgtattttcatgttttgttctttctagggtagactatccatgacattagtcaaaatcacctggctactgattcagaaaatttaagtcacactcatcacttctactcaaagttcttagccagctgcggctgtggttgccatggtaaatgtaaagtcatcaaagtgaaggactcaggcttagaaatataagccaccagcataaacattcaccacttcaacaatagttgttttgagcaggaagctgtcacagtgaaattgggacggcagggagaagaggaggaggtgtgtgatgtggcagaaatagtactaggtggggatgttctgtctttcctgctgtgtatgacttgggcaagtcatttttctcctggaacattgtctgtaacataaaggactagattagaaactttcaaatcttcacctagtattaacattctgtggttttctatgcaactttagcatttcctgtaagtgctttcctttgggtcataagtcccctgagaaaaggcaaattaaattgttattctatggtcttaaatcatttaacggtttcccactggcccttggaagaacctgaaggtctgagtgatctggactctacttacttctgtggcctcatttacgtcctcattgctctcctgaacccatgtcagatttccctcgatttctcaatggatcatcctttttactgctttctccattctctgactctctactctttcaggttgcagctcaaacatttttgttctctcccaggacggtttagctttttatctcctttttcccaacagtcccctgtgtttcggcatcacattttgtgtatacgccttgaagtcaatgaccatgctctgatgccatactttgcagtagcagcccaagagatttgttcactgcagggctgtggttatggccaagttttaaagaatcacctttgctagtgctatataggaaatgctttcctataatttttttctctgatgaggtacatgtcatgcaacttaattcccatcatgcatctcttacccatgtataaggaagagaggtgttttaattttgccaatgtcatatgactataaggaaacaaaggaaggaaaagctgtcacctgtggaaagacactagaattaaaaattgggaaattttcttttgaatcccaaatttgctattagtttgcgggacaatggataaatcatttattcttttacagtctcactcttctcaactgtaaaacattgaaagttaatatctcatagggttgctgtgaggattgcttagatacaaacacacacacaacacacacacataagtctacatgcatacatatatgcatacacacacatcactgactgaacaaaactaagcattttctttgtgtgtgaagctgagcaatggagggattcccctttagcaagggccttggcaagctaaggagacttgcaggtgatgatggtcactacgtggggagagttctggaggtggagagggaaccagactggtgcagtggaattattactgagtgaggaagagtagaaaactagaggttgggtcccaacattggcacttgtgagctgtgaggccttgggcaaatactttaccatttgctcttttttcccccctcatctgttaataaagagaggtaacactttctaatctggcatggccacaaggatcagatgaaataatatgcctgaaggatgaaaggcctaactgcctggcatggcgcaccgctcctgattgataggcaatgagcaaatatcacgtgcatgaaatgaactgccactgtctgaaatatctgctattatctgaaacctcagcttcctctgctcagtttttctataggtaaagctgggatgatgatagtatctaccttgaggaattgtttaaggattaaatgagaaggcaagttgtgaagcctttgtaaacactgtttcctcatattgcgcttctcacacatgtccatattatcaacattttagaagcaacgccagttgaggaggtactgagtttggtataatatagctgtttttccaggagactctaaaaagctcctttcatttcgaagcaaacagcaaaatacagcttctaaacattgctattttccctgaattttctgaacctgagcaaaaaagttgtttctctcttgagaggctctgttctgattggatcagccagaaaagccaataggaagttattttcagggccaagagtaccagggcaatattacagcaaaagtttgtatattatgctgatggttaaactgggccttgtgttccgtatatgaaaaagtatacttcttcaaattcctgcatatactaactactctctcccaggagtgtttctagggctttcacagttttaggaggaaaagtcaggaattcactttaacatttctgttttctattaattaggcacttttagctgttttctttttagaaagaaactagtagcagaatttgaactagtagcagaatttgctttccattcttctcctctaatctttgttgtctttgttattccctttgttataaggaagtgggataaataaaagtattcaaaggcccagttcattgtcctttggccatatttcacctcattatgttacagcctagtctgaacccttttaacaagttttcctttttatgtcctgcttcctacatgacttttgagtgaaaaagagtactgtgctctaacacacaaacacaaatgctacaaatgcatgcacgtgcacacacaaatgaacacatacacactattcaaaaggcaccacgcattgcttacccatagaggtgaaagcaggaagtaaatccttttgaattcatctcatgagtttttttttccctgcctccaattggtttctcaaggagatctcatagcttctccaatcattttaattaatgttctccaatcactattagtcacaaaatcacgttcatttcatcaattagatttgtgtcccatgtaaaaattaaaaatttaaatttaatttaactttaaagtttcttttttctctcagcctgataaacttttagaagctcaaagtttgggaggatacctgatcacttattttctctcttctgtctcctccccctcctcctcttcctcctccagtaactcattcgtttagtttttgaccctactaggatcaaaattaaggttccagaaagtttttctttcccctcataatttagattggtttgtggcaaatgcatggtgctatcttttgcttttcaaatgtgccaaaaaaaacctttctttagctgtgtaggaaggaatcaaattattggttgacagtcctggcctgggctaagagaataaagaccattttaattgctttattgaggggcttgccagagtttttagggaaagcaaagcattaaattaagcagttgagtaacgttatgaggacacagcagtggagacaagcacgccagaattcttattgtactttaaaaactaaatgctggcagcaaaaattctttgagtcatttttctctaaattcagattcaggaagtgcactcttaaaataagttcattttggagttccatcttaactatagcttcaggccaaaagacagacttctccaagtagaacgccctgcataggatcacattttagcaaaacctgtgtgtacgtgtgtgtgtgtgtgtgtggtgtgtgtgtatgtgtgttgattgttgctgacagaaacaaacttcaatcattaggagcagaactgaaaggattagcttttaattaaaaaaagattaaatatggaactttaactgtcaaaaagcattttatttcaagcaaattttataggcaaaatttctaggcaacaatgaagttgtttttacatactgacgtaaaacattcttgtaaataaaataggctttcctctcttgaaagcaaaacattaaaattaagaaccaaaacaataacaaaaatataaaataagggataaacacaattaatgaatagattatagtgttaaacagaatgtatttgccttaaatcagattttaatacttctatatattcataatgaaaaattaagaagtcattattaatttataaacagacttgcgcaggtttcatttgaattgctaccttttgattatttttaaagtagtatcaattttcaaaatcatttcagagaaacaaattgtaaattcatactgtgtaaacctgttgcttctgaatgtcagcactgtgatcagtgctaaaggagtacaaaataaagctaaagacaaagtttccttcaaagcttataatttcactaggaaggaaaaacagacgttcaaggattcagttaatgaagaaacagaataaacagtgtttcagtaactaggatgcctgtgtacactaagagtaattgcaattagaggtcacagctacctcatggtccaggtggaaggaagccacagttggattctgagcacattgaattagaatgtgtgcaagagaatggtgaggatggagggaggctgtgggaagggacagtgaatgaaaacctcagtggatggttacaactgtaaagggtggagaagagcaaagagttagcttttcttatgctaagggcccagcttggagaaaatgtcatgtgcagggtgctattctataccacaaaggggagaaacatgggcagacagaaaaggacagtgtgagtaaccctgaaacagaaaggagttcttgtgctttagaaaagaggtgtgggccggatgcggtggctcacgctgcaatcccagcattttgggaggccaaggcgggcagatcatgaggtcaggagatcgagccatcctggctaacacggtgaaaccccgtctctactaaaaatacaaaaaattagctgggatggtggcgggtgcctgtagtcccagctactcgggaggctgaggcaggagaatggtgtgaccccggaggcggagtttgcagtgagccgagatcgcaccactgcgctcagcctgggtgaagagcgagactccatctcaaaaaaaaaaaaaaaaaaaaaaaaaaagagttgtgaaattgatcttaacattttagcaatggtcctttgggactccagagaaaacggagtgaaaaagcagtttggaaaagagaatctgattttagaactagagtaagagaagttgtcctggaaatccctcctgtctcctctacctttttattgttgttgttgttgttgttgttgttgttttctgagacaggtcttattctgtcacccaggctagtggcacaatcttggttcactgcaacctcgaccgtcaggctcaagtgatcctcccacctcagcttcctgagtggctgagactacaggcatgcacaccacccttgggtaatttttaaatttttttgtaatgatgaggtctcactatattgcccggctgatctcaaactcctgggctcaagggatcctctaaccatgtcctcccaaagtgctggattacaggcttgagctaccatgcctgtcctctacttcttaatggtaacctcaccctagacatcagctcattcatctttaagatgatgttaactaccgactagttattatcttcactggtgaagttgaatttaaatgattataccaaatctgtgcgcttttttttttttttttttacttttttggttcattctgtatcaatgagcagttgtgatatgacagttatgtgtgaattcactataacagtggattttggggaaatgaataggccaaaaaggaagatattctccaaaactttaaaatttaaaggttgcagtaggatgctactccagctaattttaagctagccctcctgattcttacagttatttctctctctctttctttcacacacatgtactcattttcttattcattttataacaatttccccttatgctgacttcgaaaacttattatcttaaaaaatcttatgcatgcattcctgtaagcagctacctcaaacgctttttgagccaggctgaaaataaataagccaaatttaaaaaaacaaaaacaaaaaacactccaaatcttgccaaactgatgaataaatgttttttgattgtattttctttaacctttatctatatgaatacataatttacacaatttatagtcaaggtgtttgggtaaaagaacaaaaaatgatttatcctctttcaaagaaaggactacaaaaggactgaaaaatactttgggaggccccaggtccaggatccctggtggagacccctgagtggagcgtagcatccgccaggcagcttgagacacacctatatttagccaggtgggttatgtgataagagggaggaggcctggccacatgctctctgactcatcctctaagcacatgtgtcaatttttcctacagttgggacaacctccttcagaagacagagcctgctgtaactttcctgggctgcaatgcttaacttctacagaacaaagtatagaaactaagagcactgggagtccccgagctttcaatgagccacactagtgataacatcgttattacttgtttgagcacccccacccccgccacgcatgtgccttttctctggtttggaactggagctttgcttctgtgcagtgtctaattcctccccagactccctagcagcctgccaggtcaataaggcatgttaaaatgaaactgctttaacggctacttcatttccttgcactttgtgttcaagctggcatgtgtaatcctgtgatacacaggactttagattagagctgggccaacacaattttaggatcctttttgaggggagattggcaagagatggaagagagtgcagaataattttagcatgaattttaatcatttctctacaatgactagctttgtgaccacaggcaatctagctcccagggcctcagtttcctcatctttgagtatgtctgcattctcctcaagactgtgatatcaccagggtgagaagcgtgaatggcacagtgcttggtataagcagtgcatggctgatgctgtttgctgatggctaagagatggaaaacgacctggttgtagccgacatcacaatgagagactcttctttctaatgtggataaagcttctcctgtatctgccttcctcctagtaacctgactaaaatgtaatgctgactacctagatcacaaagaagaattttctacagaagccaacaaggccattgtttacatgccacatgtgctaagtctcaatcttgacattccccaatccacttcctggcaaatattgtttgacttagggaactgagttaacagatattgaacatacggtgttgagtaccttcacttatcagtgggccaagaaaaaaaatgccaggaacccaattatattgaatcagattaaatatctatgttttgatccacatctggtgatatagttataggaattaactttttgaaggactggttactgaaggcccattgggcagctttagaactgcattacctgagaaagtgttgtaacttctgagcgccctcgccagcttgttaatttgaaccataatgacgcctcctcctttgcagggctcatatggagttcatctatgtgtatgcaggctctttgtaatagtgaatgtctacaaatataagtgattattattatgctttttatacctcctgtaggtgttgctggtcatggactgattgactttttccaacattatgattcctatgtaactgatctctgaaatatctaccatctccacctataaaggagattaaattttagggagtaaagtcactttcttgctatcctgcttatcattacttatgattaggcagaattctgctggttaagatatgttccagggaggcctagaagagtccttctgtgtgcttctttcccaaatatattcctgacaacttgctaataatgaaaagttccaaaattgggaattcacttcattgtcactattctaatgaattacactttaagctctaccatttatatacacgttattatgaactgagttcatctaacattttaataggttttcaacagagggaagaaaattgaacatgagctaatggtagggaccaagtctcagagaacaagaactctgcaactgctaataagagaatttttgtctctgtagctgtgaaatatttgaatgatatccaatgattaatgtttctttaattctctaggtgaccaaaatcacacagaattatctagcaataaatcctctttacataacagccaaagcacttggggtgaggaaagagaagagaaataggtcttacccagcaggtctggtgtcttcaatggctctatcactgggatcaaatcgctaaggtagacattgaagtttccttctttccatcttctttctgctccttctcctttccatgggggacaactacaggacgcccaaactgccctggagctttgggtcccttggagaaagtgtcacatcaattcttaacacctggtgcgttccactgtcttcagtaaaagggcttttatatgactctggttgtattctgtagagggggctttggcagttatgtgatttttgctggctctagccctccagttaaagcatggttagtttgggacagtggcactcatgtggagcaagtgaagaggaagacatctcacttctattcctggaaatgtgtttactttgcttttacccaatactttaggaaatattgttttggttttagaattagagacctctttgggtctgccttttgctcttcctctttggttataatcacaagatggctttcagagaaattgatttcttcccatgagcccctctagctccatcatcctttgacaaacttcccaaaggtgtctattaatagattgcttccttaagcgatttgaattgacagtgaacttaggaaaaggaagaccgtattggctttgtgtttatttgcattgacttctttgctctgagtcttagttttgtttaggccatggcttccccagacttcggcactgctgtgctggcagggtgtgccctctcgtttgtactgcctgtgatcgctgctttggtctatcagtactaagactgatggtcacattcaagtcctttcagctgctagttttgatgtgtcactgctgggactatgactcttccggggctcctttttaaactgacacgtcccatgtgtactgatattttgactacctgagttccttttgctgtatgaatgaggtctttggagccccctgagctgtcgtttgctttggtgtcccctggtgagggaggcttcaggtttggtgcctctcccgtctgtcttctgcttgttaggagtcacagggaggtctgcagatgtgcaggatgccacaacggcacaaccttgccccttcccagggcattctcatttttctttccctctgggtttggtccaagtccacctcaaccttgagcacactctcctagtttttctaacattctctttgccccatgcccctttcccatgtccccttaggggaggttcatctcttttatgctgctgtaaaaaatttttccttggtctggctgaactctgaatcctaccgctccctcctcacaatgtcttccttgatgacccgagtgttgatctcactgaatgagagcggagagctgccatgtcaaagaggagccagatgacagaagctacaaagataaatgccagactcgcccacttcctcggaaaaactttcggatcctgttcatggtacaaagctttccctgcagcctgccctcccttagcctgcttaccttgagtggagaggaagctgaagtagcagcacagcagcagcagcagcagagttgccagaaagtgaccccctcccctgaacacagcaggaacagcagtccaaggggaaagctcagttcctaccgcttgtcagtctctgcctgcgtggcattcatagcagagcatctgtgcctgcttggctggccctggctaagttctgataaacactggcttaggtcactccaggagcagttgattccagccaccgaacagttcaacatatcacttgtttgtctccgggagcccatgtccaccttcctacaagcccaagaaaaggtgggggccagatgagactgccgtttctctcctccccgttctccgtctgcacgctgtaactcaacaccactttcataaggaaaacatttcatgccattacccagaaaacttcattcagctctcaccttctggttatgtgagagcatgtgtgtttaaacggcaattaaagaggaaaaaaagctatctaactggagggcatgtgttcctggtttgtgaccccacctaccctactcctgctcattaaccctgtgtagccaggtgccaatgctctgcctgaggaatttatcactgaagttaacatttcagcttaagacataacagcttaaagaaggggcctggtatatcctcacttccagagatgtatatgttaattatttagatcattcattcaaggggtttcaatgtatttctttgtaagccaactattttttttcactaatccatctgtttttattattacatttgattacaaataaacttaattttcatactgctataaaagtttctaaacactttgttatggtctgaatgtttatgtccacccaaattcatatgttgaaacctaatcataaatgtgatagtattaggaggtagggcttttgaggtgatttcattataaggatagagccctcatgaatgggatcagcacccttaaaaaagagccctattgccttgccattccacaaagtgaagacataatgagaaggtgccatctatgaacaggaaatgggccttcaccagtcaacgaatctgctggtgccttgatttctgacttctcagctctagaactgtgagaaataagtttctgttgtttatgagtcacttagtctatgttattctctatagtagcctgaacagattaagatacacttactctcagtttcagtacttatctcgtttaaaccagcaagcaacagtttcaggaccacaccaggacttggaccagattttgagtgagctggttgactggtagggtagcagttccgccacaggcttttcattagaaccacttgaaaaagatccccaaaactctggtcaattgatgagagaggaggtggagatgacatttgggctgtattgtattaaatatatatatatatatatatatatatatatatatatatatatattttttttttttttttttttttacaaagcttcccaggtctttcaaatgtgcagctaaagttgagaacactggtctagaaaaaaagtctcaattttttgtttgtttgtttttggtttttgaacatgcctatgagacatttaattttaggtgtctacttgactgggctaaggaacacccagagaccagtaaagcattatttttaggtatatctgtgagggtgtttccagaagagattggcattgactcagtgcactgagtggggaggagatgccctcacccaatgtgggcaggcaccactaatggttgagggcccagatagaaaaaaaggcagaggaaaggtggattctgtctctgttagtagctgggacatctttcttcttctgcctttggactagaactttagattctctggctttggctctggggcttgtaccagtctgcccccacaacctccacatccctcactaggttctcaggttttgacctcagactgagagtgatgttattggcttccctggttctcaggcctttggactagaatgtgccatgttactggctttcctggttctccagcttgcaggtggcctggactgagtttctcagtctccataaccacatgagccaattcctgtaataaactgcaactcacttatcacctctatgaatcctattggttctgtttctctgaaaaatcctggccaatacagtctacacttgtgtgacattccttccctgtctaaagtacagtctaataaaatctatgcattcccatacaactaaatcagaatacacattttgacattgccagttgtaaagattgtccatagagttgagaagcacttctcgggaccactgtccttctctctgaggaactctgagtgatttgtggaaacactgctgttcattactctagtgtggggagggtctagcttccatgctttgaggtaaattatgttcccaatgacttgggaggggaaggagagattccaaattcatatatatatctcagcactttgctaagttctttccattgactatctcactcaatcctcacaagaatctaatgtaaggagtaaattacaatatgtattttgtagtcagcaaatgaaaccttagagaggtaaagaacttctggtagagattggaggggttgggtcttgaatacacgactgtagtccgtgtgctcaatatcacacaatactgctctctagctgtatgatcttgcaggctagttaattttatgtgttactgagcaataaaaaaaaattctgctttgcagattaatgtgagaatatttaaaaatgttaaagttattgttatattgaaggtactctttaaatgttagccattcatattgttgctatactttgctgtaataggagtgtcggatgcatgtgggaggcaatgtaccagctcttcccaaaaaacaagtagaaaactagtgactaacatgattctggcaatggggaagaaacaaatcgagtattttattttattcttgccattcttatttcctctaattatagatttaacaagaccttgttcactgagaactccctacatgcccaaaacatgaagtaggtgacattgtctctgccctaacaaccttaaaactcccctcagtagaacgccaccagtataataataataataataaaaaagaacgccaccagcaaaaaacatagcacacatctttagcatccacattcgaaaataagtgagaattttttttagcatcatggataaatggtttgcattacaatattgttttaaactgaaaatagaatactttaaaattattttactctgcatgattcaatcttgtccagccacctcccaccccaaatggcagttggaattactcaaatgtcttttaggaaagtcaacacttgtatattctatgcttggcagtttaaaacactgcttgaaatatattcttgtttccatataaatttatcaaagagtactgatttctttttatccctctctggtttgtccttgcgaatcaaaaacaaattacttgcaacaggagagcaacatgttaagaaaattaaaagggaatcttggctttctatcatgggtaaagcaacacattaactctggcttagtcttcggtctatttgacatacattcagaatgaaatgtgaagagtgggtaggagagtaaggaaacattgattaaatatcctgaaatggaggagtagatttgttgtcagacctggtctaaagtactgacttggccactaatgccatatgactatggatgtgtcacacatggaaaagcttgtgtaaggttctcttcccagctcttcttggtcttttcccttgtgagtttatgataatctgtgatgatggtagaagttggtataagccataccactaattcaacactatgtgtcttcaggcactcagtaataatttctgtgccctcatagctgtacatctttctccttttttttctcttttccgacacacatgctgtttacatctcagatcaatgaattgcataggtaaaaggaatagaaaaaaaaggatattaggaattctaccttttcatcaacacacatattgcccaacacatgacatttgtatattggtaaatacggtgcttctaaaattttagttgtattaatttccatgttaccagcaggaaactaaatagtaagtgggttggttatttgaggtaccccacagttagggagcctggcttgtcatcccaatcgtagaatgcaggtacctttggctggtcaaatttctcaagaatctgtacatacttagtggagatgatatccatctgaaaatctggagttacgaattatccttgggagacatttggagggttattccaattatcagtctgactccagcttgtactaaacatttaaaaacagattttatttcttcttctgtaaaacgagcataatagtaggaggacttgccctctactctatttggtgttgtcaggataatcatattaatagcaacctttcattgggaatttactgagggcctaccctagtcacttcacggtatctcatttaatcctcaacatttaattttctcagactagatcaaaactgttcagcaaaacagatctgcataaagttagagtgaaaagtatatttgtgttatatctcatggcaaatgtctttgaatcatcctcattgttaatcaagtaggagctcagtaaacctgttttatatctagccttaaatctccctgatggaagtacagaatcttagaaacaccggtccagctctctggctttgcatctacagttactttatctgggtatttgaagatttcttgatatgtgagtatatcctaagtaactaatatctgttttattttatgatatttactcaactatcactcctaagtaaaaagaaagatgtaaaaggaaaattaatttaaatgtatattttacaagaataatgattatccatggatgcatcactgaatttctttttccccagttttactgagcataattgactaataaaatgatacatatattaaatatttaaggtgtacaacatgactttgatagccttatacattgtggtatgattgcctcaatgcagctgatctccattatctcacatattatctttttttgtgtgtggtgagaacatttaagatctactctcttagcaagtttcaatatacaatatattattatcaactatggtcatcaggctgtacattagctctccagaacttctaatcctgcgtaactgaaactttgtattctttgaccaataccttccaactttctccatccccaacccgcagtaaccaccattctactctctacttctatgagttcaattttttagctccgcatatgaatgagatcatgcagtatttgtctttctatgcctggcttatttcacttaggtaacgtcctccaggttcatccacagtgttgcaaatgataggattttcttcttttttgagcaaaataacattcttgtgtgtgtgtgtgtgtgtgtgtgtgtgtgtgtgtgtgatatattgtatgtatgttgcactttctttattcattcatctgttgatggacacttaggtgaattcatatctaggctattatgcgtaatggtgcaacgaacatgagactgcagctatctcttcaagtgctgatttaatttcctctggatatatagccagaagtgtgattgctgggtcatatggtattctattttttagtttttttgaggaaactccacactgttttcgataatggttgtactatttacattcccaccatcagtgtacaagtgttcccctttctccatatccttaccaacactgttatcttatatctttttcatcatagccattccaaaatgtatgaggtgatatcttattgggttttgatttgcacttccttactgattagtgatgttaagcattttaaaaatatgcctgtggccatttgtatgtcttcttttgaaaaaggtctactcattttttttccctatttttaatccagttgctttcttgatattgagttgagctctttgtcaatcagtaggagcgcaataaaatggttatatatttgagatattaactccttattggatgtatggtttgcaaatatagtcttcatccataggttgtcttttcactctgttgattgttttcttggctgtgcagaaacttttagtttcctgcagtgtcatttgtctatttttgtttttgttatctgtgctttcggagttccaataatcaccactcagaccaatgtcaagatttttccctgtgtttactttcagtagttttcacttttaggtcttctgtttaggtctttaatcaacattgagttgattttaaaccacaaaaaattaagcaaacaagcctatttacaatagcataaaagtacttaggaataaatatttttaaccaaggagatgaaagcatttttaactaagaaggtgaaatctctgtgtactgaaaacttaaaatattgatgaaagaaatggaagacataaacaaatggaaatatatactgtgttcacgattgaaataattagtattcttaaaatgttcatacaaaccaaagtcatctataaattcataaaatgtctatcaaaattctggcgtttttcacagacatagaaaaaaaatcctaaaattgtatggaaccataaaagatatcgaatagtcaaaaaaatcttgagaaagaagaagctagagcatcatagtacctgacttcaaaaatatgctaccaagttatagcaatcaaaatagtatatactgtcttgagacaagcctgggcaacattatgagacccccatctctacaaaaaataaaaaattagcagggcatcgtggtgcacctctatggtcctagctacttgggaggcagaggtggaggatagcttgagctcaagaggtcgaggttgcagtgaaccgagtttgtactgctgttcccaggttgggtgacagagcaagactctgtgtcaataaaaagtatatgatactgccataaatcagccacatagaccaatggcacagaacagagagcccggaaataaatccacaagtttaaatcagttgttctttgacaaaacagccaagaatgcataaagtggaaaaggtagtttattaataaatggtgttggaaaaattggatatccacatggataattaatttcaactcattgcgcttcagacaatacaggatgaagatactaattagaaaatttaaatgggaaaaccaagtaatactaattactgtttttttcggattttaatgtgatttttttctttccaaattctctcttctcttttttagagaagagacaagttgtaatcaactggataataacatcctgtgaaacaatccataaaaggaaagaaaagttttaaaatcatatactaaaaggcaggcattattgcaattcaacaggtagagtaaaaatacaaatggaaatattattccattttaactaattcttccatgaagatgaatagttacaacttctggcagtcattaaacattggtgtatgtctctttttaataaaatttggaagctgactaacaaatgaccttatttcctaagaccaagagaatcagtaaccctttacacatttgttcttgaaaagggttgcctgtattagtgataaatcataattggtaagcctaagtttaaaaaaacaagaaccctattattgaaagacaatttattgtgtttagcctcagttttcattgatttttgagtagtgaggctaagccaacatttgtgctatactacttacaggtccctagccaatttttacttaaaaaatattttagtttaattaggaaaaatttataaatttaaaagcaaaacattaattgagtatcttccttggacaaagaactgtgctagtcttaaaatggagaaagtgagcaggttcctgaaggacatattgtcaatgagcccaaaactgcaactcataatcttaattaactgagttattagtattggttaattatagctttggggataaaagagaaaatagctcagggtggctctgtaagaacttcagtaacttaaacaggaatggtgggggaaaatgatagtttgagagaaaagaaaagttcaaatttaaatatgttgtatttgaataaatgaagattttgtaactaggtgcatatttaaaaaatatttatggagtaccgaccaatactagactaggccctgtgctaagctttgggaaaataaagaagccaaagcccataattagtgtagttgttttcatttatatgtgtgtccatcaaacatttcatgaggaagtgttgttaaatatagactctgacgttctcccctcagagatttcaaggttggttgtagggcctagcatctggattttaactggagtagataatgattctgatagagttggaccaccaaccatacatgaggctcacaggttcagcagcagaagcatattaatattaaaataagaaaactggaatagttatttggaggggtgtttggaaaggtgtcctgggggtgatgactgagtgtgaattcctctatgaatagggagagggtaatttaggaaaagcagtctatgcagaggtaaaagcaggctcaaacattgagggaggaaggcatgagaataatatgaatggataattaagatttgtttgatgtactagattttacagtagattggcaagcaacgaggtaaagattgttggctgagcttctttgtatttgttcaagattttggatttttactgttcaagggctagaagctttttaaagttgagtgtgatactctcagggttttggatagagagcgggtgggtgtatgaagaataaattgtagtaagcaagctgcaggctgggagaccaattaacataagtgctacatatttattgccctcttttgaacagtctaatcacacatggaataaaatctgaactttaattgtacatgttagctatttaagatatttttctagatcaagagggaagactggaagagggatcatttctactatagagtgggtcttcattaaagacacagtctcttaaagtgcacgtaaggcacaaatatacagctatgccctctgtttctaaacctaaggtgtgtttaacttttaagaaactgccaaaattccccaaagtgcttgtatcatttcatattcccactgacacttccccacattttcagtaaacttaactttttaattgtagtcatttttgtgggtatatagtggtatctatttgtgttttatttacatttccctaatgactaacaattttgagcagatttttctgtgcttatttgccaatgtctacattctttggtgaattacgtcttcaaatttttgatccatttgttaatggattgttttcttatcatttagggacatgaagaaacctttaaggatggaggtgtgtctactgtctcatcctggtgatgctttcataggtatggacacaatatcaaaatgtattcaattgtacacctagaaatgtgcactttattgtgtatatattatacctaaataaagctgttttttaaaaacaaaaacctaaggaaagaataaggacaattcctggaccaaaaaacgagtgcagtgttttgtttcttactattccaagcaggaaaaaagtggacgatgccattattacagcttgtagatctcaagaaatgaggtccctacttctttggtcctaagaaggagctgcagttctggtctcccaaggtcagtgcagactctctggtttgtgcagtgctgccttaggctgttaaagagagcagccattgtgtgctccctggatgggcccagccagatgcccttcttactctgttccccagggcaaagtacccatcaatgcttttaaaacgtttaaatggaagccactctcaaaattagagtcgtcccattgcctctacattcaaattgttatgttatcattgagttgtataacatttaaatgaaggcctataggcttcaattacagtattgtttgaagaaaatctttataaaatatgaatttttggagcagagttgggtaggagctccagactccaggtctagagtcaagattgtgcaggggttctttctacgaatgacggtgagggctttgatactataaagagagtggatacggctaatcagataaaagtgtgtcaccagaggagacaagaaatgagtttacaaatacaggctataatttaattgtaaaaaaagattagagacaccttttgttttgaaattgttccagttccggacagataaaaatgagtggaagaaagcaaagttcagagttcgggcctggtgacttctgttttctcagagaagtacgagatagactaatggtgaacagtgaagagttgagggtgagtgtgtcaaaagacaacactgtaacaaatttagtttaaagatttaacaggaattggggcagttctcctccacaaatttagaaaaggtgctctgatgggcatggtagaacagttcgtttttaaggacagtctaagcaggaccaaacatatagcataatacaaaaagcagatgggttaccataggttacttcaggttactttccttgcagggttaaaaggatgtttcctgactctaccagcaaaactggcctgtttggatacttggcaatggtctttctctcctgatttcctgaaaggtgaataagcaacttttttagtttggtaccaaggaactttagcacgagtgattccattttgattggtcggttggggcctagttcaggagctcagtccaactcaatgacttcctataaatttatttaacagtgggtaggggttggatgcacttggtaaagtttggaatcagctgttaagagagaaagaaatgtgctacctcagaacaagagtaaggacttctcagagagcttcgagagtctgctggcattttaaccaatgcctctaagcaaggagaaaacacaatgagtgacagtagaaaaagaaggcatgtggacactcccacagcattcctgagacagagtgataaaaggtgacaggaagcagatatggagtaatgatttctgacaaacgtggaaagaaggggatatcatgaaagattttagaaagtggaattgccgtatctaaaagcattaggagaaattctacaggcgagaaaaaaagaaggcactagagatttttgttgttgattttatttgtagaaagagacattctttacaactgcaggcatgttaggactttgccctttgaaaatctattagtaatgatataaaaaccttccgtggtctcttttggcagaaactgaattaaatcttcagctgctctctgaatcaccatttaaaagtttcagtgattcatatgcaaagcttgagttaagagaacaaagacctgaggagtttctgtagggctcggcctaagcaaagttgtcacgcagaacaacatgagtgctgggcccctacccttggccctgacaacctccatccgagcagcaacccctatccaacttactgcgccctgcagcctcccaggtgctgccctgggaatgccctcagaacgggtcctgtcctctgtcctgactctccttcctcttctcatccatccccctgaaatgatcctgtcctctttatggctccattatagcaaagaaaagagaaggaagaagagaggagtagaaaaagaagtcttgtggaggagcagacagcaggtgctatgtagggcatttgagggctcttttcatgtgctgtgaaaagtgggatgaaatgaaaatctttttgaaaaagctggaagctgtttcagatctccccctccctgctccccaccaattcaattcctgctcccaggggaaagtgcaaaataactttctgtgaatgaaatgatgacaatgactttggatccaataatgttatcataacctggaaataaccttccatctgaggcttgcaaaggcagtgaagtgtgaaactcagactacagttagagaaacaaagagacttgaactcaggaccctttggacatttccttcaatatcaaagaaaagttttttttctctcctctgaaaatagggtaggaaatgggtaagtgataaacagagaaaaaggcagagcaatacctaattagaaatcaaactaagagaggaaaagaaaaatgggttcagattaattcaggtttggttattccaggatctcaacttcgttgctgttatcacatactttcagaggcttcaggtcttgtgatgccgtgtgcttgagtgtttttcttactcttggaagctgaggattatactcagggctgggcacacaggagaaaagggtttgttaagcatccactcctggttaagtaaaaaatgtacatagaacttgaaagcacccaactcagttccagagggatgaaataaactaaaaataggtgagctctggttgtattggggctggcctgaaaacacacaagaaaggagccttgaaagagaaggaaagaggagcaatgtgcatattttacatggatatacacatttgtgctacatatttatatacaaatgtacaaactccatgtgtgcttcgtttgtgtgtgcatattatatttatacatatgtatatatgtagagttcacagagcatacccacacaaatacacaccgaggtgctgactttgagctctgtaagaaaaaatttactactcgggaagaaatgaaacagccttttgaggacattggccatacactaccaggtatactaccttttggagggcagatcattgttttgcatatgtttattttgggtaggaggagactcaggagcaacataataaccacttaaaattttagaggaatatcctgtggaagaagggtttaactcattccgtatggttccagagagagaactgagactggagcatagcagatttctgttctaaatgagaatgactttctaacattagtactaaacaaaagacacgtgtatttcttctaaaagtagttaacgatatgcctgccttgtaaatgacatgtggcagaggatgaatggccatctgtcacagaaacggtagggggtttcttccattaggtgggggtttggactacagcattagctggaccagctccattctgaaatcagtggttctctgaaatacataaatgagttttgaggcaaggcaagtcagataatggtttgatttactgattgcttttacttcattcagtgacttaggagcagaaaactcctatctcatagttcctatagatatctatttttttgccttctgtttgatttctattcttcctcctttttctttacctttaatttttgtgtttctattatcttttccttttcttttcttcttcctcccatgccctctagatataaggatggagtaaaggcaatgtttgtcaagaaagcaacaaggaaaaaaaagaatagagaaaggaaaactttgaactcagttaacttttaattttcacttcaaatttggctgtgtgtgagtatgtgaatgcatgtatgtatactggattgtgtatgtgtttgttgtgtgtggaggggtgggatagaaacagagagaatgtgtgagtaggtgaatagaccctcgatgtttggaaatgctggaagttaggtaccacttcttgttgtcacgatgcctagtgggtctagtagtaattaatggcaaaaggggaggaatgctctatgtcctgcaatatgcatgtcatgccatccaatcatgtattatactaccctacataacagggccccattgaggaacactaggaaaggctgtggagacagactgtctgggtttgaatcctggttctgccatttttagctttggatcttggataaatactttaagctttttgggtgtttgttttctcttctgtaatatgaaggtaataagaacaccaacctcacattactgtcagaattaaatgaattagtatgagtcaatgcttagaaaagcacagacacataaaacacattcaacagtgtcatctatgattttaattttctgaaatggctggaaatggactacttggactcatcttatgtgctgagtgtatgaaagctctacatgctttaactgattttttagggaactagatagtaatgaaccagtacttaagaagtgcagcttatggaccccttgatgttgtgaagcttttgtgatatcacatgaacacacgaagctttggcagataaaattaatttgccttgttctttttgtcttcctcacacataagcaacatatagtcatataccacataactatactttggtgaggaacagacctcatatatgacgtggtcccataaaattataatgaagctgaaagatttctattgcctggtgatattacagcctcttaacttcacagctcaatgcattactcatgtgtttgtggggatgctggtgtaaacaacctactgtgctgccagtcatataaaattgtagcacatgtaattatgtacagtacataatcttgataatgataataagtgattatgtttctggtttatgtattcactgtagtaaagttaatttactataatttattatcatatttactatactatagtttttatcatcattttagagttacttctactcattaacaaaagttaactataaaacagtctcaggtgggtccttcaggagaattccagaagaagtcattgttatcataggagataaaagcttcatgtgtgttcttgtcctgaagaccttcctctgggttaagacgtggttgtggaggatggtgatatggatgatcctgctctgtgtaagcctaggctcatgtgtgtgttgtgtcttagtttttaacaaaatgtttgtaagtaaaacaaaaaattttgaaaatagaaacaagactttagaataagtatataaagaaaaaaatatttttgtacagctgtacaatgtgtttatgttttaagctaagtgttattacaaaagttcaaaaagttaaaaaatttaaaaactaataaagttaaaaagttatagtaagctaagttaattattgaagaaattttaaaatgaatttggcgtagcctaagtgtacagtgtctacaagtctatagtagtgtacagcaacagcttaggtctccatattcactcataattcactcactactggcacagaacaacttccagtcctgcaagctccattcctggcaagtgccccatgcagtataccattttttatcttttatacaattttttttgtggtatcatttcgattttagataatttagatacacaaatacttatcattgtattacaattgcctacaattttcagtatagttcatattgtataggattgtagcctaggagcaataggctatgccatatagcctaggtgtgtgtaggctataccatctaagttcatgtaaatacactgtatgatattcacccaatgacaaattacctaaagatgcattcctcaggacatatctctgttgttaaatgacacatgattatatcccaaccgt

SEQ ID NO: 5104 - DNA, 16067 bp, Homo sapiens
atatatatatattatttatataatatatataaacacacacagatacatacacacactatatatattaagtatatataatagtgtgtattatatatattaaatatatataatagtgtatggtatgtatctgtgtgtgtatatgtatgtgtgtaagtatgtatgtatgtgtatggtgccgccataagctaatcaaacaatgtgagttaaattacctgagaaaacaatatcagttgagcctgagatatgtacttagtgttgtacatatatcttatacaaatcagcaatagacaggcaggtaaaataatgttctaagtagcagagggattgactgatttccactgaaatgctcagggatgattagttctcattgaaatgactttccctagttacttatgctggcaacattgtcatccgtccaggtcccctgaattattcctcagagaccagtgaaacaatgtcatgctctagagtgggcagagagaataaacgaagtatgccactctgaatctgcttagttttaatgctatagataatgggttcataaaaggtgggaaaaggaagtggatgtagctcattgtgatgtgaacgactgaggaacatgctttccaaacctatgaataaatgtcagacaaactacagtgacatagaaaccaggatgcagcagatatgagagacacatgtgttgagggccttggccctttctcctccgaaccaatgcccatgacagtcttgagaatcaaaatgtaggagaaaaagatgatgagaaatccaacaagaccattgcaaataaaactacaactggatagagacggttgaaggtgatgtcgcacaggctagcttgatgacatcttggtgtagacagaaagcatgggagagtacatgggacgacagtagggaaaccagtgtaggcgaacaactattggcataatggacagaccagccctgtcaatacccgcacaccaatcttcattacctgggtgttggtcaggatagaggtatatctaaggggttgtggatggtaatgaaacagtcataagccatggcaagcaagacacctgactcatgacagaaagagtatggataaaataggcctgagagaagcaggctccatggccaatctcctgtgatctaaccacagaacacctagcactgtgggcattgtggtcaatgtcactccgagtctgtagctgccaacatagctaagaaatagtacatgggctcatggaggttatgatcattctgatgagaaagagaagagtgccactgccaagaagtatggagatgtaggctgccaataagggatgaatatccagtgatgtgccttctccatgcctgggaagccagtaagctggaaggtgaagcagacttattgagccccattgccagctttgcaaagaggcaaatatttactccaggaaagcaatagtaatcagttgtataaaagttgctccttgagaactctacctgttcataagtgttcaccagtcctgactttcagtgacagcaaggatgataatttagtcattcctgggagtcctaggtatgggaaaatagaatgtataaagaagatattatttagggtttactctatgtagattattggatactacgttggggatacagctattcatgcagaataaacattgttgaatcattgtaaatcatataacccagaaaataaaaacaaaatgaaagaagaaatcactatattgaatagtgctgtaatggcctgaaacttataggtcacttttcatggtgctcttcatcctgctggtggtattatagggtggatgtaaaggtttcccaggctatgtgagacctaaaagatcgtagaaaaatggttctaagcactattggaaaagcagatataaagattatatggaaaaacaatacacaagtaagaaatatatgagcaaatacaataaaatagtaaatttcagagattgattttcttcaatattcctggagggaaaattcaattgatgaagctccagagacttttgggtgttagaaaatgacgtaagagtgacttacctgtgtgtgtttccaaagcacatagaactcttgttgcccagctttataaccctagttattgatacactgcttcaaagaattcaaattttctaatataaattgaagaataaacagtaaaatgtggatttgatgataagcttttgaaggcataattgataatagcaccaaactactgttgcatatcacctacttggtgatgcaaaaataaaattggtaatttaggcaagatcaaggagaattttttttttaaaactatggaatctgatggatttgacaaaagtgagaaggctctgtgactcattagaattctaagatttcagctggtgaggcagccaacctctgagaatacataaattgtgtgttggtggcatgagccagagaaaatggcccaccttctcttatggttggtttggactatacatctcatatactattgaaagagcaattgatgtaaatttatgcacgatttacaagacctctttctgtccatgaaaagaatgcatcaagattactggactttcattttcagaagaatttgttgaagtttcagctctgctctttcaacaataatgatcttgggaaagtaatttaatcttgagatttggttacataacctgtaaaactactagtgatttctgtcttctcagtcattctcttgacacaaagtaaggggaaatgtttgtaaagagtggataatttttttatttttgtgtttttgttattgtttcagagaagtacccctttctctttctctagtgagtacatgtcaggattattcacccagaggtgtgtcaaatgtttcctttttttctgtggaagccttgggaacagatataagatgatgatggggtttttagagcctgtgtttgactttaaataaagatattaaactatagtttctctaatcagcagataaatgtgatatgtctgggtgggaaagggaaaggagaaaagattgatgagccaatgtgggaattctgacatagctaaaagtaacgttgagcctggggcattgggactgagggaagtagagggaaagcaactctgtcctcaaaaagtgagaaaaggaggtattattgctcaatctgcctgcagtgagaggttcagacaatactcagcttatgcaggattaaagaagcagtatggcaaataaaattgtacataggtatataacttattgttttattataggtattcattgttaaatgattccataatcaaactaattaatatatctatcacctcacataataactttaatttttttggtgtaaaaatatgtgaggtctgctttcttagcaaattttaaatatacctaaataaagctggagggaaaagataatacagaacattaatctagttaattgtgttatattactactaaataacatataattgataaattaaaaaaaaaacaggagtaggaataccagatagggaaaataaactgagaaacaaatgtatggaacaaataattgttgaatttctaccgtgtgtcaagtattgactggggcattatatacacctcattttttgggaagaatccttaaaatagctgtttgtctgtctgttttcatattgaaaactgagtgctttcacttgattcactcagttgcttttgtggatatgagatgatctgtgagtttcagaggggataaaaatctaaaacctttgcctcatcccgcagccattcaccctcttccagggtctctgtcatagaatagacttgagtttttattaatagaaactaattctcaaagtctcaaactctgccgcataaactgatggctctatgcagacactcagcaggagcccattcagatgttaactttcatatattctctcaccttccctttggctttttccttcacttttcctgacactcttttctgtctcaagcacttagtatctccatccttttttacccccttacctttggctattatcctttctgtgatggttaatattgagtgcaaactgattggattgaaggatgcaaagtattgttcctgggtgtgctgtaagggtgttgccaaagagattaacatttgagtcagtagactgggagaggcagacccacccaccctccgtctggggggtactatctaatcagctgccagggcggctagaagaaagcaggcaaaagaagatggaaagtagtggatgcctgttacacaatataaacctttccaggtgctaaagtcacacaggctagtgaatctgtacccctgatccagaggcacacataacccaagctccgtccaagcttaatttgaattggtttattagtcatatggtcagatagtgactttttttctagaaagtatttgaactctgatgattacagaggtatacctcctcaagaatttggaagagttgattctatatttgcacttatctggacttctagggtaaaagacatggggttgggggcagggggactctcagggtagaatggaagccagagagattaaagaatcagtcaggtggagagaaattactacaacccataattcatgcctgagtcaacacccatgctctggtttgttcgtagaattgtttgccttagtgttccagaatctatccttcacttttttatatttgaagaggtaactctcaaagaaaccagttttagagatgtcagggagtctttaggacccatgcctactacatatatctactcttacagacaacactattacttttctcttgctaagaaatcagcttcgatctctctgtttttttttgccttggttcctgcaatgagatcttacagaggagattcattaaataccctcactgactgaaactttgttcccttccattcttcagttccatagtcatgtatctcacatctttagcctatgaaagatttgggcatcatcttttcagaatctgcacatgagcctggctggtaggaactttattttagaagctcctccccagagaccattcctgatttagataattattgttcttcctccctccctcttctgctccctcctctcttccctctctccctacctccttccttccatcttttctctattatttgtgccctcagccttgtgggtattgggctttgaacagcacaactcagatctctgtctctgtcctggcttttactggaggttttcctctgttggaggttgaatatttgtctacattgtggctttggctcttgctgtgctactttggaattattttatctcattgctttcatagtccttactgtaaaacgcatataataattgccatcacaaagtgatgtggtgtcttggctgaagcaccatgtgatgagtatgcctgctgcatcccctggaaaagagaaaactctggtaggctaaactcaagaagggaatagttagtgataactgcagaatgtgcgttcacgtgggtactagagaaggctgcctgaattttattatattgactctagtctatctagctctcgctttcaagctttctctgatctaaaccaagcaggaaatatagtagaaattcaggttacaaggccaagaagatatataggctttctcttgagataaactgggaaagatttgactgttgagtaaatgtagggaataaattacctcccagaggtgataccagagtctgctggggctatgagacaggctgtctgattccccacacataaaggtcctaccagtggcttgattcagccagtacttatttgaaaaaagaaagattatttaaaagcttggggggactaattaagtgttccagcccctctaaggaggagttaatacagagtaaatatttcttaagatccaagttggctataaagggagacatctgggaaggtgctatctttattaataaccacagtgactgcttctcttcacgatgttgagaaggaacaacatgatctaagtctttaggtaagacacaagaaccctgctctcctcaccatcaaacaagttatggtacctgggagtatggtgaaatactcctagatatataagagtgtactaggagactcctctataagctctccagagaaagatacggagaagaagtgaggatctcaatagtccacagctttggatgtgtgcacagatttcagtctgaagttgatagacttcaaaagcaattccaagtgctaccaaccaactacctaagaccttctgtactcagtgagtgaatatgattgaccctctcatatgtcttctttcctttctaaaagatgaacaggaaggacctcttattctactacattttactttttaaacaaagcagagaaaaattatggctgtaatgttagaagtttatctgattttctaggtgttccattatagaatcttcttgcttctatcccagtctttatgatctctttccttccctatattttttttcctcagcttttatctcttctccattgtctttcttctcagaaaccaagagccacgactagctgaggacacaagaattttcaaaaacaaagtagagtgattccatagatcactattatagctgcattaccaggtatgtctgatggaattcttgggaatggagaaggaggaaactttaagttgcaggttattattggcaaatacaatcattgccttacagtttggttagctttccctgtagtgattcatcacttgtgctgatattctctgataagaaggaatttttcacaaagttgagatacagtgaaagattaggttaaggagattattgctgaaacgtcagagaagtaagagtgttgacagagaaatgaagtacatgaacacagaaggggaggagctaagctggattatctttgcgtctagtaactgaagaatatcatcactcattgtatgttcagtaggcactgaattctggtttatgtctctcagtcctaggcagaatatggatgctgaaaaatgattctttcaaagtgctgagttgttgcctcacgcccattgtctggcatctcttcactgaaactattacagttagatctcatctctatgggtggaagtaagaggatcgtttcctttggtggcatctttagggtagtgccttacactgacaaagtaatctgaaggggtatatttggatacgaccatctttttaacttaggataaaaacaacttcaaaagttgttctggcatgtgacaagaaaaaaaagcaagggatgcatttgctctaattcagcatatttactaatgactcttgatttcctcacaagtgaatatgtatccccctcagacttccttttgagtaaatggcttcaccattctttcatttgttcaaacagaaatctaggggaaacccatttgatttttccctcactcccatttttaatatatcagcaaatcttggcactacttcaaaatgcatctgtctctgtttaagttttcctatttttctctttttttcatttcccctgctctctcctagtcaaggtcaccatgactcttcatatggatttttaaaatagctttctaactatctcttttcttgtctcttgcttagtcttcttcacatagcagtctaagtgagtaatttaaaatacaaatcagaatatatcaccacactattttccattgtgattttcaaagtgtcctatgtctttactacatttatagtaagaagaaaacaaaacaaaacaaaaattccgtggtggttgtaaggccctatgacacttgagtactacctgcttctttgacatcatctattgtccctccctgttttcttatcaaatgccagtcatgctgattttccctctggaacagttttcctctagtctgtatacggtcaggttttcttttgtattgaggtctcagttcaaatgggacctcctctaggtgcagttctaggcccctcaaactgctatactatcttgtatacaataccatccaataatctacatcaagtagtactgttttatgttaaacttgcatttatatttgtttaaaattgcttatttatttttcaacttaatttatggtttataagattagggactttgtcttattacctttaattccagagagctttaaatatcatggctgtcacatgatgcgtgttcacaaatattggtgaactaagaaatgtttatcagtcacatgttagatactttgcaaggtgttgagcaaacaaataaacaccatgtctatatgcaagaagcccctagtctagtggcagaaggaatattaaaccttctcaaaggactaatctcttctcttcagtaaaagacagcaccacgtttaagcaggaaatagctctcactcagtattggggagaacagattcagaagcctatggctggggataagggaaggaaaccaggaagatggatgtttaaatataaatggagaacttgaaatgagagagaatgagagaggtcagattctagggaattacttcagtaggcctatagaaaaataatttaaaagaaaaagacactacttgtaaataagaaacagtaagatgtttaaactgaaggagatacctattataagtgatgtctttggctggcctaatcatttattccagccccaaagtctaactataattagactgagctattgtcacaagtagtgagtagtactgaaggattctacaagaggtaattcacactaatcgtgaatgtctgttccccatcactagtccatgaaatctggaggccagtgtctctttctcaatctgactgctccttagctacagtggtagtggcagagtttctctcccacacttttctttcttaggctgttgagactttagctgataattcaggtaagtctttaatgcaggaaaatgtggattagggatcactactgtgaaggcaattacaggtttaggtggtgaccagaaaaaaattagtgttagctttctggaaatccccttgaatgccccatagaatacaattctttaaaatctgcatagttaagggtaacagtttagaagttgtagtttacataatttttttctgaagagaatgcttaaatgcatataaacagttgaaactccaagaatttgattagtaggtaggagatagatcctggaatgtgcagttaagaatacaaatagtatgagtaacccgagaatgtattttgagaaacaatcacttatattgatgtcattattatctttaggaaaaattctgagaatgatatagtcgaagtgataccttgaaggtagaactgtgcactgtggtaatacagaaacagaaagacgacatttcttctatataaacccaggatgtcgtccagcagcagccccatcccttcctattgactggttttccaggcttggaggaagctcatcactggatttcctatttttcttgttcatgtatatatccatcctttttggcaatggcaccctccttcttctcttaaggaagatcacaatcttcatgagcccatgtacttctttctggccatgctggctgcccagacctggggctggccctgaccacaatgcccacggtgctgggagtcctctggctggatacagggagattggaagtgcggcctgcttttcccaggcctactttatacactcactttccttctcgagtctggcattctgcttgccatggcctatgaccgttttattgccatctgcaacctcttagatatacctctgtacttactaatactcgagtagtgaagattgggctgggagtttgatgaggggatttgtatccgttgttcccccaatcaggcccctctatttttttctgtatgtcactcccatgttctttcacatgcattctgccttcaccaggatgtcattaaactcgccgtgctgataccaccttcaaccgactgtacccagctgtgcttgtagtctttatatttgtgtggattatctgattatcttcatctcctatgtgttgatactcaagactgtcctgagcattcctccagagaggagagggccaaggctctcattacctgtgtctcccatatctgctgtgtctggttttttatgtcacagtgattggattgtctctgattcatcgttttggaaagcaggttcacatattgttcacctcattatgagctatgcctattttctgttccctccactaatgaatctataacatatagtgtcaagaccaagcagattcagaatgccattcttcacctttttactcccatagaattggaacctgatctccaatcatcacagtcactctcacagaatgtaaaaacctaatatttagcaggagagcaaagaagtctcatatctagcatgcatgctcatatgacttgtaaaataggtgttaaaatacagcttcaagtttccctaaggtatctctttaagcccaacctttagctaaatgtagtttgtacaaatttttgttgcattcctgtaaacggaatatttcttaagctttccactaaattattgtgataacaataccttaggcatctattggtatgtctatatgtaactaacatatgtttatttcatggtataaagttagcagataggaacagaatcataaaatataaaattattagttggttcgagtgaaatggaatagagtttggtttactatgtcaatctaatttccaactcttatgaatttctctgcaggtgtccatacaaacaatgggaaccttaaatttggtcactgaagtccaggaattttcctgcaaaaaagaatataatcttctttgacagtgacctaattacttatcatctcaacagtctagttggttcctcctccctccatcaaatataatgaatttgtctcaaaaaccataaactcatatttattccccaaggcagtaccttcgacaaacttgtaacaaaaaaatgtgagaagaggaatcacggataaatgagaggacgtagcacagtcagtacctccttctatcttgctctcattcttattctactaccctagttgctagtccaatgttgaggccatcctcagatatctacgctggctgactagtccaaattagtggaaagacagttccttcaccctccttttgctatgaaaaaggtctgaaggaacaaaaaaaaatagtttctgcatttttttgaagaatgattgctttctgtacatacattctgattccatgtaaaagtgtaaatttcccaaagaatacaacaatgtcattctcatttgattaaaattgtctgagagttaggaagggacccataactcaatttaaaatatcctaaaaagagggaggttatgtctaattatactttaatcagagcaaaaataatacttcagtgagacaagagaggggactataagaagatattgtttatgtctttggtgttttaccccgatcattttacagaattgtgcaccgtgaatgttggctgctcattgttcatgtttctgctttctgcaggttgttgttctcaactagcaggaaatgtcttatgaagaaaatggcccctgctccttaggtagcaggccataggcaatactgaccctcttgccttctgaagctaagctccagcttcagtatgcacttgcttacctcttcccctgtccacactgcttttacttgctccctgtctcctgagagcattcattaataattgcacacatttgaatccctatctcaggtattgctcatagagagtccaacttaagaaaactgcaatccttatttatattctgtttcattaagagatgtaattgtgaaagaactgaacaataaaaaaatcagctttatcatgttttttatccttgtcacgccatgtcacctgagcaaccagtctgaatactaaattgtgagtgtgagtgcatatatgtgatggtaggtttttgtcctttttcaatcattcataaaaccaaacatgtgtcccttaattatgctctactacatccacacttattttattcataaaaatattgtggggtagatattatcactgttttcttgatggggaatttaatataaaaaagttaaatattccctccaagggcataacatttttaattggtatagcatgattcaaatttatatcttctaactataaggccagtgtgaatggtactccactacagagactatccttagtggcttctactttttgccttgtattccgtcatgcttgtagtacctatttctttttctgaaaatttctcctccttctactccaaaaatattgttccctatgaaaacgatattttgcattgtatctccaaactcctaaccgcagtagaagaacttttttaaaaagatttttcaatatgacattgcaaaaaaaaaaagagtaatgcttttgttgtggtagaattacaaaatgcaatgcttagaattgttaatgacaatgtttttcatcaggcaagtgacttcaaatataataaatatttagagtaaattatagataaagaaatgataataaataaaaagaatctcaaatctctgattccatgttttcctgagactcagtgacaaggaggacagtttgaatctttttttgattccacagcctaataaactcctcttcttgtaatttgttttgttcagcctagttcagttgagtttcacttataaccaaaggctattaataattatatcatctcagttatagaatgtgaatcttctctaactaatatttaaaactggaaaatactgttaggtagaagagctgctctttttctaaaatacaggaaatggaacctaaaaatggcaggaaagttgaccatttgggaatgatttatgaagttatttcccttgtttaagaagttcatttctgacttgaaagtaaggtgaaactaaattcactgagaagatgctgtaggatgaatacagacacaggacatcggagtggggggaagactaaataattatctcaaacttagttatacagaaggctacatggtggaatccactcagacatgtttttctattcaaaacccattgtaacaatcaacataaacacagtagttagtattatcataaaatttagaactttctgtgatctcctacaagtcttcctgtggtaaatgctatgtactattagaagccttagcaaattaatacaggaacagaaaaccaaatacccgtgttctcacttatgagtgggagctaaatgatgagaacacatggacacatggaggggacatcacacactggggcctattggaggatggagggtgaaaggagggagaggatcaggaaagtaacaaaagggtactaggcttaatacctgagtgagtgatgacataatctgtacaacaaccctcgtgacacaagtttaaatatgtaacagacctgctcttgtactcctgaacctaaaaaaaagttagttaggaaaagaagcctatttataacactatctcctaggaaacactgcacagaatttgtattcataagaagagtagaattcagagtggtccagtggactaacaaactggtaaccaccttcttacagcaggtgaagcctgtaattcagcttttcatcattcaagactgaagaagaatataacttatatagagaaggacctcatgaggaataaatttcatggtgcctattagataaataagtaccatgtagttatgggaaatctaaggtgtaaaagaatatacattaaaaaagcccttgccaaataccatcctttctttttcaaataataatatacttgtgtagtatggcttgaagggataacataccataagaatatttaatttgagtcaggaaatgaaaggctaatgtgcatttctgtagactaagccaatcttagaaatgattaagaagacatggaagaatctagagacacactgaaaaaatatgtatggtctaatgagtttacagatcacttttcctcccaataaaatgaatttatactagataaggggaagatgaactttattcctctcattaacaaatattgctgggttccttcaccagagatgcagatttttatagggtaaatgaaaggtgatatattaaagatacttactagattatatgagtattaaattgggcagcaaggatgattagaaatattaaggacccagaggtctccatgtccaattaaagaatgtaaatctgtttttgattttaagcctaaatccttagacacagtcattgttattaataaactcatagacaaaatttatttttgggaaatttaggagtttatgtccctagatttcaagtacatgccaccaaactgacagatacagtgattagtcacaaagtgcctcaaaaatagatggccctatgttagtcatggttctcagaaaaatagaatcaacaggatttacccaacttcaaattatactacaaggtgacagtaataactgaaacagcatggtactgataccaaacagacacactgactaatggaacagaatgggaactcagaagtaagaccgcgcatctgaaacaatctgatcttcaacaaacctggtaaaacaagtaatggggaagggattccctattttataaattgtgctgggagaactggctagccaatgcagaaaattgaaactggaccccttccttacatcttatacataaattaactcaagatcattaaagacttaagtgtaaaacccaaaactataaaaactttagaagaaaacctaggcataccattccggacatagacacaggcaaagatttcatgatgaaaatgtcaaaaacaattgaacaaaagcaaacactgtcaaatgagatctaattaaactaaagagatcgggcatggtggtcacgcctgtaatcccagcactttgggaggccaaggtgggtggatcacttgaggtgggggtataagagcagcctggccaacatggtgaaactccatctctactaaaaatacaaaaaattgctgggtatggtggtgcgtacctgtaatctcagctactcaggaggctgaggcaggagattgcttgaacccaggaggcagaggttgcagtgagctgagatcgcaccactgcactctagatgggtgaaagagtgagacttcatctcaaaataaagaaaaatacaattaaatacagagctctaaacagcaaaataaactatcatcagagcgaacaggcaacctacagaatgggagaaatttctgcaatctacccatctgacaaaggtctaatatccagaatctatgaggaacttagaatatttacaaaagaaacacacaaacaaccccattaaaaagtgggcaaaggacatgaacaacacttctcaaaagaagacatttatgtggctaagaaacatacgaaaaaagtctcaatgtactgatcattagagaaatgcaaatcaaaaccacaatgaaataccatctgacaccagtcaaatggtggtttttaaaaagtcaagaaacaacagatgctagcaaggttgcagagaaatagaacacttttacactgttggtgggactgtaaactaattcaaccattgtggaagacagtgtgcaattcctcaaagatttagaaccagaaataccatttgacctcacaatcccattactggtatatacctaaaggagtataaatcattctattactaagatacatgcacatgtatgttcatgtagcactattcacaatagcaaagacatagaatcaacccaaatggccatcaatgatagcaatttaaaaaatgtggtacatataaaccatgaaatactatctaaccataaaaagggatagatcatgccctttgctgggacatggatggagccgaaagccattatcttcagtaaactatgcaggaacagaaaaccaaacaccacatgttctcacttagaagtgggagctgaacaatggaatgagaacacatggaaacagtgaggggaagaacacacactggagcctgtcagggcatgggtgtggtgaaggggagcattagaaaaaatagctaatgcatgctgggcttaacacctagtgatgggttgataggtacagcaaaccaccattgcacacatttacgtatgtaataaaccgcacatcctgcacatgtacctcagaacttaaaaattaaaaaaattgaatgtacataaaatatggaaattaataaatgtaattcactgcattaaaaaaaaataatggcaaaaactgcaatactgttgcaccaacctaa

SEQ ID NO: 5105 - DNA, 14140 bp, Homo sapiens
ttactgtagccttgtagaatagtttaaagtcaggtagtgtgatgtctccagctttgttcttttgcttaggattgacttggctattcaggctcttttttggttccatataaatttaaatttttttctaattctgtgaagaatgtcaatggtagtttaatgggaatagcattgaatctaaaattactttgggcagtatggccattttcatgatattgattctccctagtcgtttattttatcctctctgatttctcagagcagtggtttgtaattctccttaaagagttccttcactcccttgttagttgtattcctaggtattgtattctttctgtagtaattgtgaatgggagtcattcatgatttggctctctgcttgccttttattggtgtataggaatgctagcaattttgcacattgattttatattctgagactttactgaaattgcttatcagcttacgaagccttgagctgagccgatggggttttctgggtgtaggatcaatgtcatctgcaaacaaagataattgactccctctctttttattcaaataccttttattttttcctcttgcctggttgccctactagaacttccaatactatgttgaataagagtggtgaggaaaggcatcgttgtcttgtccagttttcagggggaatgtttccagcttttgcccttcagtatgatattgactgtgggttgtcatatatgactcttactattttgagatatgtttcttcaatagctagtttattgagattttaaacatgaagggatgttgaattttttgaagtacttttctgcatctattgagataacatgtgatttttgtctttagttctgttaatatgatgtatcacatttattgatttgcatagttgaaccaaacttgcatcccagtgatgaagccaacttgatcgtggtggataagcttttgatgtgctgccgaattcagtttgtcagtattttattgaggatttttgcatcaatatttacaagtatattggcctgaatttttctttttttgttgtgtctctgccaggttttggtatctgatgatgctggcctcatagaatgagttagggaggagtccctcctcttcaattttttgaaagtttcagtagaaatgtgtactagctcttctttgtacctctggtagaattcagctgtgatctatctggtcctgggcttttttagttggtaggctattctctactgcctcaatttcagacgtggtctattcagggattcagtatttttcctggttcaaatttacctttcttataaggaggcaatcatgttggatttgagtccagtctaatgacctcattttaactttgttaccttggaaagactctaccttcaaataagttcacaatgtctaactgtgagttaggaatttaacacagaacccattcaacacatgaacctttgggggcaggacttaatttgacccttaacatgaaggataaaaatattttttagacttgataattgtagctcttgtttgatggctgaagtatcaaaagattatgagaacagacatgaggctatgaatatgttgaaggattggaattttggatcatcaaatgtgatccaaaacctctggacacccttaccctttctagatatattttttcccctaaagaactcaaaggagaacaaagacctggaaaaatatctgtggatatctggaagtaagcctgtactagaggttatcttgtatttgtctctagtttttatgttcgattctcagaggcagtatttcattgtacaaggtgcaataattatggagtatacattttatttaatcacataggagtggtttattataaaagagaaagaatactttaactttaaacctgttggacaaaagggttagtataactttctcaattacttaggcaaatatattcttgaaaataaaaagttagaaaaggggaaagactgagaccctcaatgttaaataacattttataatgatcacatgctgagtcaaggcaaaagcaatttctaagtcgcctacttaattctctagaccatgcctgctatcttattttatatcttaataaatgtacatatgctgccttgctgttttggggacaatgggaagtataatttgatctttcttgaattctccacatttaaagtctccacttgtcacttgaattaacaagtattttagcatttaatttcctggggataccagatgttttattttgtgagtttgtttttttatgttatagttgtggtttaaacaactatatgttcatttaaaatgaaactcaaaaaaaggaaagaatggcacaactcaataaatatgtagtttaataatattcagtgaatacgtatcacagtgaatggaagtctaaataacgtactccagtgaagaattattagatgttgcccgttcagctggattttcagttatactattcaagctggtgggaggtttcaggggaagaacagggagaagacaaagcagaaacagccttaggcagtataaattctgaatacctttaatttgataacatgttaatactagcaggagagttactttgttgtattctagggattataacatggcacatttgaaatgatatggttcccaccgataaggggaggatgaatagaagcatacactgaattctctccagggcattgagttcctttggcgacagcactgttggctaaatatgaaaggcttgagatgaaatggcagcaagagaacagcagaggaaaatgtaaggcaaggatgggaaataatgagaagtttatacctgaccatctcttttctatcattggcttcctatctcctattcttttctttgtcaatctctgtagcctccacctttgctcaaattggctcagtgatatgattttatactaagcccacacccagttggtatgaagacattaagtaattaattaattcaataacttttactgatctgaacaaagtggacaaaaaaccctgtctctgtggaattttcttccaggctgaggggcttgggaatgggtaacaagtaagtaaattatgtaacttgtttgacagtgctagtgctacaaagagaaactaggtagataaaagaaatagggacttgggaggttgaaatttttaaaaaaaaaaaaggtcagagaaaataccacttttctgatgagttaaaaagctatgaccgctaatttttatgtatttattctgtgtccattaaaacttccagaaactttctcttgaaggacatttgagtctcaagatctggccctggtgattatattgtgacacactgtgatcattaaaaaatttttatcatcatgtataactgtgatgctattttgcttgcagcccagacaatgtatggatttattaaaacattctgataatcataagacagtgattctaggacatgtattatcggacctcttctgtacctgtgtttggagttgccatagatgaaagtcatatgataagagaaagcaatatgataatttgtaagtgagctgcttataataagcaggatatgacagtcaacattttcctttttacctttccttccatctctacctcttttctttgttatagactttgagtttgtatgtgtcaggtttcattcatttgggaaaccaatgtcacatcaaattaggaaggatgtatgaccctctaattggcctttgcattgtacacaagcctcctatgtttgttcgggatagcccacgcatccttttaaattggtagtttgactgtcagtttccgtaatgcccttgacagtaaacaaacacaactctatgtgattctattatgaaacattaatcttctgactgtatggtaaaggaaggggtgagagtttctctccattcccccaaaggaaggaagagtaagaaagaaattaaaatgtaaaagcactcccaataacaggtcatcaagtcacagcttttcattgtggccacctttgtcagctgtgtgtgtgacaagaaacaaatcacagctccatgatatttgatagcctgagtaattaaagagtcttcaatgctttttggaaaatgttgtccaatattccagccacatcagtgctcccttaataactcaataactccacatttctctccctgtgtgtgtttgactatgctatcccttttagagatatttgcatgtaatcaagatagagttcaaagatttaccatttccttactattattctatatttgaatatccctcccacttccatttttttcttccgatagggaaataagttaaccaaaattcaaacaaaaatcagttttaaataaatattcctaataagattattataactactaccacacatacatttatggtaggaaaatttagaatctgtcctggaaaaaatacgtccagattatttacaaagatttgctttcagaatccctcttgagataaataacatgttgggggtgattctgggatggagcaaacatgtagtttgggtcgcagtttaacgagtagccgtagtgtattaaggctatgcatagcaatttctcttgccctggagtagttagtgcaaactctttttacccattaaacatttgaagtagatttattagctctaaggattcttggtcttcctgaaaaggaattaagaatctttggacagtggacttcttgaaaatcctatcaaaacccctaagtatgtttctggtagcctctcggttgtgctattcagtgatgaataacacaggcttgattgttctaatttagcggaagaaacacatttttttttaatgtggtttttgccatttctattatactttaagttctgtgatacatgtgcagaacatgcaggtttgttacataggatacatgtgccatggtggtttgctgcactcatgaacctgtcatctacattaggtatttccctaatgctatccctctgctagccccccactacccaacaggccccagcgtgtgaggttccctccctgtgtccatgtgttctcattgagaaacacattttttaaatacataaataaatacacccttttgtcatgtatcttcataagcaattgacccaaccaatggatttgcagtcagtaaaacaactttggatagatgggtggatggatgaatgaatggatctcatttatttgtggggctaaaaatttaaacaattgaactcatggagagagagagagtagaaggatggttaccagggctgggaaggttaaggaacttggagggaaaagtggggacggttcattggtaccaaaaatagttagaaagaataaataagatttaggatttgatagcctatcagggtgactataatcataatatcttcattgcacatgtcaaaataactaaaaaagcataattggattgcttgtaatggataaatgcttgaggtgatggctaccccatttaccctgatgtgattattacacatttagcccatatcaaaatataacttatgccccataaatatgtacacctactatgtacctacaaaattttaaagaatgtgaatggttgaatagataggcagatagataataaagtaattactattattttgatttcagaagattttaacagggcccttgattatcattcatctgagatctaccttgtctgtatggcttatttgggttgtaggtaagagtcattcttgaatgagtgggggttctgattatttttaaacagccattcaagaccaatgcagatacctaggaggaaaatgtttcgatttttatgaatgtgtatgaaaccggtaaatattcataacatagctaccaatatatgctctgcaagccaatctaaacaaattgccagtatcaaagattctgttgatgaggaatagacgcctgtgtttgcagtcttgttaaggtggttaacagtggtgtcctgattttttccaaaacttccagatttgggctgctgagtagatgatgctgacttccgatactgcttgttgttgttgttaaaccattgagcaggttacgaacctctgaacttaaacgaaagaaatcagtggtttcactggaataaaaaagtaatactatggtatagcataacggagataatacaatttttgtggtttaaaacagagaaaaaagtccctcttttaatgcaaaatcacctgtaaccttgaatgtataaccagtgtgacttagctgataatttaggcctatttcatagagctgttatgagaactaataaaatcatgcacatacaaatgattagttacttttaaaaactgtaaaatgcttgctgttttgttgctggattgaagagttcattgtgatggtgccattcaatgactatatgactaagagatcatcctttgtactctgtctccccatctctcctccctcccttgtttttccatgtggttgtgttttctctctctctctctcttttttttttttttgagacggatagtttcattcctgcgcccaggctggagtgcagtggtgcaatctcggctcactgcaacctccccctcccagggtcaagtgattttcctgcctcagcttcctgagtagctggaattacaggtgcccaccaccagcctggctaatttttgtatttttagtacagacagtgtttcaccatcttgaccaggctggcttgaacttctgacctcaggtgatccactcgcctccgcctcccaaagtgcttggattacggcatgagccaccgcgcccggcccgtctctaagttattttctaagctaaaagtcatgctctgcaaccaacggatatccccccttttttggagatacttggtaatgtagaaactatttcgagagtcaaaattctacagatagagtttagaatgcacaaaatctagacatggcattgagcatctagatattgcctttacctatttcctgtaggaacttgctccagattagtatcttaagacaaattggcatttatttttcttacacacattgcattgtgccatgtaagaaaattacaattaaatcagcattttcctcctgcttgatgtgaataaaatcaatgctgaaatgggagtctagttaatctatgtgatagaagttactaggaccagtgtttggtggcttaggtccttaaaaaattggaaagctctttgcaatacagtgtgttaacaacagccttttctttttattccctccctttgcaactgttcccagcccttctttaaaaatctaagtcagaaatatattgaagggtttatttctatccatttttttctatctgcacatggctgttgatattccttcactgtcttgagctatcaactatcagtcttttgtaaagtagcatacatagtaaagtatcaagaaaacatttctcaagccagactgcctgtgctcaaattgcagctctgctacttactggctgagtgacttggacacgttatttaacctctctgtgcctagtaaccactacataggagggtattttaaaggattaaatctctgtaacacacgtagaaaagtacctgccatatggtaggcacaatatcatttttgttaaataaaatgaagcttagtagtttacctgcattgttcacattatctaaccattaccttccacatcgtaggtacacaatgaatattattagtcatgacttatacatgacaaatgtattcttaaattggagtggtacaaaaaacatatgggtccattccacatttctacaactagctctgcagtcttgcacatcaaattttagtgtctttggagcttccttctcatcttaaaataaaaatatttgcccaatgtatttcaaagggtaattttaatgatcaaaatgatatgtacttccaatgagttgaaaaaattatttctctatatgaaaggtattataacattttttttctcaaattactaaatcagttctaggggaaatatgctagtaaaatagttaaggcttgcagatataactggtccagaggtcggtagtcatcacgagtactaagacctagatactagggtctgtgtttgttcttgagaatacagcaaagtgtttcaaggaaggaggcttctcctttattaccaggcctgttcagctgtatttggctacttcttgttatggaaggaaacctgagcagccttgggaatccagtgttcctttatcacattcctcagatctgttaggctggacgccaagacagtagtttgaaggtgtttgtcttgatgctgatggatgttgcagtctgtaatccacgactgaaacagggcttctcttcattgcagctggcatatcttgttgtgtttatgagtctgacggcaaacatatctgaagcatatctcatatgctgatctgtgagggagataagccccttgtttgcttgactggaaacaaaataagcaggtggcagaaaaccctgcattgatttctgcttggctaaaacacccagaataagatcaagtcccccttgggcacactccagcctctgctatttatcattgatcatttgacttaagtttgcaaattgttgtagggaagtgtaagtttctttctctttaacaaagctacttttacttattataattttataagctattagcactattttgtgaagaaaaaactaaaaatcaaatggtgtcagagcttaaaaatctcttacttcatttgccgttaatctttatgcatttgatttttgcttcaggatccttacctataaagcatacccatttctttgaccactagatttttacagaataaaaatagttcctttctgaagaggaactatgaaatgtatacatgggttaggagatggagctgaggactccaaagtaatcagtccctgataagacttgagttttgatgcacacattattgcattttagagattttggtctcccagttagattgaaacttattgaaggcagtaggacattgacaatgcataaatattagttaggaaaatgaaaataaagtgttgcttaccaattcagagattcagaagaatgtggataggattttttccctccacctgaaatttcgactttataaactctttttattactgtccttccttttctgatccctgatgattattaattggttccagtggtgtatatttcagatatttaattaagtcttccttttgtccaactctctgccaaaacatatttttcatttttatacctgcaatgctcaaacataattgatgccaaatgcatgctgtttgattacattccatccagatttacttccaagcaggacaggcctgtagcatttatttcaagtagctttacaaagagccattcttggccctcaatgtggtggcaggcggggaggcaggagaggaaaatgaggtagatgtccttcccataccttaactgtttttgagagaaatggaaaatggcagatcagatgccattggccgtttgcccaattaagcatagcagtgttagctaagatgtgatcaatatggaagacttggtctgcagagcctttttagctgtgctcctgtactagtcaagcacctcctgcaactttgtggtaaattcaagcacctgtgcaactttgtggtaaaaaccatcctcatgagttagagccttgtcttataagaaggaaaggacagcttctgggtgagacacgtgctggccatcatgctgttgcctaatctgtcacctaactattgattcccagctcttgattctcattgttcattcatggagttgtttctaaataaggtgactagagaggaggaaatggtgttatattagttctctattgctgcataacaaataatccaaaacgtagcagctcaaaaatcaacaaggcattacctcctaatttttgcaggtcagaatccagatgtggcttagctgggtgcctctggcttagagtccctccataaggctgcaacgaggtgacagccagggcttcagtcacctcaacttgggagagatctgcttccaagcccttcctatggctggtggcaggccttagtcattgtggactgttggccacagataatacttcatggcacaagagcctttctacaggacagcttacaacttaatagctgtctttgattgagggtggggagaaggtggaagccattgttgttttcaatctaatcttgaaagtgacatcctgtcactctactgtattctattcatcacttagaagtgagtcaataagtataggacatttaagggagggaataatcaagggtatgaataccaggaggctgagacagttgggagccaccttatagctgccttacacaggtgtaaaaagcatgaaatagacattagacaaatgcagggtctgctggatggcgtgtaaaaagttctatcacagggcttgccacagagtagagaagcattgcattttttcttgccacccccagcacattgcctggtgcattgtgggcactcaagtacctacatgccatgaaactgtgtctagtttactaaaaacaaagagtctctctgttccaaaagagattaagtttggtgttatcctttctggacaattttcttcctatgcttcatttctccagttatcgtaagggaatggatttaagtctgaaataaaatcactcaaaaataaggaatagctgaagcagcctagaattaccttggtggaattaccttcttaagaacaattagaagtttattctttaggcaggaatgctgttgccaatcttccacagcaggtgataagaattaaattccctcatgaccaggaaacgttctttctgctaatctggttccacctggaggttcaacaaatagaagatagacacacggtgtgtttagtcttaaccacatagcccgaggcactggggaagtgtccacacgagtttgccttctgtgaacctggaaagcaatttttttctagttttcctttttttcctcttctttcctattcatctgaattcttctgtagttaaattattaatttctctccctacagaataaataaattactatccttgttaattcttttatcaaagatatgtactaggcttctgcttcccatgggccatttgaaaaacagtgcttcatacgatccctgaactttttggcaattataaaagagatcacaaatgagtaaggttgaaaattaaactataactggaatgaaatgtcctatagactaaacctatcagttgtattgcagatcagccccttataattggtgatgtggtatgagcattttatataactataatatataggccataaattattattatatcagtctgtggtatatattgcaccttagggtagaatttgctccatttacattatattcaggcagaaaaaatgaaacatctgtcagggagagtatagccctattgatcaggtatatataagtaaggtttacttaataaggctgagaaaaggggctttccatttgatttcagttgttttatagacaagtttctatttgagggagctatttagaaatgtatgtagccttatgtagaaattccaataaagctttcaaaaataaagctggtatttatattggttgaaatggcaagataatgagtctaaaagatttcccttctgatgttattttttttgttgttcagaatgacacttgaaagatgcctaagattttactgctgctcttagaatcacaggatctcagggtaaaatcaaactttagaggtcattaattcaaccagccataaaggtctttttgtcaaacttatgaccattcaagatactttggtgtaaagtagctcacaagataaaataaatcactcgcatgttaacccataggaggttaaactttgacagcagatctgtggtggtagataccatgttttctactgtcctattggaaatgagtgtagaggcccatttccactacaaatactgcctagtggctgacttacatggtaaaaatccaccaaccttgctctgcatacattccagaactctaatgcaaaatgatgcctaaaccattttactctatccatgcatgaggacactaagtaagatgaagcttgttttgatatatacacttttaaaaaggtagaagaataagaggtggtaaaataagttattcaatttattgactatagtacaacttggctctgattgttaatgtttgtccctgccatgtgatatatagttgtgtgagataaaaacccccttgggtataattttatttacaccaacacatatattttgaagagatgaataccaattctgggaatagttagaagtaaagaatttgaattttctgcagcactgctgcacgtaggtaaattcctctctttgggcctcacttgcaacaccaataaagagaggaagttatacagatgatctataagccccttccagccctaacatgctattagcccatgattcttgtgtaggataccagaagaagatgaaagagagaacctaacttattttctgtcaccagtccttataatcatggcattgtgtatttctccttgagtcaacattgcttcttttagtgacacaagcaagctgctttctccagctcctcaggaggcaactctgctactgcagaacaaagatcattctctcctggcactcttctgattcctggtacctgtattcagtttcacattccctttcttgttgagatgccattgcctatagaaagatactttaggtgaattaccaggcaaacgttactaaagcaagataactgataagggggactagaatcttggaatttgtgcaaataaattcctttgttttgaaactgcagactgattagaaaactgtcatagtaaaatactttaagcatgtccttttccattttaaaataacaactggaaggaaaatataaatatatcactgaaataatggtttctcatgaagaaaaagacatttagacaaaccaaaagtgtatattctatggtgtagtaaatcataccttactatattaggttaatacttgataaaaccttgtagtgagataaatggtgatatgagaacttaaatcttcaaatgtatgttttaagccccattatagctattttttttcaaactacctactataaagttttgtccagagatattccaaaaaagaataatagattggtattaattttctgcctcttttactctttggaagacgtgccaataggcaggtaaagagatcaaaaagaaaagtcgggcagggtgcagtttctcacacttgtaatcccagcattttgggaggccgagcgggtggatcacaaggtcaggagttcgagaccagtctgactaacatggagaaaccctgttctactaaaaatacaaaaattagccgggcgtggtggtgcacacctgtaatcccagctaccaggaggctgaggcaggagaaatgcttgaacctgggaggcagaggttgtggtgagctgaatcatgccattgcactccagcctgggagacagagtgagactccatctcaaaagaaaaagcaaactagatcaccatttacttaacaaggagctgttagtgtattaagagtattatgccatcagtctgattaaaccacctgaaggaacagtggaacctcttcctaatcattcccatgtggacttcctgggagacagctgggggcagccagaagcaagtagctagagaggactgtggattctttgtgaggaaatctgaaactggccactttaaggcccctgggttctactgaggttaacgtctaaagtgtccttgactcactcaatttcaaagcaaattcaatttgatctcttgcctataataaacactggtcagaagcagacatggaaggatttggaaaatggtgttaaaagatcaagagatctaaataaactattttgtttgaactagagttaccaagtagaatagattgtttaccatagatggagactctttgagaaggagttaaaatttgtgggagatccccaaaataatgcagttcccacacacacttttcccccagagtgtatataggggatatataccactttctccctccttttccacttcttatcattgttagatctctagaaagttcatgtagcttctttctctttgtcgttatatgtttcagatacctcaccagcttcctttgctttcatttaccatatctagtggtaatttcctcaattcctatatcctacaagagcttgatgaatgaaaagaaggaacctgtgacaattattttattcaagcctccaaagcagagt

SEQ ID NO: 5106 - DNA, 100000 bp, Homo sapiens
  misc_feature 90325, 90326, 90327, 90328, 90329, 90330, 90331, 90332, 90333,90334, 90335, 90336, 90337, 90338, 90339, 90340, 90341,90342, 90343: n = A,T,C or G
ttcttgagtaacatccttttgttctgcttcttgtgattttggtgtttccggggcttctgttctggtgatgcaaccacattgctctctgagatagctccattccactccagagattttgaatctgtgggtcatggtaagggactcttctttttgaaataaaacttggctctttcgtgagcctacaaaacacggtatacaaaaatagtagctactaaagcaaaaagttacaaagacaattttaagaacacttgtggaggagaaatgaaattttaaatttagttcagatatatgtaccatatatacacacaatatccttcagattataggattttaaaagtacagcttttcaacataaatatttaattttgcttttaaaagcattaaaaatttgaccataacaaaaaattaaaaatggggggtcacaaaatgttccagttatcctaacaaaagtcactagaattgcaacgtgataacctggcaggccaggcagtacatgctgcctcgtttctaattactttcctgtgctacttacagaacaatgggccctggtactgtcaaaatttggaacttttcacaaagcttctcttatgggagcagaccaagatgagaagggatgagatgtcactgtgctggatcttggttctacatcgccttgatttcctgagaattaaaaaagaataagcccttttaacaacagctaagatacaattctctatatttctgtatggaaagcaaatgtccaaaaacttaaccttctatgaaggtaaagcagctctgcagaatgacagccactgagagactgccctagtttagggccattctttaaacagttgcagggtgcagaaggaagattaagaccagaatggaaagggaaggtggaaagaaattgggcatgaggtaaaacccagggctccttagcctctgttgtagatgtcttggccatgcaccccgggtccttatccttttaaaaggcttccctagaccacaggtcttctcactgggtgatatctgtctggaggcacacaaagatgttttaggagggtaaacagaagtgggcagcttagggaatcattttccagatcctcaactccacatgtgctctcttgcctgatgctgatatactgcctgagagctgcatctgccatctgcagttccatttcccaccgcccctttcataatccctttttcccactttagagaagaaagacacacctcttaaccagcctgaaacttactccatgcgtccgcccaaggtagaacaaaacctcaggggtagggagccaaacaaagggacaattaagaaagcatatccctgagggagaatatttgacagcaaaacaaagcaggcagagattagaataacaaagcaacagcatcttatttcatatagctccatggattttccatctaccttctagtattaaaattcagatatgagagggatgtcatgtgaaatgtacatatgcatataacactttaccttaattaaagataaacagactttctcacagaaaataattctaatttggccggtagtttgccaatgaatactgactttgccaattgtatgataaacattttccaaaaattgaagggctaaattggcagctccagagtttttacaaaatatatgtaaaatatataagcactatcaatataccagaaattctatcattcaaaactattcataaaaatttattataaaaaatagaatttagaaatgtgtgacgaagcacaatgtttttctaaatttttctaggaagtataaaacaaaaaagcttgaagatcaccaattagactcctctctgctttaacacagaggcaggttttggtagaagcacaaaatgaaagaagattctcaagtggtctgccgctgtctcccagcaccgcaaatccccagggtaaaaatacactactctaaaagaagggacagccatcctcggtaacctgctgttgttttttgctaacctcccacctcccattctgagcattctggaattcttgctagtccctccccatgacctaaaattccccactaacgttcctcccctagtccattccttcctcattatataccatgctctaaggtggctttgctctcatggtctcatttcatcaccttccctcaaatgcagctgatctaagctgaaatgttattggacaactacccagtttaatgaatttccagtgtcataatagccctgtaggcgctcagcagggtgggatatctatgcttaaacaggatttatttggattcttaatctaatggaggttcaaatatgtggaatttctggtcatttgaaaaagaggattatgagcagagggattttcctagcaccctgccggagaagcagggacaccagtctctgaagtttgccgctgggtcagatcatgatgcttcagaggaactctaaaagagcactcactcttgcccactcttccctttgttctctagaccaaattctgaaaatacctcgtgtcttactaactttccaggcttggtaccctacccataagtcttttcctggcttcaaacactaacatttatgtgacttacatgccatgctcgcacacatcacatgtgggacactaagcatgatctgtgtactcaaaccaggcccttaataggcaacatctcatttaaaccctcccagtatcctatgcaacagacttcctaaaatctcacttggtgaaactagctcaatttgcccaactcacacagctattataattcaaatttaggctaattcattcattcaaaaaatagtttcaaaagcaatagaatgttccaaggcctgtgttaggtactgggtggtgaataagacagagcccactctcagagatctaatatactagtaaggaagaattaaataagcaggtataatgaggtcgtctgtctcccttctgttctatcaccctccgggaaactctggcccaggactctgccttcctgggacacagggaggaggcatgtgtgataacaagaacatgacctctgaaattacatgcttgcacaaaacagacttgatttcaaatcatggttctgccacttactagctgtaaagctgggcagcgacctcatctccctaagcttccatttctcaagaccttgggagcactcttccccgcattgtcccctcagctttcaggtctcagctcaaatatcacctcctcaaaaagagccttcccaaccatctaatctaaagcattttccctccaatccactcctcccgcatgttatgtatacacttccctacaattttatataaaaacctgaaattcccttaattattgagtgacttgctactgtttctctccacagttaagggactttggttcagggctatatccctagtgttcccaaccaaactgagggtcaggctgctatttctctcggccaataacgagatgcagataaactaggagaaagagagtttttatttctataaccagttacgggaagaaggcctgcaaattatcacagacgaaccccaaattacaaagtttttcagagcttatataccttctaagctatatgtcacgtgtaagtgtgcattcatctaaggatataagtgattaacttcttttaatctataactaggtctgagtcctgaagaccttcttctggagcatcagtaaatttacttaatctaaatggtctaggtgctgggctgattacccttatcttgtctcctgctgaatcatggaggtttgagggttccttcagaccgccaataaatttgtggaggcctggggagtttcttcagacccccagtaaacttgtttaatcctaaacggatcctgttaagaattccttattttgtcatgctttatgcccaggaaaggcctaggcaatactcttgatgggcttttgtgacatcccagcctttgtgtagggcactggctttttttagctttcaatatttaacttaaccgctcagtcagtaccgaaaagttgtgatggaggcctccattagtgaaacctggcctgccacactagctgctgggaatatcctggctcatagtaaaccttcaataaatacttgattaataaatgaataaatcaaccagccaactgaacttttaatatatcatttggtaaacttagcccaaggtttacttagcccaagtataacggcttggcccaagttataaacttagcccaggttagaatggctattagcctgctaacttacctaattgatctgatctaagtccagcccatgggtactttcgccccacggaggattacaagactctgacaaataagactttttccacaggaagttcctctggtattcactcagccctgtaatgcaaagtacacttttgagtacagtccaattaatgaatgatgttttaaagcgacatcggtgaaaaataatttctgaacctcccaaaagagacttaagactgaaaattaaaacagacgagctccttaataagagctaatattcacccagccctgtgctaagcagttcacagtgttatatcctttaatccacaacaccacttgaggcagatgctaccaggaattccaggccagaggttaccctttcactgattatctgattccaaagcatgagttcttgtcggataactatgacaatctaaattctcatcattctagatttatcgcaggttttcaccgagtacacaatttatgtaccatgcctaggaccttttgctatttgataaagtcaacaaaaggcaaactcccttccattctgaatacacgcctttaagataaatgagtcaggagatgtgggacgctgtggcacctgtgaagttgcagggtgctagtccctgacagctaccagctacctggaacttttaactacgctaagaatgcacaacgatgaaaaacgtgtatttctttatacgctgtctttactaaaacccatttctcaagcctttaaaagccacatacactaaagttttaaaggtaatgggggtaaatgctaagctaaatgggccacaggtgtcccaatctgaagtcgcctttagttctcttccaaagggacctcctcccatctccactcctcttgagtccccctaagtaaatgtgtctcgcccatctgactcttcgacacactgcagcttgcaaatgtgagtgagcggagagggaactagttaagaggcggcgggcagattctggggcccctcgagcaggccctggggctggcagcttcgccgggcagagggctgcagcgcagaaaagcagcgtgacctcggcgctccacacctccccgccatggctccccccagccacattccggcccggggaccccagcctcaccttgaagcgcacggcatgtcgcccggcgccggagcccccgctactccgacagttaactggagaaaaagctcgagggggcggggcgataacagtgttccctagcaaagcctcggcccggcgtccccgactcgcgccggcgcactccgcgcttcccgcctagaggcctgtcggtctgtttttccccgcccttttggagcctagggaccaatagagactcgcagagtgccttacctccattaggatttgacaatgagtggccgaaagggagccgcctacctcccttgccaaatccctggggctgatagaatggcgggcggaaggccggccaataaggctcccggaaccgggctgggcgggaccccggggtgccttcctgggttgggtggaccggtccctggttcgccgggtcctgcgcagcaatgcgctgcttgctggtggaattcgccagccgccagcctcgctggcccaggtgcttgacagcataaaggtcaaagtgtgttcttcatgctaacatctatgagaaaaccgaacgcttctttttcgaaagtgctcagatttattctgctgaatatcggttcgtacaaacgacagccgcattacatttattgtcacatcaaaagggaaaggccaaaaaaatatataacttaggcaagatttttgaactttattgaaactcgaaagacaaactgctgtctcttcctccagtgatgttcttcctcttcaatctctaccttccccaaaatgatgtacatacagcccttagatgagaaaacgtttatgaagatggttgtctcaacttccaaaccttcagccttgtctctccgctcaaccttttttaaaaataaaacttcatctgattttaatcgactattgccatcatcgtcgataaatgtttctgacagaatactgctgattctgagaattgggaaagaaagaaattgtccagatagttctcgatatacttgggaaggacatacatctttatttatttatttattcattatttattcaatatggtgtaatgtgacatgtgctaaatttctaaatgaaaggtgtcaataataagggctacagatctgggagcagggagtcatttcggacggcagaagatgcgtcaggaggaaatattcagctgaaaggactgcaataagtaaaaagtgggacgatgaaagggcagatgtctgaatggaagctgccaggcttcttccaggaacaacaaatgagtgccttttacatttgtcatgtgttgatgaataaaagtataccactcttaaactttcaaatatcaacaccaatccttgatgcttcctttaagcattttccgcaaaagctgtcttcctgaatcctgattgatgtctttgttcttcacatcatcgagatacttaaaaatcatttgaagaagccacctgatatctggaacaaagagctattaaattagtcccaatgcagccatgcatccagggggcccttgattaatgttaattgggatgacagcatctctgtcgtgtaaattaagaatggcacaaacaagacacagtggaacatgaacaaaagtcatctgcaggaaggcagcccatcttacagagtaagaaaggcacaactttgttgtgcacacagctttgttaccacaaaatgctaaggtgagatcagcaaaagcaagtgttagaatgtagcctgcctgctaaacaagcgcaatgatcactgcagaagagctctgctgagagggagtaaatgacaggaaaaccaaacagcagattgtaaaaataactcagtcacatcccggcttgctagagaagtatcataaagacttaaggaagaagattttactttgctattgttaacaaaagcctacccaagtttaagaggcaaagatataggaatgggaaaaaaaaaagtgacaccttagtaaatgagttttgtagcctgtgttttaccagctcttatcttctctgctactgaggaaacagtacccagtaccctacaaagctccacccatgttttggggagtccctaggagtatttcacatgtgctcgcagcaaccacatagcgtatgccgggcagcactgccccttgttcaatagccatgcatctgtaggtgtcactcttgctgctggctatcacagccactttagctggtactgagtcttcactgggcacagcaactgggtacagccactcctcaaactgcctggcttggtggtaatctatggcaaagcacctctcctttttgcgttaccctctttgaagtgagtacactatgtcttagagagccttcttttcatttgtgttttagcctttctcatcgccaaaggctcaaaatgaagtccgtggagtctaagccaaaaagtaattcctcaagtgacagatctctgctatgcttctctcttccactagctaaggccctcttactgggacagtggtatcacaccggctcactcttccctttgttgatttctctatttctcataggaatagatttctgtctattctcgtgagagactgaatttgcacaacctatatgaagggcattttggcaatttgatccagagttcctcttctataaatttatcttacagatagactcacacatatgtgaaaaaaaatatcatttaaagttgtttaatgtactgtttctagttacaaaaggttgaaaactacctaaatgccatttagagagaactagtcaaatacattacggttcatccaaattcaaagagtagcgcagttgttctgctcctttgggccttctgatcctgcatggatatgttaggtccagctaggaaacagaccctacacaaggcatttcaacaaagagaacttaatataagctattggttcattactattgaagaacttaaagccaaaaggataaagaagaggaactccaggaagcagctcatatgtaaggctgagagaacaaaaggaaaatgttgaggttactagaatgcggaggtttgtagagaggcctcctggagttggtcagaccgctgagaaagggccactgccccactggtggggtcctctgaggggacaaaatgagactctctgggaacgtctggaaaagagacaagctggagatgcaatgaactgccactgtggggtagaagatcactgttcaggtgctgcggggaggaacacaaacaaaacagagcatcccagtctttccctagcttcctttcttggcaaacataacaggagctggccatgtgatttgcacagtctgaagggtgagactggaactgacatgcaacagctattaacttgcacacttccatacaacccctaacaagcaagaagcacctctttatgagctacatagaagactctcaaagaaaagaagcaaggcttagaagactgtttatggtataccatcgttgaaataaaagaaagacgagtgaataaaagaaaaaaaaaactgtcctatgatgtcgctaatgatgtcattcacaggcactttctccctcactcatgagtccaactccattagcggcgctataaagaaaagagcattttattcagtttactggtaagatatggaaactttaagttatgatagttaccactgaggctattttccttaaataaaataactccattggccctttctagtttatcttgacatatacctcacgataaggctgttgctccttttagagacaaaaacatataaaatcctttgaggcaaattttatttgcacttgaaatataaaatattctcatctactaccattctattaaaaaaggaagttgaccacttcacaaattaataatctcctatcattttctagtagcagttgaaacagtgaagaatttgtatttgcctctaactatatttatttttatttacaaaagaaaagtgtatatgagcaaacacatcagacgagggttgaagaagggaggtacaagatgaataagacatagcccctgtcttcaaatataattataatcttctaatgggggatcataagtacacaaagaacacagaaaataaaaagaaaggagaaagtgagaaaggggctaaagtgagcaccttggtattctaaagatgcttttaaacctggagccagaaagtttgatctaaatagactattaaagagcaggcaggataaaggagctgaatttaaattccatcctgggaaaacctgatctagagacctttcactttttttgttctgccctgggtagctgaatccaagccaatgttccttgagaagtttcaactaacattgctgaagatcggttcccaaaaaggtgaattcttgctttctgttgtctttttttttcttgttgcttcggaaatcagtaaagctgttttagaactactattttatcaatatagtgatacacagccttgtgtttacatatatgtaattttcctgaaataccttacaaggtaactgaaatgccagtctttgggcttagtaatgctctttagtctgttaacattctctcaggtcacatttaattgggctttcattggtaaatcttgagctcgcctttgccaaaaagcaatcagtctgacaaccgctttcttttgcatttttccataggtatagctgatttttcctcctatgaatgaatttctgattgcacaactaaaaaaaatgacaataaatccatggattctgtctgagaagcaaaattgctgatacttcacattaatgtcagtaaaatcgaataaataggttctatgattaagacttagcaatgagccaagtgcaatttgccctcagacttttagccgtgagatgcctttgttgacaagggagtgtctggcttttgaatcagtgggcaccttttggagggactccaggttctcttgacaacaggactttttttttttctctcttttggtgagccgaaaggactcctcaccatacaaggccacggctgagtaaagtaattctagtaaggcataaaccactggcaagcctcacataccataataataatgttgtactgcagcgcacaaggtccagggaatacatttggggcacaaaatttctttcattttaataccttcacgtatgattctgttctaagaattccctttccttttcttcattgattatttattgtcctaatcaccatctctttgaaaagtcctcacagggacgcagatattttccagaattgctaattgtgatttgaaagcatgaattctctcatctcatcaaatcggattctgtgtcttaaggtcagtcagcctttctaagaatcttgtaaatctctacctttatgccaaaataaattttgaaatattcttttatcacgggtaatgtacatgcacctgtaatcccagcactttgggaggctgagggggcggatcatgaggtcaggagtttgagaccagcctggccaatttggtgaaaccccttcgtactaaaaatacaaaaattagccgggcatggtggcacacgcctgtaagtttcagctaccgggaggctgaggcagaagaaccgcttgaacccaggaggcagagattgcagtgtgccgaattgcaccactgtactccagcctgggtgacagagcgagactccatctcgaataaataaaaaataaataaaataactgcagattaagtccagattgctactattattctttctgaaatcccagtctttctactgataatggtatctgaagtatcaataagggaccaaaaatttttcagacataaagtcagtttcctctcctttgtggcttataattgttgactcccttaagagattttatctcttaaggcctggcacggtggctcatgcctgtcatcccagcactttgggaggccaagcaggcggatcacaaggtcaggagttcgagaccagcctggccaacaagatgaaacccctctctactaaaaatacaaaaattttccgggtgtggtggcgcacacccataatcccagctctcaggaggctgaggcaggagaattgcttaaacccgggaggtggagattgcagtgagctagatcgcaccactgcactccagcctgggcaacagagcgagactccatctcaaaaaaaaaaaagatttttacatgtattttgctggagcaattagtataaaatcttagtatcgtgttatcaattcatccttcaacctctcaacttctattaattgaatgaatgatggttgacagtgtacatgatatgtccaaatgtaaaacactgaatatataaatatgttgttttagtatcattgacactatctatggaataagtttcaggaatcgtatgtattttagttaatcatgctgtggtgtgctgagactgactcattccaaattcatgccaacctccttctcctactgcagaagctggaaactaaaaacccctttgaccttagacccctttgcaactgaagtgtgggtataatttacttctgctgatcagaagcacttgcataaactgagttagatgggaaaaaagcagagcacagtttgcattgctgtaaatcatgacagtagcagcaacagcagcgtagttctggagttggcactctaccagcagcttcctggtcatagcagaggtgaagtcggagcttgtagcaaaggtgttcaacttagcaggcagattcttggttccacgacttcctgactgtaggctcctttagtgatctgttctgtgatgtggccctagagtctacttcttcagctctcataatgattctttaagcacttgtatcaatcgtcggttgccacaataatgctgcataacaaacactctcaaatgcacaacttaaaataataaccatttattattgcttatgaatctctgggtcagttggccagtttgctgatgtaggttgagcttagctaatcccactaagcctgcttgtggatttgtggccagtgatgggttagctagaaattggctggtctcagatggcttcagctaggacaactcctcatgttccacttgggctctcatcttctagcaggatagcctggattgttttcatggaaaaggaagattccaaaaggaatccaaagtacggaggattccaaagtatgtgaagcctcttgaggattggcttcgaaacagcataccatcacctctaccatattttgttagccaaagcagattaaaggccatcccagattcaagggctagggaaatagactcaaccccttcacggaaggagtggagagtcacgttcgttgtaaaggaagaatgaagaattggtagactagtattgcaatactatcttcctcactactgaataccctgaaaataccctttctgttttgaaaagctagaataaatatattatctgaaatttaactctgaccgatacaatgccagttcagacatatgtgtgcatttgattccctcttaaaactctgtaaaatgacagtaactgaatgccagggcaaacacatgattcatctcaatttcctcttaaaacttcatgaaatgggccaggcgcggtggctcatgccgtaatcccagcactttgggaggccgaggtgggcggatcacgaggtcaggagatcgagacatcctggctaacacggcgaaaccctgtctctgctaaaaatacaaaaaaattagccaggcaggtcgcgggcgcctgtagtcccagctacttgggaggctgaggcaggagaatggcgtgatccggggggcagagcctgcagtgggccgagatcatgccactgcactccagcctgggcgaagagcgagacaccgtctcaaaaagaaagaaaaaacttcatgaaatgatagtaaatgaataaacaggtataacaggtataaaccagtgaggtcaaagagaatggcagaggggacaactgaaaatagaaatattaacaaatattgaagttatggagagtagtctgttgcagatggggtttctggaaagcagactcggagatgaagtttaacgtgctgaatgtctattagtgagtgttctgagatcaacacctgtggaagggagggcaacagagtagaactgggtagaagaagaagtgagctgcaaggcaggcctgacagcctcagccaaccccatgagaaatcatgaactaaaatgtttgtcagaggtgtcctgccttgggccaaaatgagcctccttaggaaggctgtaaccttgaaaaggtggctgtctgccgtggaggtaacctctaaaggggctgacagcagaaagcactcgagtaggagcagcaacacatccttctttgaagtggaatatggacagtgcatcactgaagcacgttactgtttaagcagtcagtgtacctcacaagcagcacatacttgaaggcttaccacacaaaaaaactctggtcctattgggagctagtttcaatgcagctgttagactcttatcttcaaaccttcaggagtgaagaagagtacctgtcagcatgagttccttttgccacaggtagagtcccagatggaacattgccacatcctgtccggttcctgccttagcaaagaactactcctcctactgccagaatcctaaaaagaatcctttatctttttcataagctttccagctacttctggttcaaaactctcagagacaaaacactggatctgcatctcctcctttccctccctagactggtctccccttccttgctttgtggcaaagtggttatgttttgctcctgggcggatcatccacagtcctgtgcttccagacattctggtaatgttggtgccattgaaacatgaggaaagccagatccaggaaccaacaggacatctgcttatgacgtccatagccaaagaaggatgggaattgggtatagagaaaccccagccctagaagagagcaagaaaaaaggactggatttgaggagctatgcagacttgtctttttatctatgagactataaaacaccataaaagggaaattgtccgtatttgtgacccaaaaaaaaattggctccctaaaattaattccattgcagtcatttataaaccagctactaccacttatgcctaattaccatgcagcacagtacaaccgtacatgccataaagcatgtgatcagttcattgattggaaagctaaactctgcactatagggacagccgatgtgcaaacactttgtgaattgaaaagtgttacagaaatggggcagttcttgtcattaggctataaagaatgtctccttttgtatccttcctcatctttgcgttcctaaacaatggaactcacatagtttcacttcagtcatctcttagtctcaaattatctaaacaatactttttctgattattattagtattggctacaattgattaagtccttgctcatgtctttaggttgtccatgctgtaccataatgtttcagtcgggaaatcagagccacttaggttgtacaggaataaggggcttcatatagaaatgcaagcttgcccagatgtgagagaggtaaagtagtgaaagtcgagacagtcacagcccaaagactggaaaaaaaagttgctgtgacttcagcctaaagcctggagtatggatagggagctgatgggtgaagactgagaatctgccatcactacagagtgagagctcatagaaaggactatggactcccacatctggtgacctgtctgataaacctcagcaagatttaccctgagaacaatggtctcctatcacttctgctaccaagtcttgcacaagtcgcaaactcaaagtctcattgactacttccaacccagaatatataagaatggagattctgggaaaggtagttcccagccttggacaggcatggcactgaggtgtggagtgaccaacaggctgtctggcatacggacaactctactatgtaggatgtagtgttactgttaatattttttggcagataaaattctgagatgtttaataacttgcctgaatcacatgctaatcagtgacagagctaaaagtcaaacccaggtcggtctgatgctcatgacctaccttaacaactcttctctaacagtccttcaaaatctgtataagtactattaattgcacaatatttcttctaatattatgtccctgtctctgtgactaccagaggcatatattttactatcctagaacattgtggataagagatatagatcttgggagtaaagcaacatgtcaggatgcattcctactctggggccagagctgggacatttctgctgccctcagtagcaggtgactgttaggcagcttacagggctgcattattagaaagtcctttttcctcctctggtcaagaaaaattaatatctacagtcctcaattctccagtctcttccaagtactgtgccctacaaatgcttccctgaatgtacttttggagggaggaaagggtatgcattcttaaacttcaaatgaatgtaaaaagctttaaggggactatttggagaacttcctatgtgctccctagacttgtgagatggagtggctattatctaattgggggaaatgcaatggggaaagtttgcagctgagttggtttaacagcagaatgaagagaggagggtgcattaggaacaatatgcataacaggcaagaatgtatgaactctcatgggccaagctagacagatggagaggaccaacctggagcatgttcaatcctacctaacagtattccctgaaggggaaatgtgacccaactgtggattccagaagttcaggtgttgagagtgagatcaatgtggtccctgaagtgcagccctgcccaaaaaagggagctgcagtcagaggtcctcactgggcaggcctccaaacacatccctcaaggaaagagccagcaattgtgcacctgccacctcagaggaaatcatcggattacaaactgccaagccacaaaaggccttttttcattaatcctctgttcttctgagcctagctctgaaaagtcagaaatagcatctagaaagcagagagtagtagaaggagaagcagagaagtagaaattcaattacgcatctctccaaacacggatatccaagccctaaccaggcacatggttgggaggtaggaagacaggaagaagggaaaagggaaccagatcagagttttatgctcatgagaactttaaaaatcatgaaaaggaggctgttcttgtgactaaaagtaaccaaaggattttttatttcctaactaggagtaactgaagaaatttggaacctagatgagattgcatccaggaagggatttagcagggagaaatgggaaataataaagtctttcccctattcagtccagcttgaaataaaatgatcataacaatgtaatagaaacaatgagagaacataaaaggactcttagaactaaaaacattataggagaatttttaaatggtgtataagagttagaaaataaagctgggaaatctcttggaaactagaacaaaaagaaacaatcaattaaaagacaataaaagtcacagtcatcaggaagacccagaatatgacatcgtaacacctctgtttaaaaaaagagaaaccagaaaaaaaatgtagagaagaaaattactgaagaaacaatgcaagaaatcttcccagattgctgacatgagtttccaaattaaaagtgcccaccctgcacatgcattaattcattcgtaaatatgtgaatgcaccttttatgtgctagatgcagttctagaactatggcagacacaaaacaggaaagtccctgctatggagcttgcattctactggagggagacaggtaagaaaaaagaattatatcatgtgtcagatggtgatagaaattattaagtaaaataaacctgcataaggaatatgtgatgagggggtgtgggggagggatcactgtttgaaagcgtacagttaagacctctctgataagtgacatctgagcaaagagggtgagagatgcaagtatgctaggaagtaagcccagcaagggcaaggttctttgtccaccttgtttactgacatatcccaacgactgcagcatacttggtactcaacaaacatttgttgaataaatgaatctgttccatatgctttgcataaggaacagcatatgcaaaaaccctgagacaagaacaagaaagttaatgtggcggagcagaggaagctttgggggtaattgtaggtgatgaccttggaggctgtggctagaatttggattttattccgagacacggaaatccattgcaaagttctgaacatcatagtgtcaaatacaattcacattgttaaaaaacttacccttgcatctgtgaagaaaatagatggcaaaggacaagaatgggagcaggtagaccctcccagtccaggcaaatattaccagtggctaaagtaaggtagtatcagtgaagaagtgatcctattattgatagatcttaaagcagagtagcaagacttgctgattaattaaatgttacgcgtgagagaaatataaaagttaaggatgaaccaaagtttttaacctaaacaacttggaggatggagggggaaacaaaggaaccagttgcaggtgagaagttaagggttattttggatttattgattttgagatgcctaaatgacaagtgagatgccacatgtatttctttgctaaataaataaattggtggagaaattgcatattcagtttatcctcctcaatatagtgtatctatctcaagggccacacgagtgacctattttaagctcatttccaacattgacaatgcagtagtcctcccctcacagctagagtaaaagctgtgattctctccttttacggtgcctgcaggattttttctttcacatgtacacccttcctttccacattacatcctccctctttcctctatattcttggggcataggtccctcttattttggtgtgttgcaggggaggtaaagggaagacaagcaaacccttcatttggccattctgctcttctccttcatttccctgactaaactttgtcgcttctccctccaatcacggatagagcttcacttttttttttttttttttttttaatattgagacggagtctcactctgttgcccagctggagtgcagtggtgctaactcagctcacggcaacctccacctcctaggttcaagcaatctcccacctcagcctcccgagtagctgagattacaggcacatgccaccatgcctggctattttttttatttttagtgaaaacagggtttctctatgtggccaggctggtcttgaactctgacttcaagtgatctgcccccctcggcctcccaaagtgctgggattataggcatgagcaccacgcccagcctgagctttcacttcttaaccctgacttccatcttcaaacccatcacaaaccagtcctttgaaggccaaggctttgggctgttctccagtctccttcacactcgggggcctctgcacccttccctgtgttgacttctcattgtaggcctcccctgggattcatcttggtcacctgctgtcctatctgcgtgcttcctccctcagaaagctcatccatccccatactgcagtgaacacctctgcactgatgactctcaaccgtaatgttcagtcttgacttccgtcagagcttggacttcctgagaggtagttaagcaaagtgatggtctagaataagcactaattcagatggcttgggtttaaatcccaatttaactgtataaacttggggtcatctttacttctcattcttcataaaatggggataataagagtatctgtctcaaacagattccttgagataaaataaaggataaaatacatttacatgtgtaaaacacccagtgtctggcacatagaaataataaaggttagttatcattattggacatcacactttcactaccaactcaatttaacaacaccacactcctcatttgtttctctctccctttaatcaattgtcctcctgtttttcatgttgtctctatttctcagatccacatcattgaacatttgtaataatctctgacttgcttttacttcaatttctttattcagtcagttaacagacagatcttgctaattttcctttttgttgttgttgttgttgttttgagatggagtctcaccctgtcacccaggctggtgcaaggcacgattctcctgcctcagcctcccgagtagcttggattacaggtgtgcaccacgaccccagctaattttttgtgtctttagtagagacagggtttcaccacattggcctggctggctcgaactcctgacctcatgatccaaccaccgcagcctcccaaagtgctgggattacagcatgagccaccgttcctggccaggtcttgctaattttcttactaattttttctttgatggtcacttaaatcttttgctttcctctttcgccctctgctatgcctcagtacagccccagtccccacaccaaggcagccagggctacagcctctttgtgagtctccgtggactcagctctcagccccaataatggaaatcttctttagatcccaaacaatgttcttctcttcactcagaatgttcagtattcccagtttccattcccatcaagtgcagaatccttcagctagagagcctttctagaacttccgcaatatggctccactctgtacaaccttatttccttccactttgctgccctgtctccctactgcaccaagaccacgtcacattgtttctggtctctgcttcttcattttgttctcgcctaaatttccctcctcactcttctctaccaatctcaatctacttgtatttagcccggctcaatctcagcttcctccctgagatgcacattcttcctattacttgcctcattcttcctattactgtagcacctgaaaccaacatttgaccccgatgacacattgggcatattattccatgtagtttcaaaatgtaagtcattttttgtgtgtattagattataaatccgttttctaaagttcagtgtccctgccccacccttccctactgcacacctggaaagccatgaatccatagaaaagactcataaattgataaaatataaaaatactactaataatcacactatactatatgccaaggagctttacatatattcatttgtttaatccttacaatattctatattagaaatagtagaaatattattatcctcattttacaactgagaaaactgagcacagagaggctaagtaacttgcccatgattgatcactgactcagagtaatcttcacattggagatatgtgaaggaatgcaaaaatacaatctaagaagattatactgtaaaaaatacctgaagacccaaggaagagaaatccaaaacctcaccctcacttcagtaatacaaaattttgtacttctgagttgtgaagggaaggaataagtaggagtcactttttttttgaaatcttttgagatagtctcactgtgctgcccaggctggagtgcagtggcacgatctcagctcactcagcctctgcctcctgggtccatgattctcatgcctcagatgcccaagtagctgggattcaggtgcccaccaccatgcccagctaattttgtgtttttagtagagatggagtttcacttattggccaaactggtcttgaactcctggcctcaagccatctgcccacctcaacctcccaagtgctgggattacaggggtgagccaccacgcccagccaggagtcacgtttttttaagtgcagtttgtcattttttatttatctgattctaaatgaatcacagaagaaacctaaaaaagctggtccccctgtccccatttttaggtgaggtcaataggactgctttgagagctcaccgggcccaaccatcagtctgttatgaaataagtatccctgtaaattggcaactacccaataactgccctatcccgaaaagggacaagtgctatgtgctgtgctctgaaagccgcacttctttgccttgttacaaaggaacagttctggctgttcacaaataatgtagagctatattacttgcatctgtttgaaatcagccaattatcccccaaaacagcagctagccttcacctactgagctccaggtcctgtccatcctcagaagggagtgcgaaggggctggatgatcccttgtgtctggctgagcggccaacaccctaatgctcaaggcgacagccccaaatgctgggctctgccccaacactcatcacctcccttgtgtgaaggaaagactacagcccatctccagactaggtggcaagtcgtagaattggactaatcagtcattttcctctgacctaattaggaagtgtacctcttggcttttagtttgagaagagaaaaccagtggcctgttacctcagaaaactttcccggtgagaggccagctcttctgctctgattgccacatggagattttgcaaatctgctaaaaatttattaaaatggttatgcttgcctacagtagtaggcatctttaaaatgaaaggaattaagaaaccttgttatataatgaatgttttataccacctcactggtattcaaactatttttttcctaagctcagatgatttccatatgggtgaaagacttcagattttaattgatcaaagataattaacaggactctgaaaaggtagttacctacatgtcattctacatccacaaaatatttgcgtgagaggatgtttcagctgtcgcacacaaccctgactgacatttaatggattattagctgtcttgccccagcatctattctgctttagtggcttctatcctccaacccgctgaaagtgactcaaggcactacagattccaaatgcagcctgccagattaagcaggaaactgcaggaagcatccctacattgtgagaggaaagtcagtgcagttcccctgagatggtgtgcgttaatgtaaccatggtttttaatctccttggatgctctctctgtacctatgataccatgtacagcatgctcaaaagaaacatgataatggctaacagctggattctttctgcagtttcttatcaagtgcctcatagtttgcagcttcccagaataaagagtgtctctgagcttaagcccagaagcttaatttataaactgagtgtaatgaaccttgtcagaattgtataccacttggcttgtaccataatatatgtgtggagtggctattgtatacaaagatgactttttcagcacactggaactttccatttgttaactgtctctcagccctggaatagtcatttgcttttgtttttatttcaatagctgccatttagcaagctgccatgaagatagccatctcatctgattcatttggggctacaattcatgtattaaggttaaatccatatcttttatccacttgggtgaagaacatgaaagatcctatacaactggtctaacacctgtgtgttctctctctaaaagttaatacccaattcagcttggtgcaggttttaaaatttaaataaaaaaataagttaatattcaagttaaaccttggtctatgtctaatcattacaatccttctggaatccaaaatgccaaagcatttgccccaaaaagcagcctggaaccaaggtgtaatgaagcatttcccggtcccactggacagggctgtgaatcatcttcctttcttacccagttggcacagataatagcaactgaacagcattttgtctccggaacagtataatttccttaaattaccattagtactagtgttgttttcactagcagcttgtacagggccagacatatctcagggagaccaacaaatcttcagaagcaacccgcatgtggagaaaccatgttgcagagtttgaaacctcttagatggagtaagcaaaatcatcctcctagctcagctgcctgggaaacttgagcccctggacctgaacatcaccacggctccaagcaatgacaccatcttttgttctctggtttattttctgcctaactccttctgtcacctgcctcttccctagggactgagctaatagaagattggacctctctcagcaagtccatctggttcattgaaatttatctcacaaagagtagcaatttaaagatgggaagagtggcacaaagtggtttagtttctataagtgcccccaccccccgccactttgtgggggaaaaaaaaagcaacagcttccctttcactgcagcagcaacctgtaagtaatggatcatttcagggcattcagatctggcctacattggcgctgatatttatccggctattctggtattttcttcaggttaaacttgtactacttcagtgtcgcactgacagtgacttctttcttaatgttcacaacctggagggagtgaacaaggcatatacaaaaggtaacaaacattcacaatataaacaaagagcaaagaaatctttatatttccctgtagattcctgctttttaagaagcagtggtggttgtgccacttattcattttttagctatgagtcggatttgagcattctcctccctagtctgtggctagaatagcgttttccaaactatgggccctactgtaaagaacacacaatctgcctgggtttgaatccttgctctactacactagctgtgtgagttaggcaagttacttaatgtccatgtgcctcagtttcctcatctgcaacacggggaaaaaatagtgcctatttctttttgtttgtatttgtttctgtttttgtcttttgagatggagttcactccgtcttgttgcccaggctggagtgcaacggcacgatctcggctcaccacaaccctgcctcccaggttcaagcaattctcctgcctcagcctcccgagtagctgagattacagcatgcgccaccatgcctggctaatttttttttgtatttttagtagagacggggtttctcatgttggtcaggctggtctcgaactcccgacctcaggtgatccacccacctcagtccccaaagtgctgggattacaggcttgagccactgcgcccggccaatagtgcctatttcatgaatggtagtgagaattaatttagttaatataggtgaaaaatgtaaatactgactggctaatgtaagtattaaatattatcattattcaattctacagaacagtagttccaagagatgttctagggaaacaagagcctgtggtcaaataagattgaaaacgcttcacaccaacatatgtatcaaatctacaaagttattgattacataccactaggaaagaaaaagcaatgccaattaattaggacacaatgctttccccagggatttggcgattttcctggtttcagttgtgttgccccttggtgagtggtagccactccttgtgcgcctacctcggtaacaaatatagccctagtactgggtatcttcctttcttaagttctatcaagcatttggttattgctttgcaagaagtaaggaactgtagtgctgtgggctagatgtttgtcctcctaaaattcatacattgaaatctaacccccaaggtgatggtaacaggaggtggggcctttgggaagtgattaggtcctgagacagagcctttatgagtgggattagtgcacattaaaaaatgcctgagacaggaatattagcccctattcagcctgaagaagttacagagggtgactcttcatccctctgtaaccgttggattaagggtccccttgtaaaaagggaggggaaaacatgtcagaggcatttgaaccaggcaactccatcttgaataggagctgggtaaaataaggatgagaccgacttggctccattccaggagattagacattcttagtcacaggatgagataggagtttggcacaagatacaggcacaaagaccctgctgattaaacaggttgaggaaaagaagctggccaaaacccactgaaccaagatggggatggaagtgacctctagtcatcctcactgctcattatatgctaattatatgcattagcaagctgaaagacactccgccagtgccatgacagtttacaaatgccatggaatgtcaggaagttaacctgtatggcctaaaaaggggaggaacaggaaccctcagttcaggaattgcctacccttttcctaggaaactcgtgataacccaccctttgtttagcatatatcgagaaataactataagcagcccatgtggctactctgcctatagaatagccattctttgtttctttactttcctaataaacttgttttcactttaacaacaacagcaaaaaggcctggagaatctcattgacgcttccaccatgagaagacatggtgagaaagcaccatccatgaacagaaagtgtatccccttaccagactctgaatctgccagcgccttcaccctggatgttcagcctccagaacttcgagaaataaatttctgttgcttgtaagctactcggtttgtggcatttgctatagcagctcaaatagactaagacatgtagttaacctacaatgatgagcttctctgctctaagatcttgtatatacccgactgctctgtttccataccttttgacatatacataacttttcatgtcaataccaattcatggtgtgatctttatgaagatactttaaagagcatgaaacatcattctatgctgtgctaggaatatacctaactcagctgatgtgacaacaaaatagctatggccaacatcgcatgtacccaggcaatgacaaccatggcaaaactgctgctgaccaacaactgctataagataccactgactgtaagaagcatcctacctcagagataaaaagtacagagggaagtgctacttagaattgatgaaatatttattccccctttaagagacaccaatgcatattaacatattaaaggtgcaaggaagccctgcagtaaagaaaccctctccctgctttaagccaatattgaaccagacagccctctttacaagttatacctatcaacagttggcaaattcatatcaacatattctactgaaatagaatctaacaaatctgagcataacaagtaatcacagggaattttttcaaccgctttatagtcaagcagctatatagtcaaccggaagactgacctggttgtggaatcaaagacagaaaagtagcccccacagaaatcctaggactaatgatgataagtcaatatctccatattcttaaagaagacacttgccggccgggccgctggttcacacctgtaatcccagcactttgggaggctaaggcaggtggatcacctgagtcgagagtttgagaccagcctggccagtatggtgaaactccgtctctaataaaaatacaaagttagccaggcatggtggcacatgcctgtagtcccagctgctcaggaggctgaggcgaagaattgcttgaacccggaaggtggaggttgcagtgagccaagactgtgccactgcatccagcctgggtgacagagcaagactccatctcaaaaaaaaaaaatacaaaaattagccggtgtggtggcatgcacctgtagtcccagctactcgggaggctgagacaggagaattgctgaacctgggaggcggaagttgaagtgagccgagatcatgccactgcactcgagtctggcaacagagcaagactttgcctcaaaaaaaaaaaaagcacttgcctcatccccaagtccaagtttttatcacgataagactaactccttagaaccagtcaaattccagtttaataaacatatggagcccttgatatacattaagtcctgagctcagcaccagagctacgaaatgcttaaggacctctgtttcatcatctgcaaaaacgcaataataataataacacaataataatagattactgtatgtatgcagtgaagtactgtatgtacagcacttaatatagtgccctggctggagggttgcaagtgtcattccagtgaggaagatggaagggaaatgtaggaaatgccgagaagcacgagccactgggagccatgggggccactgtcattcccctgtcccttattctatagagcgattgctatagaggctgctgagcaaatggcttactgtcttctggtttagttttactttaggttcaactcattcaagttcttttgtgcccacaaaatcacaagaatgaagtgagctttagctgggctggcatcagtcatctgtcacctgcataggctggggttcagcagtgcaagcaatgacttatttcatcttcaggtttgtatttggtgtgagaacctgcagggagaggggatcatttggcaagggcagggaggggcatataagcatcgggaggtgagccagagtcagagtcagctcagaggccttcacatccagcccagatcaggagctaagtaaaggtggcaccttagtactgggtcctctgaactgggggccatccaggacttcatgagacatccaggcccacttaactgggcccttaactggagttagagccacactaggtacacagattctaaagacagggtacttgtacccagggtacccacttcacagccacactcccagttctttctccctgtccaaaggcttaactagtcactcctactgtactgcagtgcttctcacactcacagccactcggcggaatatgtcaggagcttaaacactcagcctcctgctaggaaagagaaactaatgtcaggaaaatgtttaaaaggagagcatttgaaggatggggaaaccattaaattagagcatgcttttttcccatttttcattttaagtgactcaaaagtaggggaggaaaagggagagacaatcaacactgcagaaatgaccactgacagctataaacaaatgtctgaatgttctcttctagcaagatagtactactttctgttacacagcgtgagatctcattatgttcttttgataactaacactacactactggtaacatggaaaacttattaaaaatattcattagagaattaatagcttcatttcttccgattaagtgttgtaataaagatatcttgtctttatgtgccaaatactctcaaaagaatgaagaatatcagagttttaaaaatctgattgaattcatttacaaacgttaactactagaaacaacctggcataatatccacctgattcctcatagatgggtaactgtgttattgatttgatttcactcatcctcagggattagagcaatctacttatggtgactcttgcttgcttgcttttctttttctttctttctttctttttttttttttttgacagtctcctctgttacccaggctggagtgcagtgacagtcatagctcactgtatcctcaaaatcagagctcaagtgaccctcctgcttgagcctctcaagtagctaggactacaggcatgcactccttgcccagctgatttaaaaaaaaaaaaaatttgtgagacagggtgttgctatgttgccaggctggtcttgagctcctggcctcaagtggtcctcctgcctaggcctcccaaagtgtgggattataggtgggagccactgtgtccagccaacttcttaataactgaagcaaaacacacatagatgttgaaacttcagtaataaagttgataacatcaagttgccttggcttctcctgtagacattaatagggataaagaacaacttgttgaatcaacaaagattatcccaaacaaggaggaaaggaagagcaaggtaaaagagaacaaatgaatggaaagctatgtgtccagatcacaggaatgaatacaggataataaaagagaagaaagatgtaggtgaagggacagggaatattcaaggaaaagcttagtagtaaaggcatttacaaaccagtgagggaacttaaagagaccagaaaagggagctaagcatttttgtggcagcatctggaactgcctggaggatggaaaaggccccagagaaaaaagtgacatatatcatgggtttccatggtgatgatgacagtgcactatcagagcattatgacttcagaatagaaatgaggatataataatagcatacactacatctcccttttaaatccctcccaaagctcttagtatttactcattaattttcacaacactatgaattagggagtattacctattttagagatcaaaaaatcagaaacaattgaaatgccacaatgcctgaaaaagtatattgctgctaatctctcaccctgcactataaacttgtggataattgacataaagactatttcactggtgcttatgctaagtaatatgatgagtttttgagctaaccatttttgggaaatgtacgttggaccactggagaaaaaactttctaacaaggttcttagatttcttcttaattataaaacatgagaaaacagaaatttcagccttttcaaagctgagcattgttttccaaatgttttgcatcaaagattacctgtctgtcttccccatggttgcttttattgcaactggcattctttcaggctttttaattttttttctgggctttgttcactttactcttcttcccccctcttccccctacttcattcatctgttccattaacccccttcaaacacaccctcaaaaccagggatggggcctatgactatatcactataaaattctattactactcattcttagaatgattaggacactcattaacctggagaggaaattcatatacagttgaagaagttttggaatcggacaagctgggttctaatcctgcctctgacacctgcagcaaagtgaccttagaccaactacttctctgatcttagttttctccatctgtaaagtaaattatatttgtatgtatttcccagggttgctgtgaggataaaattggataatgtataagagcatttagcaagagttattcctgaggctatgaaaacgcaggcttccctatctaggtgctctccttccactttctcataccctattttgcaatccccaacttgactctaaagcctttaacactaatctcctttcaagggtctctctctgttcccatcttgaagacaaagagcaagatgctcagaaaagctatgttcacattcagtatctattgggacctcaggaagtggctgaggactataaatccagagaacaaaattttactgtgtttcctccttccaaaccatgtgatctgggtaagctgcttctcagatcctcaagtttcttctgtaaaatggcatcacaatgcctactcatagaaaatttttttttgagacaagtttcgctcgttgcctaggctgcagtgcaatggacaatttcagctcactgcaacctctgtctcccaggttcaagtgattctcctgcctcagctcccaagtagctgggattacaggcatgcaccaacacacctggctaattttgtatttttatagagacgggggtttttccatgttagtcaggctggtcttgaactcccaacctcaggtgactgcctgccttggcctcccaaagtgctgggattacaggcatgagccactgctcccggccttacagagatcttatgaaagttaaaagtacttatgaatgtaaaaatggcttatacaggacataacacacaatcaatgttcaataaagtgtgacctgaacgtgactgtgaattaaaaattttcctatcattctcactttcctagaatttaacagtaatgaagtaaattctggtatatctgtgatgcagttactaaaatcctagagtagaacattattaacatggggaaaatgctcatatctattactaagtgaatagtattttatattatttttgttttttaaaaaacactcaacaatacacacacacacacagacacaaaaagggtttttaccaaacttttctgtactaagcattatccttttctatttagggacagaaagttaaaatagaaattttaaaaggagctatggcaaaaaaaaaaaaaaagtattgtatggtgggtccatcaagcatgacaatggaaggaaggcataaaagcagtggggagtgtggagagggtaaggagaagccaagagtgggggaagggagaggagaaaacaggtcagagtgaggacgaggtaagtcagggctcagagtcagaggagccttgcttccatgcgtttgttgctgggattgccaaaatgcctgcggagatacagggtcgcgtctagccatgcaggccacaaacattcaaagttcactgggggaactgggagccggaggaattcgagcccagggggctttagatgccctgatttttctgtctcagatccacagaaagggtgattacttgcctgcttacgcaaaagctaacagatgacctagatggcctcccatgtggctttcagtctaggagactgatttactagggttttgatttattctcctccaatgagcaagaaaccaaagctatcaccgctaggtggcatgccccaaatactattaaactttgaaactggcagaaagttggtatctcagggaatcacacacactctataagtcaaaagcactgctagaggcaacagatgatcatagaagattttcagtttctcactgttaaaaacaaaaatcatcaagcaaaacactgtaacaataacaaacactcctttcccaaataatatattaaatgcgtttctcatggcacatcctggaatccccctgggaaacatggcccccatacccctatcagtgcctataacatctcctcctttcccaaccaaaataaacaagtgtcccctatcatatgccaaaagcagaagaggtctctgatgtcatcaaagaataatgtacaaccacagatacaagatttgcatgagctaagtaggacaagaaattccccacacaggatctattatggtcgagaaaggacaagaatggacccaggccagaaagaatatacttcttttgacctaataatcttctctttctaaatatcatgccactgtcaggatctctatattaagctagagctgttagtcatttacaccttaatgtgattacttttctctgctgtcttttctccggaacgttacatgtcattggttattctacaagataaaattttagttgaatggctaaaaagaggaatgattttagagcacatgaaaggagtaccagaaaggacaggacagggtagggccttgaacttgaggactctgcatatggctgcagaggtcaccaagctcttggcatttttgaatgaggagaggagagtgtagatggagaaataataaagggaagtgctgaaagaaagggatgtggcaagacacattttgcataattcatagattgcctaggactatctggatgcctagtgatgaaatgtgaagaaatacagacaatttggtatttccaactatgtaactctaacaggaaattccctgtattgtcctatatttaaataaattaatatatgagatgtgacaataaatacaagggcagatttttttaagcaaacacacatgtatgacacacaaatgagttattatccctttcaaagtattcacccattttaataatgcaaaccttttggaagctcctcttttaaaattgacacatatcttttgaaaacccagtgctaacacacagcattctttctgaaagtggatttcatttgttgaaagagtcaaaagttggctgggtgtgtggctcacccctttaatcccaacactatgggaagtaaaggcaggagatagctcgaagcaggagttcaagatcagccttggcaacatagcgagaccctatctccacaaaaaaaaaaaaaaaaaaaaaaaaaggcactggcctggtgcggtggctcacacctgtaatcccagcactttggaggctgaagtggaagaattgcttgaagccagaagttcaacaccagcctgggcaatacgtgggaccccatctcaataaaaaatataaaattttgaaaaagtcatttggagctaaattggcaaacagaaaggatgatcaataagaatgttccatttttggtcaaaactgaagcacgatcagaagtatgtgctctagtatcacactgggccacaatccttcttccaccattttattactctgtgaacataagcaagttatgaaatcattatttgcctcggttctctcatctataaatgcaaatgataataatacctacctgataatgttgctacgagattaaatgacataatgcaacaaaatacttacatggtactgtaagtatacgtggtaagtaagtatacacggtactgtaaggggcaaatgccaaataaatagtaataatgttagtagtggcaacagcaataatagtagagtggcagcagccacagtaatatgtagcttgtaaacctaaggaggcaatttttaaaatagtagcctcccaactagcaactttcaataactgcaccaatttgcatgtgtattctgacattttttaatcttgtttttttgtttcttaacccattcttatttaaactcagatggcacatatttccaaagagttccctccagtcagtgaagaatattcagagaggcagcttctgtaccagggtttaaaattattgtaccaatacattagaattcatgaagatgctctattatctagacagtcaaattatatgtcttgttaattcacaataaatatgtatcaagcaaatgccgatcatttctaaaaactgctaaaacagattaaatcagtcactgactaaaatagatctactcaatcatatataattattgaccataaattttgggctgtatggtctggtctctggggtaacaaccaagatatacggatgaaccaaacagatatagcagaccaacaggaagttcttggattctcgaactacttccagctaagggacacacacacacaaatacatagggcacctctggaagaacaccaatacactagcaatagtgattgtctctggggagcaattatttaatactactttgaactttcaagttaccttatgcatgcgttaccttttcaaaaagtaaatagaagttaaaaatttaacttttatatacaacaaaaaatggagtagtttcttcaaacctgctatgctgattcacattattttaatgatgtgaaatatctgtgcttacctcttcacttagaaaattaaatcattcatacaatataatactgttattgatcccagtccattaattactcctaatttcccttgtaagacataataacagctgtgcaacccatcagtccacatgccacggtgatggcctgttgaaatctttgctaaagaatttggtcatggaggggttatcaggatattgtcatctttctgggtaacatttccaaagctggtgagcagagtctaaagccaactcagcatagccatccagcatcctctcatccatcagctgcatgtcttcccaaggtgctaagcaatgaccttcctccatgaacatgaggctcattttcttctttgaggctcattgctatgttctcaactccagagagtagtattccttcaggtttaaacttgccaaaaaaaaatccataaatcaatcagcaaacatttataatcatctcccacattcaaggtactgtgatggatgtttcagggatgtcaagaaatataaaagtggtttctaaactctaagagtttattgtctagttagagaactaaaacacataaaaattaaaacatggaaccatacaagtagaatactaaaagtaccaaattaagaggttaagggggagaggcaataatatttatcaaatggctgtgcactgtgctaggtgcttcacatgtccatttacttaatcatccttccagttccactttgaattccattttatagacttggaggtgaagaagttgcctaaaatcacacagatgatcatggcagggcttgcgtttaaattaaagtaagcctattccaaggccctgctcttctgactcaagctttgtcttcccaatatataccacgatcccgtagaaaataagtgctctaaggattaattgaaacaagttatcactttgaatggtagcataggcatcatgaacaggatgtgaaatttgagaaaagcttttaaacaggttaaaaacccaagatgagtagaatgttataaggtaaaaggaaggaagaaaaatctatttccatctgtaagaagtgcctgtactacagtgtagagatggaagagcccaagctggtgagacgaccattctgtttgtgcctgatctggttacctgctcatctcagtacaggtatacagcatggtcctggaaggcagaggtgctttagggaccagccaacccatgaataagtgggctcttcttgggaggcagattcctgcacatacaataggaaaggcatgggccaaacatctccaagccttatatcttctagggattcttggtgtatgtcagtggcccatcatacaagaccaacaattttacttaattaaggtaatgaatatattaaaatgaacatatagatattttggagtagaatccagcattaactggattttgttagtacaaggtattaatgtaatgccatgcttgtaatgggccccatgagcctggcccagacggctgggattcatagtttgtactcctctcccattaggggtttctcaggtgaggactgagaggtgctgatatggaggagacacacatgtggcatagcacatgatattgggaggcaaaaagagaggaaaagagggtctataatggccctccagatctccatgttctgagtctgttgtcatccatactctcgtgttgtttgtttcttgccttgactaatgaataaagtctcattaggaacactccatgcgttactaggtcctcatagtcatcttcggctttgcacttgtctcatatcccacatctgatccatcagcaaatcctgttgtctctaccttgtaagtgtaccagaatccaacagcgtccccacctgtactgccaacaccccatcccaatgttcactgtcctcccctgcttcatcgccaccgtggcctcccagttggcatccctacctctgcccttgccgagagagtctactctccacagcagccggggtgctcatgtgataacatgcatcacatcataggctgctctgctccatgcccccaggaacaggctatccccctcagagtaaaagcccaggcctccaaatcccctgcaaggccccaccggtcctttccaaccaccccatctgtcctccctctctcaccattacccagccacattgcctgtttactgtttctgaggaagtcatctatctcctcctcagggctcttgtacattctgtttgttttccctgacacgcccttcctcagatatcctgtggcattaccctttccatctctagaccttggctcaagtgtcactttttcagggagacttccctaaccattcccaacatgctctgctatctgctctgctatcaacatctgacaatcacttattaaacatgtttattgcctgcttccctctaccaaaatgtcagttccatgagggtaggattgttatttcactcattcccagctccttgagcaatgcctgatgcatctttggcatcaacaaataatagtcgaataaattcatctacctggtagtccttggctggaaaaagttttgattttttgtctttataaagcaaagatgaaactaaactacctgccaaaaagacaaagagaattgcatttaaataaaacttaaaacaagttgcagaatttgcatagtataatctcatttcagtttttaaattgtatgtgtgggtatatattattgaacactaactgcatgctagcagctgataaacggactatacatgagctatgtactatactcatataaatgttcataattgcatataaaagcactggaaaacacgtaccaaactgttagcaagtgggagtgaggtttgagggattgagagaagactagcttttactttacaccattcttcattaattgaatgctttacaatgaaatattttataaatacaaaaagaaaaacatctgaagaaactcaatatcagcgccattttactgaaaatttttcatcttgcagttttaacttctcacagaatcctttcctttggacttaggcctctgaacctgtgctaattgcactctgtcaggaattcgtccttggcgaccatagaaatattacaggtgtctgtgctacccagaaagcaaagggttgtggtgctttcttttttccttgagttacattgcgactggcacagttatgaaatgagaaatgttacacacaagattgcccaatccccatttttggcttatctttatgtcccatacattcttttaagatttctatcgcccagtattgtcgatttccacatccacagcctaacaacgtggtgcaatcgccctttgcgacccgcagaccaacagacggatgctgccctgctgcagtttcacagcacaccgggtctttcccttcagctggacagaggcccagccaggccgtagggaggattccgaaggtctctctgcagggaccggcctctcagaccgagaaggctccacccaggcaggaaaggacactgtatgtgggcagtcggcctgggccccatggctcgtgtttgttgctgaattgggcaacgtgggctgcggtcacagggcaacagagacttcaccacctaacacatcggggctggtgcagctgaggagggtgcttctgcctcttggtgaccacgccctttcccaggctgggcccacaggaagtctggccggaagggaggaggcactgcaagctgtgggaaccacaccggctccttcactgctgacaaaatctactccacccccaccgagaaactagctcagaaccagctttcctcctcctccgcagcctcatgccctgaatggctgacttgggggatgtttacactcatttttttcatacttaaggggtgtgggtgccagatcaacttgctcaccactcagaccgcacacaagaagccttatgttaaacttgttcaacctccagtaaccaagtcatgcaagtggagaaaactagatagcattgccacacacatatacatacacaggcatatatagacacatatatatccatatatatgtgttttgtgtgtgtgcaattatctttatacatatatttaaaaattttatatatatatatacacaacacatatatatataattttaatgctaataatgcttgccaaatgcttggtttcagttgatgctggtggagtgtacaaccttggtacaacctctctgaaaggcaatttgacaacagatacaaaagccttaaaggttttcatatccacagtaattccacttcaagaatttaaagaaacaaaaatgtatatacaaggttgttccttctaaggttacagctacaagtatagactactttaagccattcaaaataatcttttggaaggtttttaaggggataaaaaagtcaccataataatgaaaagccctacatttatataaaaatgggcatagtctcacataaaaatatgtgtgtgctatgtatctatgcatgtgagtgtttctgtgtacatagagagaaggagcacttcctttctttgaactaccctctgcccttggtttccaatcactgcattctttcctagttttcttcctatccactggctgctcctttgttctcccatattgcatccttctcctcttcccaaccaatcctattagagggctcaacctctgtcctcagacctcctggccatctacatgtcactcctgagccatctcccctacatcctctctatgctgataatccgccagataaaatctccctgcctgtctcttcccctaagctcccgactagaaatcctcactcaggtgtgaaattcttacttggcctcttatatccaaaatggaacttttgatttccattgctgtctcctccccctcacacacaccacacacctgcttccgtctcattgtttcccatctcagtaaatggatcatcatttcacaaagatgggactagaaaccagggcatcatatgcttgatgccttccttcttctctcatacctacatccaacccattagtagcaagtcctgttgtctctatgttcaaaatatgcaccaaatcagcccctctcctcatcagcactgcccactcctctgccaccagcatctctcccccagactctatgagagcctccccgttagtctccctgaattcacactgcccgcctacaatctgttctcataaagcaactaatgatccttttataaaataaattacatcagaaggcatgaaacctataacaaaatgttaaaagttatccaggaatgatgagattatgggctgttcttattttattcgtctgcttctctactatttgtcacatttctaacaataaacacatttcacttttaccagtagaaatcaaaatgttgttttgaaaaaacaaaattacaggtttcaggttgacagggtagggtttagcttccatgaatcagccctgacaaaccaataccaagcaagctacagagcagtaagagttcccaacctccaaaggcagcagcaagaagcaaggaagaatgtcctaaaccaagacgcaaatacatggcacttgtgatgccacttctgcctcgtatacacataactgacatcactaatgactggcaccattgccagctgagcctggatgcagcctcatatccttctcaacacagggcagccactatcattcaattagggttgacacttacatatttaccatctgtaataagcatctatctcaggattgtggagttaaattattatgctcctttataaaagaatataatgcaccaatattttcaagttacttttacatctaaaatctcatataccttcacaaaacctcagaagtaggaagagcaggtatttttttaatttttatttttactttaagatctggggtacatgtcaggatgtgcaggtttgttacataggtaaatgtgtacaatggtggttggctgcacctataacccatcacctaggtattaagcccagcatgcattagccatttttcctaataagagcagtatttttaccccccttttaatagaattgagggccacaacagttaaagtcacacagcagaccctggtctcctcatggccacactcccctgtgcttttctgtggttcccataaacctctgaggctctgaaagaggtcagaacctcacatcccagcagaggtaaatgtaggggccaaggaagcaccaaacctggacagagatgggccacaagtgatgcatagtccgttactattgacaatttgaaaataaatagtgaagacacagatgaagggacattcacaaatttcataacaaaagcatcatcctcttcaggggcaggacctctagaagccaaacatgtttgttggtcaccatagaaccatgaactgcctgccacccctccatttgacctattctgaagtagctttttttaaggctcccaagcctgcaaagaacagattgctcaattggctttagcatcttttcacactttgcgttcccttctctgcggttgtacacaggttcaatgcccaagaaaaatgaagtatccacataccgccatgaagcagaattcaaatttccactgctgtcccatctgcctgaagtaagccgctactccataagccactaagcaattaattgctgtcagagatagtttgacccctgtccttgcaagccaattcatgaaactcctagggcaggaaataagtggagaaaactcatattcccaaggaatgggtgtggtgctctcaaacagaaaagactgtcaggaagattcctttctgtaacaacaggaccacgtggcaacatcagcaattggagaagtttgtcttctcttcagtccctgcttgacttccttcccctcacacatacacctcaccctcccattgattgctccacctgctcccacccccctaaggcattctctgcctcccctcttcagatacccccaaaggttggatccttttattattttctcacctttatgccttttttgtaataaaatactctgtctctttggtggattgcaagtgagagagccatcctttgaccagtgaatttttctgatattacagtaagactaacctgatccaaactctttctacatattttctattttaatgtttatttatttatttattttgagatggagtttcgctgttgttgcccagactggagtgcaatggtgcaatctcggctcacgcaacctctgcctcccaggttcaagtgattctcctccctcagtctcccgagtagctgggttacaggcatgagccaccacgtccggctaattttgtatttttagtagagacggggtttcccatgtcggtcaggctggtctcgaactcccaacctcaggtgatcagcccgcctcggcctccaaagtgctgggattacaggcgtgagccaccacgcccctcccgctctttctacatatcttgatgcaggggtggagtaggggtacaggaaatgtagagtccctggatcgtgctgccagcccacctcctttaactttattccgcccccatctgccttaagaccacagaccccaggatcagagaactttgctccaagtatgtctttaccctgcccccagccactccacccacccctaccttggcaaaggacagcctaagaccttcagatgtgctgggtgacagtgattacaccgtaggcataccactgccgaataaatgatgggctgaagtctgaatcccaggactggaacaccatctggtcctcccacttgttaatgatatgagtggactctaatttcttcttcagaataataatgctaccaggtactgtgtgcccatatgataattaatctagcaccgtcagagaataccataatgccaattatagatgacagagagacaaagggagatgaaagaaacaaagtgtgttttgctgaatgaaagctatactgtatcaataaattgtttatagggtgttccttattgccatgcacccaataataattagatgctctattcaaaatgtgccacactaagtttgttgtaaatttattcagttataacagctggatctatgctgggccatttgctcacaatcaaaacaaaaaaaggacacccttcctccccattccaggaagaagagaaatggtatcgctaacatgcctcatgtacagtctcctgagttgtccagctccccatttgcacttttctatattactctgtgctaccacaaacctctcagctccgtggatcccataaattcccaggtttgctcaagggcccggacgggcaaagggaaataggtccctctgggcaaacaatgatgtggcttaactgcgctgacaatgctgatcaaatggctggcattccccagtgggaagggaaggcaaagaaagggaagcaggagcaagcaggtgggtgagaaggaagttgtttgcacttgaaatggtcggtgacaagatatcccataaaccaccagatgtcattcagatctactgtcatcctaaaaaatggcagctccaggcctgcctgtttcagcagcgaggtttcacatctgggtcagccactaggctggatgtcaaacacaaggaaacatgataactcggggagtgtagtcatatgtttgctgactgataatcatgggtcccaaaacaacaggcttggaaggagtctagtcccccacacccagcagggagtattggtcatagggttaagacaaaaccatgcacaagaactcaccatgtggattccccactcccactccactcccactcacaaatatcttagacatactctgccagggcacggaggcgtatccagtgtcccatcgaagcaaaactatcatgggcctcctactgccctaagagtgaaatccaacccatgaccagggcctgcaaagcctggcaaacctctcctggtgctgctgcccccttgttacctgactcagcccctctgggctcctttccaccccttttccctttctcagagcctctgccatgacgttccctccgcctatacacctctgacaccacctatcctcacaaacagccccagtctgcacacatgtcccagggccttccactccttcagtcacccagctaatgctatggaggctgcagtgcccaggcacagcagtgaacagcaaagccctgccctcgtggagcttacattcagttggaggagactggaaataaacaaataaaccaggaaagagtaaaatattctgtcagtggtgttaagtactgtggagatgaaagcacagcaaggagtgaagggggtaagcaagggtggggaggggggtattacttccttatcaaaagatctttcccgaggttctctctcttagcctcatctatttccttcctaatgcccatcacaatgtgtaactttctattgtatgggtttgttgttgttatttttaatctgttatccccactagtatgtaaagtccatgtacgtaggaactatgctgccttcttttccatgtttcccagcacttatggctggactagtaggtccttgataatttgttggatgaatggaggaaggaaggcaggaaggaattgagggagggagggaaaaaggagatggggagggagggagaggctgagaactacagggagaagcaaagaaatcagagagccaggacaggacaaggtgagtgggaagatggtcttggtggacagccctcagagagcggtattgcaggcgcatgcacgtgtgtgtgtgtgtttgtgtacgcatgtgtgtgtgtgtgcatgttgtgtattgatggaagggtaggaaatgcaagtggaggttgccctaggtccatttaaagatttgaaatagaataaatagcaactgaagagttgtctcactcccctaaaaggaggaaacagctcagagtgattaaatatgctatccaaggttgcacagcctgagggggtgagaaccaggaagtttgccctccacaaactggagctgaaacactgcccttggaagggagtgagaacagggcaagtgttggcctgagtactcagtgctgctgcctttgggatgtccaggttcttcaagaattttagtggttgagaaggaagtgaccttggtgaggttaagtgaaatgggcatttcataattgctggtgccaacagaaattgataacactttgagaaggcagttaggcaccgagcattggaatttcaaatgctgactgactttgaaattttactttaggtattgtaagggaatacttaaaacatgaaaaaactttatgcccaaagatatccagatatttatagcaaaattattcatatttgcaagaagctaaaccacctaaaatgtctaaatatccaacaatagaagattagtaacgagaatatatctacttgatggaatagtatgcagttattaaaaataaagtatatgaagatgggtaaaagtgaaaatacttaacacaatgttaagtaaaaagaattgagattaatattttacatgatatgatctataacattatatttgcataattattatatatatgtaaaatagaaacacagtgtagactgggagcggtggctcagcctgtaattctagcactttgggagactgagcgggtggatcagctgaggtcaggagttccgagacaagcctggccaacatggtgaaaccagtctgtactaaaaatacaaaaattagccaggcgtggtggtacttgcctgtaatcccagtactcgggaggctgaggcaggagaattgcttatccctggaggcagaggttgcagtgatcgggatcacgccactgcactccagcctgggcgacagagtgagactctgtctcaaaaaaaaaaaaagtgattaaagcaaaattaagaggagatgtttctagcacaccataaaaaataccattttgtcaattaaaaacaaattttaataaagaaaatatttttaaaatataaataatggtaatctaaattctctttgaccactctttattgagctgtgtgccatgagccaggcactgggtaagcactgaggttagaaagatgccgtcacaaagaagcactaaaatactgcatgatgagtacatgacaagagaaatgtatgggtttttgaagcacacaagaggacctccaaactcagattggtagagaaaaggggaaggacagtcaggaaaagttttttaggggaaatactatctaatgctgaatcaaagagaaaatgtatgaaaaaacagatgaacacagacaaggaaacagagtaaagagagaaagaatagacccaagaaaggtcgcgaggtttccaagcagagtgaacctgaaaggtgcagcttgtttgaagaattgagggaaattccatttggcacaagcgtaatattatgggggtcggggtggggctaggaagctgaagacataagcagaaccaatcctgtggagcagttggacactaaaggcaacaggaagcctttgaagtgttttcagatctgtgctttagaaagtctcttcctggcaccgtgactggattggatgcaaggctggagagaatggtgcaggtttaagctatttgataatccaggagaaagagaagggtggatttgtgtttgggtaaagggactggggtagtttttcttttgtttttttctttttttttttttttttgagacggagtctcgctcatcgcccaggctggagtgcagtggcgagatctccgctcactgcaagctccgcctcccagttcacgccattctcctgcctcagcctcccgagtagctgggactacaggcgcccgccacccgcccagctaatttttttgtattttttttttttgtagtagagacggggtttcaccgtacagccaggatggtctcgatctcctgacctcatgatccgcccgcctcggcctcccaaagtgtgggattacaggtgtgagccaccacgcccggcggactgtgggtagtttttctaccttcaattttctagcatttccaaactttgtttaatgaccatgtgttattttcataatgggaaaaaaaaacatggtttaaggaagatgagccttatagtgttctgcctgaaagtccctcagagctttgggacttgctaagccagaggcctctgtgtctgtacaagaactcacacccacgtgctacctataatgtcccaggttctgcccacagtctacactgagagggtgtaattttccatagccagggactcaagtaaaagcagaagttggcagatgtaacagcaactgagtgggaagagaaagagagatggcctccaactcatacataaaatccaagcgttcattcattcatttatctatcaccaatattaagcacccactgtgtaggaggcactgttctaggcgctgcagatacagagtaaacaaaatgacaaagtcctagttacacattctaggaaataagatagaccatctatgattaagattcagctaactgtactccctccctcatttgaagaagtagagccgcatgccatctgctatttactgacaagagtggtttaggaaactttgcgaagtaattacaggtttgatgctcatagccatactaaatgtggcacctgtaaacagatacctatgcgtgccatggtgttttgactgggttggctgggttgggtatcactgtttctagaacagggctttcagtatcgattcatatgtacctatgtacacttacaaatgtaactcaaacttcgcctgatctggccagccatgagtacaaatgagcttacgctaaaataacagcacacatttcagtaatgtgttctgccaccacataaatggagacctttgcaatcttttctcccatgcttgtatttgggagcatccaaggcatctcgtgtgttcacaaacacgcttcttatttatgttctagcaacccagctacagaatagccatttggagcagcttctcagcccagcccttcgtaggcattctgttttcttgcccggaagcggtttaagaaatcccccaaactacagctctggggacagaaaaactctcttctgggagaaagtatccctttcccctaacactgtggaaagaccgagctgagccagttcaggtcagtgttaggactctgtaagcactagctctagaagcaactaacaatgtctgggtttacccgagcaatgttgcttgtgaatctttgtctcagggagtttcttgtaaaaatcagcaccttcgcttccgcctgcagacccctctctgctgagcacaaacctagtccacaggctggtctgggagcagcctcatggtgccttctccacattctcagctccaagccccaggcacaaatctccctcgggtcaccagacaggcctgggcatggctaaatctcaattaaaggcaaacaggatgggaaaaatcagttttaaaaagatcaggcaaggtttaggagaatatgagggcagaaaaatcctcccataccactgagaaaggaggaatttacagagaagagagcaggctggaaacagcattagccactcaagacacagtgaatcagaatgcaaatggaccgacccaaataggtacctcctcccatgctgctgggtccactctgtctcacacataaccctctgtcttagaactgctatagggacagaaggcctcagagaaccaggaatggaagacagaagagagattgccaggaaccattctaaattttaattctgtaagttataatccaagttttctttgatagcaagttttcccctgagagacaggttaagggacctttcagatgacaccttctgtccctttctcagcgctagaagtcagttcaggaacctactgttagttccaatgcccttgattgaagttagcaatttacagaatagactcaaatcccccttcaagctggagatcctggagagaatgcccagagacagaatggccatctccaaggccaactcaaatgctgcctgctccatgaagcccatctggagctctcctttcagatccatactccttcatctttttctccttcttattaagctctaggagatgttgttttggctcccttcaccctctggtgtagtgattaacctctcctgtggcagatggcagactcattgcagcatccctgcagccccatgcaaagcctccctcctgtaacagacactcagtagcaattatcgagtcaagtatggtcccagagaattacttatgaagatgactcctgcaaaatggtgagggattttctggcactgtcttttctgaagtccctgctagcacatgttattgtattgtcaggatgttctccaaaagggataatggcctatccagagctgatacccagccagttaaatctctgctgcataaaggcctacacctgttctgattagccagggccttctccttggcactcccacacactcctatggtctaggttctctggactccccactgcctttgcatactctttccttcttcccccattaggcagcccatatgcatcctttgaagcccagcttaacagtggctcctgtgtggaatccctctggcctctcctcccagcggagggaacactctttcctctatttccctagcaccctgcacactcccatacagcccttcttctatgctgagattgtttttgtcccagccccccatcttatgtgagcttacgtttgactcgtcttggcagatccagcaaaaccattgcctggcagaagcaggaactcaacaaatgtttcttgaatgaatgaatgaatgaatggcatgactcttgcaaatgttttctaaaaaagatggcaaggaaatcccctgagacactcaaattaacattcctattagtttgttatatacagattcatgtcttgctttttaaatttaaaataataagggctaggattgaggccttgctaggtgctgagtgttttacaagcattgtctgttagaatccaaacaaccacctgaggcagagataatttttactttattttacagttgaataacagaaactgagaaaggttaagaaatgtgttcagatgcatatagttggtaagtgggatgtgtttggcttgaaagcctgtgctctcgactgtctcactttccatctaacacacattaagtcaggacattttcctatgtcattaagctatttttaatgcctttattatataaaggagagcttctacacatgactgactgtagtgccttattattcaaagtgcggtgcgctcaccagcacgcttaccacttgggagcttgttagaaatgcaggatctcaggttccgtcccagatgtcttacttaatctgagtctgcattttagcaagatccttagtgacatgtaagtacattgaatctgagaagcactggtttctgtcaggaatcagcagaccacagcacacaggccactctagtgcccccgggcccccactccgtttctgtattgccctgaagctaagaatggtttttaccattcaatggttgataatttttcagaaaaggaatactattttgcaacatgtggaaattatagaaattcacatttcaatgtccataaatgaagttttattgaaacaagttcatttattcactactgtctatggtttcttttgtgctacaacagcagacttgagtagttataatggactgttggcccacaaagatatttactatctggttatttatgggaaaagttggccgacccctttcaactctatccctcatctgtcacccacagctctatggttcagaatgcaagtggaaaaaaggcaaccgtcatgtcggaagactaagagggaaagagcatcccagtgagacccagatttcactgaggcctgaaggctgagggaatctaccatggggtaaaagtccagagcgtagaggaaagggggtgaacatgaggtgtggtaaggcaggggttaggaggcaaaacaatgaaaacatgaagtagaggagagtgtggatgactttggaggcggctcctcaaaggtaagcgtggaagtctgccaaggccaaggatgaaagatcagtgcaggttttagcctcaatttttgcccacaaagctcaattttcttaaggctgctgcaagctgaagggttgggtggtatccacgtagttgaaatgacagacttttcctaatgtctccaagctgtgagggcgacaagtattctcatccctaagagaaatgctaaacttgatgtgtacaatgatgaaattaactagctctctatcctgaaatggagctgtagctgcctgcataaggagcttgttacatatgccaactcccaatcccaccctgaacagtctgattcagtgggaatttgtattttaacaagcatgctacataattccgatccttgagaaagactgcctctgtgaatgagacaactcaagcctctggaaggagttagctgcagctgagaaggtgatgcttctaaaagcaatcgtttatatgggtgaaggttttctgttttctgagctgtgtaagacttcagtaagaggcagtggcattagagaggaatttataggctctatcgctaatgagctgggggcaagcagaatgctgcaggcatctgagaaacctgcagaaaggcatagctaacagaggtgtccgaggagcttaggactgacactaagggtcctaatccaaagaagccatcaagtaagatgtggagcacacgatggccaaagaacagaaatacctgcctctcccaatgatgtgaagatctcaagtgatacttaacatattggggtgctcagagttcagggtcacctaggcaggtggcagatctcatatgtacttgcagttgtctcagttttgttacatttcaccctactcccaccattcccacagtctgtatgactgcatatatataatttccctcaggtgtagatgggggcttggtaccaagtaaattatgacatgggaccccaaggaatctctgacacggagagacacacaatgacaacttatttttcacaggttacaaaaataaaaatatcaggtgcatgaatacaaggcattgtctcatgaattaataatttagtttcctaaaaaagatggatagcgaaagaaggacaggatgggaaattagtgcttgttttaatctgctttggagctgccaagaaaaccagttgtcttctccgtttttctgtgcttcctggaaatcatgctggaagcaaccgatttgaggcgcagcatgaaacatctgtcctgttttggcttctcattgagatgttcattagcttttgcatacagcaccttgctgccttgagacaaaattttaaaaacaaaaaagcattccaggctttttaagctattgtgcagggttgctattaggaactcactgcacttagactctcagcccacccaggaatataggtctgacccttaaggatagtaaataagggagtgaaatccagaaaggctgacactccctgtgcagttatttttcaacccagaggctgcttctgcatatgtatcgcttatgtaacttttctttgcaaggactcctctggtgccccaatctagcctccaccccatccctccccatatcatcagcacaatgacatttttgctgctccacccagctgcgaattgccaacagtttaaggatgtggacattgagtaaacaaagacacaaaattgaagttggctttgtgcaactagcttttaggagttgcagttctgttctttcaggtttaaagtttcagtgagtagaataagactgcccaaacaatattgcaaagctgcttaggaatttccatcactaaaatagtattatgttactttgggataaaagatttttaatttatagtgtagctcccatgtaagatatgtatattaacctagaacaaccttgctagtttccatacgccagacttaaaaataatttatgattaaaacctttttaagaattccaacaatactgagtgaccatcaattctttagaaatgggaactaattaatggaaattttcttcaaagaatctgacctattaaacatgatataaatattcatctattttaaaagctgcaaatgtcaatgaaaaaaataaagctgtcaaatgtaggagcatttcattaagaaagcagcttcaaacattgatgagagttttataaagttaggactctcaagctttacctcctagtgaagaagttactaatattgtctttattataatcaaatgccaaaagagcaggaaaacagcagtatggggccctgaattgaagtccctctttttccagtttctactagcccagcccttttgtaaataaaacctttatacaactaaagcagcactgattcaatgggaagttatgatatcagtgctacagtgaaatggattgctacaaacagaataaagaggaatagattggataatcaacacatatagcaactcaaaaggatcgttttagtgattcttttaatcttctctactactaagtatttcacataaggatgcttttggctgcaagtaacgaatatccaactaacagtggcattaaaaaaaggggttctggttttctattgctataataataacaaaccaaaatttagtggcttaaaataacatttattttgttcctagtctgcaattgggaagggcttggtgggtggcagcttgtctgctccacttggcaccagctagggcacttgagactggggccagagtcatctgaaggctgcttcactctcatgtttgacagttcttgctggaagactcagagagctagaggctggtacagctggggctcctcaggcatctcgatttctggtgttctcccacatgagttcttcagcatggcagcttcaatgtagactgacttctaacattcagctcaaagctcccaaggcacatgtcagagagaagaaaaaggcagaaaccgcatcactgtgaacctagcatggagagtcatgcagtgtcacatctactgaattctactagttagaacaagtgggtaaggctggcctatattcaagggagggtgaattagactttgctgggaggaggtcaaagaatttgtggccttgtattaaacctaccacaaagggatttatttttcatgtatatgtctaaagggaagcagtactgtataatatggggctccatgatctaataaaaaccaaggttcatctgttcatctataattctgctctaccatttttagattggcatattgtctcaaattgcaagctgactgctatagatccagacattgtagccatgttcaagaccaagaggggtgaaagaatagtgcctgcagttctggcctcttttattaggaaatcaaaagccgttcccaaacccacctcagcagaattctgcttatgccacattggccagaactgttacaaggccacccctgcttcaagggaggttagagcagtgaatattcagcttctcctttctctactgtagaggtagcgaggatgaagagagccagaaatgggcattgggtcagtcaagccatgcttctgacctcaaagcctccatatcagacccaaaaattcacaagtaagtaagtaagagcttcaaagaactctctccctcagccaaggttaactataaaatgacccaaatatgcttaacagaccaaaaaaaaattggctaatgaatggaactatttacaactgtatttttgcaaatagaatcaaaagcagatattgaattaaatgaattgtttctacagtttaaacaggaagcagaatgggtttccccagagccatttgccggcaagataggagggacaaggaagaggagagaccactgacttgtgtaaaatgtgaaagctgccctgcagattaccttggcttcagaggcctggggcctaaaaatatttgggggcagggcaaagaggaactcttcacttgtaaacctaacccaaattctatatctattttatagaacattccttcttttaaccttgttactcactagtgaatggaaacaggaaaacattgtgagttgatggattttatctaacccatctgcaacgattattcaaatgtaagcttaaagttttataacatttagctaaagaagaatcaaaactcttttcattgccccgtgtagcacaaacactctcctcgccctgccaatttgccagtctactgtctcatgctatggtctctacaaggataaaaaaaatcacaccacagcagatatttttatagacccttcattcatacagccttggcatatgaccgcaacaatagctaaaactgaaaaatgagacaactggatttactactgatagtgtctagaactctctcccaggtaatttaatagatgtacgtgaaaatgtgtgtttaaggaggacgctgaatgtgaagaaagaatgcaaccacagtgagagctccagtacaacccaggctacaacttccaatgtctggttcatcctcagagaaaaaggaatgaggaaaggaatattttcctttaaattgaaagaactctgacataaggaaattaaataattgatccaaaggatgttgctcctattaaacagaaaaaaaagcaccaaggcctttgcaagcactcccattacagtttaatttagaatagaaagtaatgcaggtctttattctaaacaatggccaactttactaacacgaaatagactcttcttaaacaaaactcataaaacatatactatgggagttacaaccattttctgaattatttataagctaatgctctgctttcaatgtttctatcagctgcaaatttaattaagaagcaaagaatgggcttatagagatcatgaccctacgtatttcttatcatatttcaaattataatcatgtcatgatgaagtttgatcctcgtggagtgtaacaaataatatatttgaactttttattattaccagtttagagacctactataagatacttcagaactcccaaaccacatagcaaaattcgtaagtgcagtaattaccataaatgtactctgtactctcaaaagcaactgccaacagttctaggcccaggataagtgttcaattcatactcataaatttcattgaatattcaacatctttcacaaactcatatataatctttgtgtatgaaatatttttgagattgaatattccccacactcatttccaactagaaattcccattgggtttgaatgaaaagatttattagatctactcaattaggtgacaagattaatagtccccattaaccctaatttgctttttattccgcaaagactaacacagatgtaaaacaggtgttggccaccccagaacatatgcctaagacaacaagcaagctgagagtaatttggtacacgaactggtgtcccttccatgccacctctccattgacagttatgctggaaatgagatttaacagcaaaatttctctttcctacaccatgcccaacttcctcagtgctagtagctttggatgtgagagaagaccacacacacacacacacacacacacacacacacagacacacacagacacacacaacacactgagtttagatcaacaagcatatactgagtgcccattaccaggtgtcatgctgaattataggcacaggtggagcctcaggagtcaagctctctgaattcacaccccagtttactctcagtagctggatagcctcaggcaagttcctcagcctttctaagccgtagctgcttacctgcaaaacaaggatactaataacacctacttcatgggagtttgtgactatcaaatagataattcgtatacagttgcctggcatctagtatgtgcaataaactgagctataatcacaccatcatcatcgcagcatagcctcagtctttatccccaggtaaactagggtgaaaagaacataaacagattatgcccattttttgtgagatggtaagtggacttcagaaaagaggcattagctcaacgtggaatgcaaggaaggtctctgagctgagagtcaaaaggtgagtagagtagctggataaagagagttattttggtcggatgtggtggctcatgcctataatctcagcatttgggaggccaaggtgggcggatcacttgaggtcaggagtttgagaccagcctggccacatggtaaaaccccatctcactaaaaatacaaaaattagccgggagtgatggcgcacactgtaatcccagctactcgggaggctgaggcaggagaattgtttgaacctgggaggcggggttgtggtgagccgagatcgcgccgttgcactccagcctgggcgacagagtcagactcgtctcaaaaaaaaaaaaaaaaaaaaggagcatgttgtgtacaggaactggatgtggtttctattacaagcaagaaattcaagacggggagggatagaagatgaggctcatgaggaagaaaggactaggtcacaagaggtctcataggtcatgttgaggtgactgaatttcctccttaagaccaaatttcctaagacagtttatagaaatttctagtgttcacagaggcatttcatgaaaattccttggtattcctcaacataatagcttcactgtgacttctttttgaagcatccaaatttcacccctttagtaattcacagtgcatgcgttagcatgttgaaggctctgagaattttacaataaaggaacctctttgcctcaatttagctcaatattttttaaatagattgtcttcaggacaccatttttacagaatgctgaaagatattttgccagattttaacaagagtatgaattgggcagtttagcttcataaaattgctctagctacagagatggagtttaaagggcacgcttggagagaagatgtgaaatgatggtgagccgggacagagaagacagagcagatcaaaaaaatattcaggaggtaaaatctgtaggttttgctggtaacagtggagtgaggggacacaactgtctagaataatacttggagttctggcttgagtgaaaacaatagtaatgcacttacttcaaaagtaatacagaaaaacatgatgttcggaaaggaatgagggatgggtaggtaaaaaacttagtatgagacatccatgagtcttccaagtgaaataataggtagcaatcgtcactaaaccattcttcagtcctaatctaaaccaggtcatctgacaagtaattccttctcttccttaggagtcaaaatttttaggttaagattccataatgcattgtgttcattttgcagcaaatttactaataataaggttattatttaatcattaaaacactcaggcttttctaatgcattcgcaaattaaaatatgcaaatgtacatatgtagacaggtgaatattgcattctcaagataaattacttaaattctcacttaaaaagtgaatctgcagtagagctactaccttatccaaatgtcacaaatatacctaaataggttaatttttaatatatattgtagtgaacatttaacaaaactaatttttatcttttttttctatctcagcttcttaaaagcaaaagaacatcttcatctttgtgccctgagggttcaaagcagtttaaaacacatggaaagtatacttaaaatcttgttgaattaataaaattaattaaagcaagtcacagtaataaatacaaaatgacaagttttcaactctactctgtcactaattgatctcatccgccctcttcgctttactatgatctacatgctaatgatttccaaactgttatcagctctgctctccttttgaactgtatcatctctgctcttcctttcaactttgaaagttgaactttcaacttgaggcttataattcaaccttacttgacttttccatgtgaatgcttaccagagaccttaaacttcatgtgtcctggtagcattactggttgcctaccttcacagtatcctttcacctcttacttcctataaaatgcctccaattttgttcagtgagccactgtgaccagctaaaaagctcagcctccctgcagctggaattggacacatgatataattttggtacataaagtggaggtctggggtataatttctgaaaaagcttttgctttcctgacataggcactacccctacttctttcagctttcccttctcctgtcttacatgcagaccctatgcctaaagctcagtccctctcttacatagtgagagtgaaggacatgataaggatgctcaaggagaagagagaatgtgcctgcgatctcgtggcatttgtgagctaccataccagctgggtctgcctatttttgacacacttttgtgtgacaataaattaattgattaatcaaagagcttgtttgcttaagatatggtttgtcaggatttggttcctctgcagctgaacacaaccacatatgacataacatacaaaacaaacatttgattttcatcttcaaagagcacctgatgaccacctccccaaccatctcacagacctattctttcccagtcataaacatgtcagtttctaccatcaccattcatttggtagcttaagaaatataaatttgggtatgtccctgatgcctcctctctgtctttacctctaaactatatctcaaacccatcttctctcttcttccaccacctagccatccaacctatcatcatagcctctagctgcccactctgctgcagtcttgaccccctgcaatcatcctccacatagcattcagacaatcattcaaaaacacctattaggtcacgtcactctcaattttaaaaacttccgattgttcctattttactcataataaaatccaagtgcctagctgcaatgggctgaatgtgtcccccaaaattatatgtcaaaactccattgtgatggcatgtgaaattggggactctgggaggaaataggtcatgagggtatcatgagagtctagccttcatgatgggattaatgcctttatagaagagacataagagtgcttgcttcctctctctttctctctccaccatgtgaaggtatggaaaaagaagtcatctgtcttcaaatcacgaagaaagtcctcatcaggaaccaaatcactgccaccttgctcttggacttcccaggctctagaactatgagaaataaattttttgctgatgaagtggctcatgcctgtaatcccaaatttttcagaggccaaggcagtaggatcactgggtccaggagttcaagacaagcctgggcaacaaagtgagactctgtctctccaaaagcaaaaacttagccaggcatggtagcatgagcctgtggttccagccttacaagaggctgagcaggaggattgcttgagccaaaaagaagaggctgcaatgagctgtgttcacagtgctgactctagcctgagtgacagagtgagactgtctcaaaaaataataatagaaattttttaaataaatgtttgttatttattttaaaataacctggtctatgttatttttgttatagcagccaaaaagactaacacactaactatggcttacaaagttatatgtggtctgatctcatcttcaccgttttctcttttgctcactgcactcaagccatactactttcatttcattcctcaagccaccaaatgtagtctcacctcagggcctctgtacttgctgttcactctgcttcagttcttttccacctggttcctcctcatcattcaggtttcagctccaatgtcacctccttagaagaccttctctgaccaccccatttcacctgtgtttcatgatctcaataccctatgttgttccttcatatgctcatctgtctaaaattatcttgcttatttacttgttactttttttctctccttctagattaaaagcttcatgagtacagggactgtgtatatcttattcaccactcattcccatatctagaaaaatattagtacaaattaggcccttgataaatattgttcttaaaaatagattaatttttctaaaaaaataaataaataaaaaataaaaaaaaaacacacagcttggatgcttggaaatctgccaacatgtatgatcctagaaacataattttcttgtctaaatctccaagagcagaacagaattttggatttaaataaaagctttttctagcatatttaatcagaaatcaccaaatgtacttaatcctattgcttatcttctatcacaggtaagtattttgcttaccacatatattctttaaccaagttatggtaacataataagggattagacccttatacaagttgccaagtaacctcattgaatttcaacatttcagtacatgtctttgtaatatctgtgtgacaaactatcaagtacacagaaagcacttctgctgaatactgaagtagcatgttgtctctaccataaaatattcctggagttgcaagttgaactaaccactcttctaatgaacaccatttcacttgaaagaccaacatattcagatgtaggtatttgctaaacattttctgaaaatgtacaaagtgaggctgtcaccccaaaggaaatatatggcaatatttattgccaataaacctttaagaaactacctctagttgaggtttaggatagtagatacaattatccaaaaggttattaaaatagtcctctgttttccagctacatcactctgtgatgccaggttttttaatattcttcaatgaaaacaacgtatcacactataccgaatgcaaaagccaatgtaaaatctagccatcttctactgtcagacattaaaaggcaaaaaatgtaaaaacatgaaatatgctatgctactcactaagtttctcttgtttggaaaaataaatacattatttataaaaaatgttatttacgttacatgcaatgggtttattattgttattttaaaatgaatgaataaaaattatttttaaaatgtttatagcatgtttggttgggcgcgatggctcatgcctgtaatccagcactttgggaggccaaggtgggcagatcatgaggtcaggagtttgagaccagcctaccaacatggtgaaaccctgtcttttctaaaaatataaaaattagccaggtgtggtgacggcacctgtaatcccacctactcaggagactgaggcaggagaatcacttgaacccagaagcgggggttgcagtgagccgagattgtgccactgcactccagcctgggtaacagagcaaactctgtctcaaaaaaaaaaaaaagaaagaaaaatgtttatagcatagttaatatccacgatataacccaaataaacaaaagatttttgagatcctcaattattaagagcataaaggatcttgagaccaaaacctagtacaatagatagttataacagaagtatgtaatagaaataaaatgtatgatagaattatataacagaaatgcaaatcctacatttctaacagcatagatgaatatttaatatcttcattccaccacaaaagagagagagagttccattgtgcaattaaataaaaatttaagcaacagcatccaggttgtggtgttgccatcacagcaactagtggcttcaggagttaaaaagctgtcagggaacagtggcaggtgggctggtggtacagcaaagagcacagtgacttgactggaaatacgaaaagatgtagtgggataaaatgctcaaacacattagggcttatgttggtacagagatttgaacaaccaggaaagaactctaacacaagataactttttaagttcacttatgttttccccttctgtttttcttctttgacatctgtgctgctttgcctgggggaaagttcaaggttggaatgtttgatttttgttttaaaaaacctgagggcagaaagagaatttaaatagttctgggggaagaataccccctgtctaaaatgaaagtctcttggcttagaggaggagtcagagtttaaggtaccctgtattttgccttactccctggcaggccccaaggacacagcaagacctcagagagacaggccattggtgcaccaagaggcggaaattagcccaggtttcccaaccacaacagttctcatactccagaggctagcacaaaggcagagaggggagcctcttaaagaccacacagggagagacagtgacatcccagcagtaaccttgtggtcatatgtctgatgccctcctgggtctctgagatctcggctctgcttgagagccggaattttgacacagccccagatgggaagtacaagaatgactgaagttgaatttctcacagacctatggaacaggggcagaaaataataattacttactgagccaaaagtagagaagataaataccattcagcaataaaaaggaaggaagtacttaagtcatgccacaacatggatgaccttaaaaacattatgtggccgggcgtggtggctcatgcctgtaatctcagcactttggaggccaaggctggcggatcacgaggtcaggagatggagaccatcctggcgaacacggtaaaccccatctctactaaaaatacaaaaaattagctggggtggtggcgggtgcctgtagcccagctactcgggaggctgaggcaggagaatggcgtgaacctgggaggcagaggttgcgtgagccgagatcacgccactgcactccagcctgggcgacagagcgagactccgtcttaaaaaaaaaaaattatgctaaatgaaagaagtcagtcacgaaaaaccacatagtgtatgttccatttataggaaacatccagaataggcaaatctatagacagaaaatagattagtggtgcctagggctaggggaaaagagggtgacaactaaagaatagaggatttgcagggacagggaaaacattccaaaattgataatcgtgttgatcgcacaactctgtgaatataccaaaaaaaaatgaattttataaatagttaaattgtatcaataaagctactacccccaaaaagtaggaaatgtgatgtctcttgtccacctgaggtgtactgagattcataaccattttatgtgtaaatgtttcacaaagttatttgataaggttgtgtcaagctgaggtggtaacttctaaaccacacatatatcagctcaggacctagcaaacaggtccgaaacacaagcaatggggaaggtgcaggagggagcagacacaagctccagggaatgtgggtagcaagtggtctgcaccaagaaccacataaaactccagagcactgttttggagaagcaatattcagagatgcgggaaggagccagcatcaaggaggttctcagcagactgcaaggctccacctcaggagaggagttcagggcaggagccctgcccaagtgcacgattgcaatgaggcctgcagcctcagagaccgggaagtgatccaagaaggacccgaggcaaccatgcagggacctaaaaagcattaatgatatagcatgcattttgtcactcatgtatacatatatacgtaaggtaagttctataaaaataaaataataaatatttgccatacgctgttatatgtatttatattttttaatgtatcttcacacaaccctctgaaatagctactcttactcctctccattttacagatgagaaattcgagtacagaaaggcaaagtagcttgcccaagtcattagtaacacagagctaaggttaaaacacggcagcatggtcccagggtccatcttaactctaccatgctgcattcagagtaaaggctccttactacatctgagccatcaggactgggaggaaccatggttgatgctgaatccccctcgcataaacaagaggtctttaaagcttcccctgtgtaggaaggacagatcctggagcctggctggggctgagcatgcaggtggtacttaaatgatggccacgtagaagcagaatatggaccaggcaactactgccacacatcttacatattttcatttttaccacagcgctataaggtgtatcttagtctgttcaggttatgataacaaaataccaaggctaggtgacttatgaatacagaaacttattactgacagtgctgcaggctgggagtccgagatcaaggtgctggcagagcagtgtctgataaaggcccacttcctcatagacagctatcttctcactctaacttcactgacagaaagattaaagggtatctctcaggccttttctttacaaaggcactattcccatcatgagagctccacattcatgacctaatcatctcctaaaggcctcacccccaatacggtaccttggaagtgaagatttcaacatgtgaatctggggaggacataaatattcagaccatgcaggtaggtattgtcttcttcttttcagatgagaaaactgaggtttgaagaggttacaaatttggccaaagagccagtaagcaatagagccaagaccagatcccagaccatctgattcaggatggcagctatgaacaggcatttgtaaattggcaggcaatgaagaaaagcaagtaattgggaagtagggtagcagcatggttaaaaacatgtgcttggtggccaaagtccagcttgtcaattactctatgatctgaaaagagctacttactctttctgagtcttagcaccttctctgtaaaacagattagtaacaataataataaagtctaactcctggggttgccatgggattcaatgaaacactgtgtgtataaatatctgacagagtacccagcatatagtaggtgctaataagtggtagcatgttaaggaggcattcctcttattgtactgctgaacacagacaagtcagtggcaacacagatctttctcctgagctgttttacctcttgactaagagaacatcagctgaaaggaacattagaatttctttaatctaattctcttttttaacagatgagaaaatgagggttagagcagttacataagttgcccaaagctttatagtagttactggcgaggaaaccagatcttttatctgtaacttaaaaattaaaaagctattggaatgagatagaaaaatgttaagaagtaaaattgggcagggtgcagtggctcatgcctgtaatctcaacactttgggggccgagatgggtggatcacttgagcctaggaggtcaagaccagcctgggcaacatggtaaaccctgtcactacaaaaaatataaaaaattagtcaggcatggtggcatgcacctgtatcccagctagctgagaggctgaggtgggaggatcaactgggcccaggaggtcaaggctgtataagccaagattatgccactgcactccagcctgggtgacagagtgagaccctgtctaaaaaaaaaaaaaaaaaaaaaaagaactataaaagaagttaaattaagacaatcctaggtgctcttccatcagggatgtaacttagtgggaaaggcagtcatgccacactgaaaagagcgggggacttctgacactccggcctctctcacaccattccctgtgcacaagtgaagcaaccttcccaggaagcaggaagctgtgctttcagatactcatttcatatcatcccacccttacctgtggtattgtctgcactcaacaaaggaaactcgaccttgggtgatacacaagagaattaacaaaaggatgaaaaccagtatcttggaaagcatatggtaggcattagattagtgtagtaaaaggagccgagaattaaaaaaaaaaaaggaaaagtccttttatatcatttgggtggttgccttcgcttgctaaaagactagctgaaaattgaatgaaattaacaagcaggtgtagatggggatgcagaatgttagagaaggtgtatcgaactaaagaggtaataaagagtttgagaatgaggtttgaggaaaacgaatatgtgcgtttgcacatttgcacacacatatattatctgacagtgcctgtctttacttttgcagtaaatttaagagctgccctcaaaggcaaataaatggtgtccattgtgctatttacaagggtcaggagaggttcttgggcatgataggaatgtggtaggaatatgacagggtaaagcagttaaggactaaggagtagggattccaaacgaaattgctaggtccacctgctacgtattaattatgcaagaattactgtttgttcagtgcattgctgcatctcttaagagaaaaaagtatatttgggaaatgtctgacaaatctattcctaaaagaaagaaaatgttacactttgttagtctaacaataatgttagaccacatatatcttaaaagaaatttggccccatttgctataaacatactgagtgattatcaggcaaagaattactccagactttaaagctttttcattagctagaactagagttccagtcttgtctgtcgttatttttaagcaccccaagggtgctaacttgtgcattgttttgcacagatttgcacttgagttaaagaagtactaggttcaaatatgtaaagaaaaaaaggcagttaacattgcaactatctactaacaccatcatctgggatgtcataaactaaaaaagatcaatctcaaagatacagatcttcatagagattttcccaaagggaataatgaaggatgcccatgtgttcatatcgactcccactccagatgttaccattcattccctgcgtgccagggccacaaggtctcattataagctgatgatggtaggggttctgatcagcagataactttcttttcttatggagccttctttgggaaatctagttccttccttcccttctttcctttctttcttgagacagggtgcactctgtgcagtggagcaatcatggctcactgcagcctcaaaccccacctcagccgccgagtagctgggactataggcacacaccaccacacctggctaattttcatatttttataggacagggctttaccatgttacccaggctggtctcgaactcctcacctcaagtgatccgctgttctcagcctcccaaagttctgggattacaggcgtgagccaccacgccaggccccacgttaaatttacatgcaccgttgtcatgtttttcattagtgtctgttatattttacattgtttggccacaatggataacataaatacatataagagtaactggaatacaatttctacaccctttgttagccacgttggtctacctctaagaaagacattgtcatggtctcttgcttctaagtaaactagggaggaaatcattagcggctctcactaaaggaaggattgaaaatagagttccattaatgggattagatcctcccactcccttccgggaccaaaatgcctaaacagaaacctccactggcatccaggtcctaaagtttgcaaggtatgagaaaggactaagggggttaaatacaagtctctaagccttggaagggggccataaaaaagaaaagaggattgaggagaaaggaacaacctttcccaaatcctatgaggcctttcttctgtgtagtacacaatggaaacttaagtttaaatttttaccacctctattcctcccacaccgcatcgttctctttgaaactatccgttcctagggcaaaaatctcaggccagaaaaaaaaacaatccacagatactgctaatggtgcaacccttactctaaagaaaaagaaagcccaggtgccccagagccttcccagagacctgactagaataatgcctctgtctttccaggtagacaagctaagtaaattaagcattcagtgaccaagaaaatattgaattcctcctgaatctgcatgaattttgtctatttccgtatcctcaggaagctaatatgctgattctgaaatttccaaaatgtgagaggttcctagagccattatggaagggagatttgtttgcctattgctactctttggggttgtagaatatcttgtctggttttcttaaaaacttcagggaataaaaagactaaaggtagccaggcgtggtgtacacacctgtaacttagtgggagaccaggcaagagaatcacttgaaccagctactaggaggccaaggcaggagaatcacttgaactcggaggcggaggttgcagtgagccaagatttgccactgcactccagcctgagtgacagagtgagtgagactgcatctcaaacaacaacacaaaaagactaaaggaaaatatagaaatgcctccaggacaaactatcattcaccaaatgtcatttgggttacacaaatggaacatccttacaatatcttaagtcaaacagtggctttatagatgtgagatgaagtgcccggggcaagatattggttctccaattttgatgtgcctgaaatcacccgtgagacttgctaaaaatgaggattataggttgccacctccagagatcctgagcggagcccccaaataaatatttctaataaacaccacaggggagcttgttgcaatgcagtgttcagtaaaccaatttttgaaaagacatcaatttctcataaaacctcagttctcagccgggcacggtggctcacgcctgtaatcccagcactttgggaggccgaggcgggcggatacgaggtcaggagatccagaccatcctggctaacacggtgaaaccccgtctctactaaaatacaaaaaaattagccgggcggggtggcaggcgcctgtagtcccagctactcgggaggtgaggcaggaaaatggcgtgaacccgggaggcggagcttgcagtgagccaggatcacgcactgcactccagcctgggcgacagagcgagactgtctcaaaaaaaaaaaaaaaaaaaaactcagttctcaccttctccacttgctcccctttcatgctcccactccactgaaacagcatcatcaaagccaccaatgacctccatgttcccaaatctatagttaattatcaatcctcacttgtttgacttattggcagtgtttgacaaagttgatcactctctccctcatgaagcacttctccacggggcttccaaggcactaatctctcttggttctccctctctttctagtgactgtcagttttctttgttgactttattttcctaatttccacaccttgaagtgcccctggattcaatccacagggttttccacttctcagtctacacgcacttctgccgtagcttcatctttccattgattttaaatatcctattagtattgggaattcccaaattaatatttatagtcggtccactctctcaagctccagactaaaatagccaattgccaactcaacatctttagttgatgtctaataagcatacattaacatgcacaaaatcccttatttatatttcctctctcaaatctgctcctccatcagtattttccagcttaatcaagggcaattctatttttccagttctaagtccaaaaaccttggagtcctcattaactcctcactttctttacaccccacatctaaccatcagcaaatcctgtcagctctactagaaaatatatgcaaaatccaacaacctctccacacttcccctactatctatggtctaagccataatcatcattcaagtgtattactacatagcctcctaacttctttcattgtttctgctaattcccactcccccaaactattcacaagcaaccacagtgattttcttaaaacacaagtcaagtcgcgtcatttcctctgctgaaaacttccaaagccttcccatctcattgaaagtaaaatccaaattccacactataacccactaaaactttatctcatctagtctagggctacctccttgacctcattttgtactagccctcctcagcctttgcactaactgaaaggcagaggaaataaccagtgcaaaggctgaggaaaaccagtacgagatgaggtcagagaggtagcacctgctctctcacttcctttagaattctttcaaatgtcctctccttggagaactcttttttttttttttttttttgagatggagtctactctgttgcccaggctggagtgcagtggcgtgatcctggctcactgcaacctccgcctccaggttcaagcaattctccgcctcagcttcccaagtagctgggattacaggtgcccgcaccataccctgctaatttttgtatttttagtagagacagggtttcaccatcttggccagctggtcttgaactcctgacctcatgatccacccaccttggcctcccaaagtgctgggatacaggcgtgagccaccgtgcccggccagagaagtcttactgactatggtagtacagcttcaagacgccccccagtgactcccaccttcttgtactcacaccctgtgtaattcccacctttgagtatgcactagctttagtgacttgcttttttttattattattattatactttaagtttagggtacatgtgcacaacttgcaggtttgttacatatgtatacatgtgccatgttgtgtgctgcacccattaactcgtcatttagcattaggtatatctcctaatgctctccctcccactccccccaccccacaacaggccccggtgtgtgatgttccccttcctgtgtccatggttctcattgttcaattcccacctatgagtaagaacatgcggcgtttggttttttgtcctgcgatagtttgctgagaatgatggtttccggtttcatccatgtccctacaaaggacataactcatcattttttatggctgcatagtattccatggtgtatatgtgccacattttcttatccagtctatcgttgttggacatttaacaaacagaatcaagcagccatgatggggtgtacttctgagattcagttacaaaaaagactgtgccttccatcttggacacacactttcatctctcacttgcttgctcactctgagggaggccaactgccatattgtgaactgccataaaagaggcccacatgacaagggctgagggaggcctccagccagtagccaacaaggaactgattctctcagtccaacaagctgcaatgaactgaatcttgccaactgttccagctggcacatgaatgcatcctcttgagagaccttgaagtggagacaccagctaagccatacttaggttctgacccacagaaactgtgagataataaatgtttgttgttttaagccactaagttttgggtaatttgctgctcagcaatggataactaatacactgactatcctatataaattcacaaatcctacctctgccattctagtatttcttcccacttactccattacttgctttatagcataatctccaaagccttgaatattatgtttgtctgtttgtttgtttgtttgtttgtttgttagttcaatctccacccactaaaacaaaagctcatggaggcagggatatgtgtagcttgttcactgctctatatccgagcatgtaaagcatgcctggcacatagtaggctcttcaaaatatttgttgaatgaatcaacaaatctgagtacaggaaagaactttgtaaaatggtgaaacacaacttagctcacaaggttgtggtgagtgttaaatgagcaaaatacttcatgtgtccgtccttagtaggtgcttaacaaaatatgctttttatcctcaaaagaaattgtcatcaagagcattggtatggacatatacaattgtagaattttttcagactgggatgtttatttgcaaatacttggcaaaggagaggagcatagcacctttaaattaagaggcaaaacttcatttcgcagctattttaatcgtgagcctcacccagcccatctccatttcactcaggatccttcacaacactccacttatgtatgagccacacctttagttttctatattattttataactcagctcccttcaactttaagaactttgaatttatcacagaggttctttcaaacctttatgggtctgaattcgatgctcactttgagagtcagagaaaaattaaaaaatagttccttctgtcctcttactgaatggcctcttaaaactccgctgtcttcataaccattgccagacaataagtaatccagagagcaataggcaattattaccatttcaaaaccattgtgcagttgcctctgaaagaaatcactggatgtatgatcttcagtttttatggacttatgccattctttggcagaagcagtgtaagcagataatttctacagaacaataatgtttaaaactttaatactggccagcaataggagcaattttcctaacaggattgaactaaggataaatgggatgtctgacaactactctgctgcagcgatgtttcttgaacccttgggaactctattttcttcatcgttttttacaaatctagcacggttcctgttacatgagaggtgctcagtcaatgtttgtggattaatggatgaataggcaagtgaaagagttattataagcccctggatgaatgtctccttgtctataagctagtccacctggatacagcatcgtgggtggtcatgttttccctgcctgaatcgttgatggcctcatttgccttggtggctaaacagacttaactttaaaatccgggcctgcacttcctaaatgtgtgatattggcacaggcacttaaccactctcaggcttagtttcctccctataaaactagtatgataatatttactttatacagttagtaataagattaaattagcgctaacatgtaaaacaccagtagcaaacacacctaggtaatcaatacataattgttcataaacctagccctatcagctgtcactatgaacaaaaatatcccacttggcctgttctctccagctagtttgttcacaagccccaggtgatccttagtatgcagaaatttaggtcctagaaagtatttccattattatgttagccaactcttgttatttaaaatttattttctatttacaagtcctctcaaatacaatatttctttgagcctcacaacaaccctaaacggctggtagacaagagtcaaggccctattttacagatgaggaatctaaagcaaaaagaattaaattacaaaaatcacacagatagtgatggtaaaatgaagtttcagactcatgtccagaaccttttcttacattatacagcctctaaccaagtgcatggaggagaagccattaacctggcccaggccgtctctcaatcaccttcccacctgaagaagcactaactagtaacacaagatgctgggtggcagccccttctggaatctcaaacctgcgtctttcaaagttggccaggtgcggtggcgacgcctgtaatcccagcactttgggaggccagggcgggcagatcacttgaggtcaggagtcgagaccagcctgggcaacatgtgaaatcccatctctactaaaaatacaaacattagcaggcgtggtggcgggtgcctgtaatcccatctattggggaggctgaagagcaagaatcgttgaacccaggaggcgggggttgcagtgagccaagatcacaccactgcactccagcctggtgatagagcgagactcagtctcaaaaacaaacaaacaaacaaacaaaaagttgatggccagtaatcatctaggattgtggaaaggagcttccggaagggtggagccaagtcttatataattctcctgggaactgagtgtgaggtggtggtgctccccctgggcgattcctgacaatattgctatgggggacaggaatcttgaaactgagaagagatttctctgtgcacatcacaacctgtttcactggtcctgcaaatacacagccttgagaaacctaaacagggaatcttcttaaccccgtaccactttgctgcacagctaactagatggaggaaggaagagtaaattaacatcagtacccacctcctctgtgccaaaccctgtgctcggccctttatatgttatctcactcatttaatccttaaacaataaatacattcctgtagtggatatgtgatatttccctaccaacattccaatttttacccacacctcctccacatggcccgcatgttctagaaaagctggctacccctgctgctagggataggataagtggctagggcttaagctgatcggtataagcccttccctggtcacagttcagggaagagatatcaccaaattcaaaccaataagaagttttcgggggtgtaggaaagtagctcacttgtgcaaacttttcctctctctctctccttctagaggagctgacatgaagcctggaattgccatagcccttttgccaccatcaagaaatgaaccatgtgaacctgagagacccagcctttcagatgaatcctgagtggctaactggtcctaaattaaaatggagccaagatgctatttgctgactaaaggtcacacaagtcctctgagttcgtgaaaacccatacctttttaacttggggactttcagctctgacctgaaccaacagagctacctgccccgccaatcagggctcagctgtatcaaccaatcagaactcagcagtgttgacaatcagaaccatgcaagtttgaatcctttatttgcataaacagacctgactgggatcccgacaagaaattttgctataaaatctgaacgctctctttgttcactgaaatgcacgcagaggctatgatctcctcagtttgcaaactgtttacaaggatgaagtcttttctccaaattcttctcagagaacttttgttcataagggcaaccagcgccagagtgaagttgacttcatgaagagcaaagggacaggagaaatcaatttttgatgatatcactgaataccaaatcaaaaacctaaaattttccgtccttttaaaatttcctcttatatgggagccaagtaaaaccacttttaatttacctagtctgagttgagtattctattactcgcaacataaaaagacttaactcattgattagggtaaagctattctgccataagaaggaaactcaacaatgatggaatggttaaaaatctaagttcatttctctctcatctaacagtgggcaggtgttccaggtggacaggagctctgcttcatatctgcatttagagaaccaggttcctcccagatcattactctgaaaccctatgatcttgctcttgtctccacagtcaaggttgggttgctctgagttccaccttgaggaaggggaaagaacatggaggagtcttatgtcccagagctgaatatgacacacacttgctcacattccactggcagggaattagttccttgatcatgtctaacagcaagggagactgaaaatatgttagcagccatgtgcccacatatctgttaccacaaaagaaaacaagaatgattggggttaactgccagccccgcagtcttagccacattaaccattatagaacccatttacataggagagaagttaagctaagaaaacttgccttacataaccagtaagtgacagagcaggatttgaacctcaacttcaatactcacttccacatgctccataaggtagacttctatgctcctccatgtatgtatttatccttcttcccaattccagctcttgaaatgacctcatcaccattagcaacatatatgccataagttactatctactctggcagttgcctggtaccctcaaggatagccagcttctggcttaactcccaaccacaactttattttctgctctctagggaggaggtgttgaagaaaggattgagatgattatcccagtctggcacacagaaagaggttatgtagtaatatccagctaaaaaggcagttacttgacaactgcaggggaaatcaggtgcaaactgaggacagaagcagagagaaaatgtgtggcacctggaggaacagagaaaatgtaagatgaagatggaaagctactaacaatcaataataaaagaggctgaaatggaaaattaggacatagaacagactgggtgaatttaggtcatttccgatgtaatgtgtccagcatttccttaaacaatttttatttactaatttgaattagcagtacatttccaaaatgaacaaaggttaaaaggaaacactctctcccctaccctatgccccaggcacccatttcctctcaccaagtacaaaatattatcaatttcttggatatcctcctggacatattttatgcataagaagcaatacaggcatgtcttgtgtaagtattttttctcccctcttttattgaccaattttctaaccttaatttttttcacttaaaatatcttggagatctttcaaggtgtatatataaagatgtatcctcctttattaaagagtactcttttttatggctatatcatatttcattatatgatatgcataacttatttaaataatcacttattgagatatctagactgttttcaatcttccctattacaaacaaggctgcaatatgcaatcttgtgaacatctcattctctatgtatgtgctaaacctataggataaattcctagcactggctttaataagtcaaagcatatagatgttataagaatatttccaaataacccttcataagatagtaccaatttattttcccaccagtctatatgagagcacctgtctcttcacattcttgccaacacagtgtgttgttaattttttgcattgccaatctaatacatgaaaaatggatgtctgtatatgtttaaacaacattcgtgtccattttctatggacttttttgcacattttttattgggctattggtctttttcttatggtttttaggagttctttacttacaaagaaaattagctagcttttgtctattaaatgagttcaaatagtttccgtttttataattgtctagtgactttttatgatgggttttgcattgcaaaaagcattccttttattcactctctgaagcatctcactaaattgggagatgctcataaataagccaaactttcctagattgcaggaggcagcatgaactggggaaaacttcacttttagggtttcctctcctgtttgatcccacccttaattactccctggtaatgatattgtcacgaactcagcccactgaataaattaatatcactaaccatgacttccagcagtaacagagtcaaaggaagccaagtttcctgccctttggcttcccagctaagtcagagaggaaaataatttctgaaaatccccagagaatgttgttgacacatcagctttcatttttcctgcacctactcctccataaaattcaattataaaagtccttcctaggtagtcattcaatgaatggcactggctgaagaagaatagacctgtgggtgggttactaaatggatgggaagagaaaataaagaaaggagtaaatgaataacaggagaaatcacactgcaagtaaggggcatttcacaacagaatgaaattgcttctgccacaagcaggcaaacaaatttcttcacacaaggaaggagggacatatttcagaaggccaaacataagtcttggcagtgaatttcaggaccccagggattgtacaataggagggaggagtgatgcccctttttgaaggtctaggaagataggtagacagcattctctaaaatcaccaagaaaattctctaaggcagctttggagaagatgctggtttctttgcatttttcagcctgatccatggcatccccaaccttcagcctcagctgaaagcatcccaaccttcagcctcagctgctcagcatctgagcgaattctgactctgccttagtggacatgaaagccctttcccatcctatggcaagtgagtagtctagacctctggaattatactcctcctctctctgcatttccccttctctcatgcatccctttccctccatcccacagtactgtatctgcagcacccggcagggcagcccttcccaaccctgggcttctgcctgacttcctgatctcactcagccgcctgctcttgctggagccttgccctgaacttcagcctccttggcaaggccctgacagcccagctggcccacagccaccatcctgttcctctcagcaagcagccaggtcctgtttcaacacggatagtcctccccaccccgcttcctctgctgtccccctcttccgaccaactgaacatttccattatccagcgttcagcttttcccctgctgcattcccctcctccactaggtgggaacccatggatatctacactggctacatcaagcccagattccccaccatacacaccagtttgaccagccttaaaccaatatgtacctttatttaacttatgtaatagaagtccagagataggaagattccagggttggttaatttcatggctctcaagtgtcataaggacctagagtctttcacctttctgctccgccatccccaccacaatgcctactctttcacaagttgagttctgcagctctcagtgaccatggtgggctgaagttggttcccagaggtcctgagagccaattgctaaatatttaggagttttgccagtcagttgtagagcttgaaatggccataatgggagaatttacaccacagaaatggaaacagacaaatgctacaaatcaggcttttcattttttggcgagggtgttagcagcggattaatgctgcatcacatcttcatagataacatttagaaacaaaaagggtctatttctcaaatatatcttttttttttaagagcgagaaactttttctgaaaacctcatagaaaatccaccacccccactctcaccctcccaattccttggcctgattatgtcacatgcccacgttttaaccaaagattgacaaatgaacagatgacaacaatttccctaaagtatgggcacctgatacctgaaaatcagggttttcttagtggaaatagggtaggaggtagtgtttgtgtgaggaatccacaggatttgtctcatgcactacacacattctgccacatgattgagagcttctctctctgccctggcccaccgtggaggttcagcaggtttacagggcaaaaaggattaaatgttagccaggaagagaattatgttaatctgttttttagtttgtctgtttgtttttagagatggagtctcacagtgttttgcaggcggacttgaactactggattcaaacagtcctcctgtctcagcctcctgagtagctgggacaaaggcacgtgccaccatgcccagccacattaattttttttttttttttttttttgagaggagtctcaccctgtcgccaggctggagtgcagtggcacgatctcggctcactgcaacccctcctctcaggttcaagcgattattctgcctcagcttcatgagtagctgggactaccgcacacaccaccatgctcggctaatttttgtatttttagtagaaaccaggtttcaccatgtggccaggatggtctcaatctcttgacctcgtgatccgcccaccttggcctcccaaagtctggcattacaggcgtgagccacggcgcccagcctgcctcattaatttttatgtgttgaatactatttcaagtaagttaaataaatacaagactagatctcattaagcagtttactcaaattaatttttctctattcaggcttaatctaatcctgattttctctctggctggagtagctgtaaagttggaatgcacctgaatcttttttgggagccagtttcttcaacggcttgtcgaaattgcaaaactttcaagggtattgtgaggtatcagactctatgccatctgtcttcatggctccaaggaagggaccccaaaactgctctttgataattccaagaaagtgtccaaatgcacttctctgcatcccattcacctttttgagccttttcccttcctttaatgaaaaaagaatagaaaccttctgaccacacatgcctatgtttgtgcacaatgagactggctcacatcattttaaaacggccgggcacagtggctcacacttgtaatcccaacgctttgggaggccaggctggaggatacttgagcccaggagtctgagaccagcctgaataacatagcgagacccatctctacaaaaaataaattagcgtgagccgagatcgcgccactgcactccagcctggggacagagcgagactccgtctcaaaaaaaaaaaaaaataaaaaaaaataaattagcacactgtaatcccagcactttgggaggacaaggtgggtggatcacttgaggttagaagtttgaaccagcctggccaacatggtgaaaccccatttctactaaaaatacaaaaattagccagggtggtggcaagcacctgtaatcccagctactcaggaggctgaggcaggagaatcgcttgactcaggaggcagagcttgcagtgagccaagatagccccactgcactccagcctgggcacagaatgagactccatctaaaaaaaaaaaaaaaatttagccaggcatagtgtcacacactgtagtcccagctattcggggggctaaggcaagaggctcgcttgagccgaggagttccagctgcagtgagctatgactgcaccactgcactccagcctgggtgacagagtgagacccttctctaataattataataataataaaacttttacatgagcccctgtagggtataaaaagattacaaagcccagtccttcccttccaagagctgacaatctgttggaacaggaacatacaaaagcaaatgaacagtataagtaaaaaaaaaactgtagccgtttgggaaaagaataaacgttcctgggtaggttagcaatttcattttttttttttaattaatgttttccactatttattctattgtaaaaatgttcaaacagaaaagttgaaaggatggtacaatgaacaccatgccccatcagttagatttaatacctgttcatattctgccatattacctatctaaatatttgctacccattttaaaggaagttgcagtcattgtataaggataaggtagtcagccttattcttcactatgcacctttttaaaaaggacatttgcctaaaatccataatacctttatcattattttttaatatcatcaaaaatctagtcaatattaaaattttcctagttgttccaaaataaatatggtataggatatagtataatatgattttgcaaaccagatttatacattgcattgatagttatatctctttagcttactttagtctggaagagttctactttttttttttatacattgacctttgaaagaaccagactagtaaatggtcccaaattctggatttgtttgtttctcaaggtgttaacttgtttttctagacttgatgtcctgttcaaataaaggacaggttgattcagatagaatcaatcattgtcctgaccggaagcagatggcatactcaaagggtctactgaaggatgtgaaatgaagggactatttacagatgtgtgggcaggcatagggaacaacgatggtgaggcactgtgggactgctggccctaggtctacaacagcctgagctgagtgcgttactgaagcattgcaggagctggagctttgggagaggggtccccaccaggagccatgatgtagcagcaacacaggcaccaccaaaactgcacctgggcagggagtggggtggtgggaacaaataccacaacatctctctcctctaccttcaaaacggctgttggaacccctgcgtggccaaatctaactagaagccaaaaagcaaaggagcctgggcaatggagtctgcaggggggagtctccaggggtgcagggcaggatggtgaaaggtgctgaatggatttctaagggcaatggagaatgatgagcacgcaactttgacatttttggctagaatgctttataggtcatgtgtgaacttcagattgcatcacatcaggggaaacgaaatgttaggttgtctcacccattaccaagctcaatttgacccctccgttaaagcaatgctagccacatctccctactgagattaaaggtgtgttttcactttgcaatcagcaagtgatccagcaggagacacttggcaccaggggattcacggttttgctccaataatttttcacgtaattgtttcagcatccatggatgttcttccctgaatcggtcatttcactgggagttgcaaaatgttgatttttctgagttttcttcccatatttggatatggaatgaaaatcatgtgaaattttatacattaaaaatagttaggctgggtgccggtggctcatgcctgtaatcacagcactttgggaggccaacgcgggcgatcacgaggtcaagagatagagaccatcctggccaacattgtgaaaccccgtctctacaaaaatgcaaaaattagctgggtgtggtggtgtgcacctgtaatcccagctactcaggagctgaggcaggagaatctcttgaacccgggaggcagaggttgcagtgagccgagatcgcccactgcactccagcctgggcgacagtgcgagactctgtctccaaaaaaaaaaaaaaaaaaaaaaaagtttaatataaaccatttcataaggttcaaatgattcaaatgaaaatatttttacctagcactgtttgggaaggaaatctttcctcaaatggagaaaacctacagttcttctaaaaagagggagttaatgttcacttcttctcctttatatatcagttgtcaaagtgaggccaaatgaacgttaaactgctgcttttcttctcctccttttcctcttcctcttcttctcctcctcctcctcctttttcttctttctttctctctctctcttcgctttttcttcttaagcccaaatcgtcccaaatttagtcagtgagagctccttcaagctaaccccttgataggccctgttagtcttggaggactttccttctggaactctggtacgtctaggcttacctggttaagttatatttccctgccccagacctccaaagaaccttggctaattttagtagaaaatgtatttagaggctgggcatggcggatcacacctattatcccagcattttcgtgggccaaacgagagggtctcctgagcccaggagtttgagaccagcaacatggtgaaaccccgtgtctcaaaaaccacaaaagtattagctgggcatgttggcacatgcctgtagtcccagctactcgggggctgaggcgggaggatcacctgagcccaggaagtcaaggctgcagtgaccaagccctgcactccagcctgagcgatggagtgagacgctgtctcaaaaaaaaaaaaagaacaagagaaaagaaaatgctatttagagaccagtaagtattctctttgctggtgagccgttattcttctagactcttacagtggacagagcctacgcatgcacacacacacacacacacacacgcctttaaatcaggagttcacattaacacttccaattcaaatttaatgttatcagatagcaggaatttatgttaaggagcaaggatttaagttggccgtgagaggtaggtacaatatcttttaaaaaataattattttctataatacaatcctacttacaaagaaaaacacaactaataagaaaagagaataaatgtatcaacaatctcacccttttaacacatccactcaatctcttatataagtccttggtggttaggattttaatatatagagagctgaagagaggagcttcaaacagggaagtacaggtcccaatgtagataaaggacctgaaatggaaagtttatatataacattactcatctttaggcctctctttaggccatactttctttggtgcataacctttcactgtctctgactgtcaaaatcatattcatcctcaagagctttccccgacccccaggaccccagcatagtgtagccttgccctacctgcagtgcgtttctgtggatctgataaccgctttcacttgatattgttaaaggtatgtgtggatctgctgtatctccctagctagttcccactagttacagtcaggaactgtatctggttgtctttgtattctaaaagctcttagctcagaactcgtatataagaagcttcctttttttttttttttttttttttttgagatggagtctgctctgtcgcccaggctggagtgcagtggcgcggtctctgctcactgcaagctccgcctctgggttcatgccattctcctgcctcagcctcccgagtagctgggaccacaggcgcccgcaccacgcccagataattttttgtatctttagtagagacggggtttcaccgtgttagccggatggtctcgatctcctgacctcgtaatccacctgcctcggcctcccaaagtgctggattacaggtgtgagccaccgcgcccagcctgttttttttttgttgtttttttgttttgtttgttttgttttaaggcagagtctcactctatcacccaggctggagtgaagtggctcaatttggctaactgcaacctccgcctcccgggttcaagtgattctcctgcctcagcctcctggtagctgggattacaggcatgcgccaccacgcctggctaatttttgtatttttttaagtgagatggggtttcaccatgttggtcaggctggtctcgaactactgacctcgtgatccgccacctcagcctcccaaattgctgggattacaggcgtgagccactgtgcccagccaagaactttcaataaacatttgctacaagaaattcaactgcagagggtccaaaaatgagtctaaagcttcacactatattgtgcagacccccataactgttcttcttgattaaaagaaactttccattgcctgtccatctttcaccctagttacttacttttgaaacctcaggcttatgttattctaattattatagttgcctagtaatacttctattttaaggctgcttctaattttcaataacaattttaaatacctttaaatagattatactatttttttaatgtcattaggttgagggtataaacaacattctaacgctttacaagggaggtgactgaattgccttctttataggtataaagaaaaagacaacctggtgatattttttaaactcaccatgatagaggcagatggtacattattgtaagagacctggaggtttctttcagctctcagattttaattgagctataaaatgtacacagtcccacctttttatgactaaactaaattggtttggatcaaaacttcatattggcaaatataatagtaatttcaataatacttacaatacagaaatctgtaggcctcattttcttatctataagatgagaaagttgaattaattgatctctatagtcatgaagcacgtagttatgaaacaccacataaatcttctgggagtctattattgctaagatgcatgcttctatgatattgattagaataatttttggctcctaaatcttcctaatagctgatagatttctaaagaacaaatttagctttattggatacctttagattcttaacacaagtactacagtgaggaaaaggaaaaaggaaaaatagacatattgaaagaatattagacataggtttgaatccaactctgctacttacaaactatataatgtttggcaatttacttacccttggtgtaatgactgaatgtttgtgtccctaaaaattcatatgccaatatctaatctccaatgtgacagatttgacaatggggtaggctgggcatggtggctcacgcctgtaatcccagcactttgagggccaaggtggccatatcatgaggtcaggagatcaagaccatcctggctaacacggtgaaccccatctctactaaaaatacaaaaaattagccaggcgtggtggcatgtgcctgtagtccagctacttgggaggctgaggcaggagaatcacttgaaccggggaggcggaggttgcatgagccgagattgcagcactgcactccagcctgggcaacacagcgagactctgtctcaaaaaaaaaaaagacaatggggtctttgggaggtgattagatcataaggttggagtccttggattagtgcccttataaaagagaccccagagagcaccctttccccttccaccatgtgagccacagagagaagatgactgtctatgaaccaagaagtgagccctcaccagacaccaactagctggggccttgatcttggacttcccagcctccagaactgtgaaaaataaatttccatgatcttaagccaccttgtctacggtatttggttatagcagcctgaatggactaagacactggtatttccatctaaaattaaatgataattcctattttgtggtattgttacaaagttaattagataacctagaagatagcccctggcataccacctggcatattgtagggaatgaataatgtttattgagatgccccttactatatagatttggtggaaagtggtgtttggatatccaggtcagattgtccattgtaattaagggttttttcgtcagcatcagaaattacaatggtagcttaaacagaaggaaatttactaggaggatatgggagagttcacatgaaagggaagctagagaaccaggccagcagatgacaaacagtaaggccatgtcagggtctgtgtagcgaaatattcccatagtctagacagagtgttgctttgtctagtgttactagaatatgtgagcttagctattttccgtctctgtcacactgattgagattcagttcccttttagattagcttggttttacagtttccacctggctaagggtagtcagggcaaaacagtcccaccagaattcaccaatgagagagaagcaattcctcaaaagaagaatattaatgtcattgccaaaagatatgactagatacaggactgccaacattaaaaaatataaatttccactaatccccaacactttgtattgtgggaatctacaaagtgtttaggactgaaaagtactatatggaagagcttcagaactccccaaaacacccagttcctgcatatgcaaaagttaccaactgtggattgaacaccttcccccctagtttggaaggttattccaaaaacaaacagttgtaccctagttatgcgctgtgtaccccctctctctcctttatcaaatcctgtgacacaagcttctatctcctcgcatccattcatcatcaaaccctgtgcctcgctggagccttaaattcaagtctttgcctgatgaaatttctgggtaccaacgcagttagtctcctgaatcttggtacctaacattttcctttgatattgcactttatttaattgaggtggtatctatgtcacctacctcattatgcttagtgtgtgtgtgtgtgtgtgtgtgtgtgtgtgtttcagagtaaaatgaaacctgcaagcgaacattttcataccactatttactactaagtataatacagtctaatatcatgtatcctgagcttattataagacagagtttaaaaaaacaaaaaaaacaaaaaaaaaaacctcatcaaaccagtgaggaactgacaagtacccagggatctggtttctagttcagatttgccatgataatctaggatgccatggactctttacttatctctctggacttgcatttcctctctataaattagaggcttgaatcatagctggtctctaaatctctccctgcttttacattctatgatcctacagccagaccctctataagagctaaaaagaaaagctaaagcaaggcgagggaacgatgagaccacggttctaggtgaggtgccatagtcaagaaaggcctttctggggaggggcagtagaactgaagctgaaggaaatgagggagccgacatgtgagtatctggggtacgagactctaggtacagcctttcttaatgatggtaggtaatgctcttctcagcatgacaagaatttcatcctctaccatagttcccatccctgtcaagtaggaacaacgcatagagagagatatgccaacccaagacaggccccgcacaagctggatggggcacaacagggactgggtggtcccatgactgagctgaagtctagaagtcatggtgtagagggtggggacagtcaaatccagtgagcagatccaaacaagtcattggcttaaagggattattgaagaatggcatgcgagattgaatgggtcggggaaagagaaaagctgaagtcctaagttgtaaaccagaaattgtccagaaagctgtatttcgaaccaagagtaatgacctgtaggagagttattacatcaatttatgggtcatgacccgtttatttttttaattatattagaagagaatgaacttaccagtgtaatcacataaagggcaagtgattgttctgtgaaacatttttttctgttgtaaacatgtattgttgagtcattttgtagaactgacttctcattgtgagtgatagttttaaaaaaaattaaagccagtggcctagaaaaaattccaggtatggactgcagaggccagtggcagtttttctttaaagatttagtggatgggctgggtgcagtggctcatcccttgggaggccaaggcagcagattgctccagcccagaagtttgagaccagcctgggcaacatggcgaaaccacatcttacaaaaaaatgcaaaaatttgccgggcggctgtggtggcgcatgcctgtagtcccagcactttcgggctgaggtgggaggatctcttgaccccgggaggaggctgcagtgagccgagttcacaccactgcattccagcctgtctcgaaaaaaaaaaaaaaaaaagaaaggaagagaagagagaagaaaaaaagaaagaaagaaagagagaaaggaagaaagaaagaaagaaaaagaagaaagaaagaaagaaagaaagaagaaaaagaaagaaagaaagaaagaaagaaagaaaaaagaaagaaagaaagaaagaaagaaagggaaagaaaggaaggaaaagaaattaatccttacatatggagcttttttaaaatgttaagtatactagaaaagaaagagcagaatccagaataaaagacttctgctcccccaccctctgtaacaagggaccagaggaccccacctaccctcaccctttgtcaccactatcaccatcaccaccacccacaaaaagaacagcctgatcccgacatgctgggtaaagaattgcttgtaaactgaaagagagaaaactcaaatgcccaccaaatatgagaataacaagtaaatgaacctgaccaagtgtaagaaaaatgggaacggtgggactctggtggaggaaatacttaagccctgccctgcccaagaggggcagcagctactcagtctcagcagctgttgtgcaagaatgtggaccaagtgttgtcagatcttggtattttttcagagatactggaaatccaggtttttataatgaaaaacattttaaaacactgggtaagccaatgaaacatgtctgaaggcctaaacacactcacactacaccaagtgtgaatagctgcttgtgtaggtggtgatacttggggtcatttatattttcatttttacatttcactgcatgttcagaattttaacagtgaacatcattttacttttataatgagagaagaatgaaggttgtaaatatttaaaactctattaactaaacaggtagacatttgagttttctctttttagtttcaagcaattctttacccatcatttcagacaccaggctgttctttctgtgggtggtggtgtgatggtggtgacaaagggtgataggcaggtggggtgccctggccccttgttgttttatctgcattaagatcaggataaaacaacaaatgttacagaaattttctctgggtgaatgttacatgtgactaaatttttatgttatgttttacaacaaaagtttgcagtacatcacaaatatttcagcctaactacagcaatatgccaagtctcaggtttgctgattcgaggtttgtggcaccatctttggctattgtttgcccatcaggacttatgaaagcaattgcttgttccatatattattctcatttctacttaagtatttagcccagcttctataatatgcaagtcttctgattctggctagatattggaaacaaagaacaggcaattcttcccctggagtaattnnnnnnnnnnnnnnnnnnngcgaatttgtattttttgtatttttagtagagagggagtttcacccgttgctcaggctggtcttgaactcctgaccttgtgatccacccgcctcagcctcccaagtgctgggattacaggcgtgagccaccacacctggccagcattttttttaaatgaaagaaatggaacagacctgaacacaatagtgccagcagtgaagataaatattgtttattgaaatttgtgtgttgttttatatagaggtacgtataagtggcagttgtggaggttaaaatttttgaaagctactttactcgaccaaagttgaagccttggctttattttctgcattgagctcctctgtaaaacagagaaagaaaatgtctgtgtgtgtgtatgtacattcatgtgcatatactatgtgcatgtatacatgtaattatcctaaaagaatttcagaaaaagcagccaggtgcgtggcttgcacctgtaatcctagcactttgggaggccgaggctgatgggttgcttgaggcaggagttcaagaccagcctggccaacacagcaagaccccatttctaaaaaaaaaaaaaaatttttttaattagctgggcatggtggcatgcatccatagtcccagctactggagaggtgagacaggagggttgcttgtgcccaggagtttgaaggtgtggtgagctttgatcacgcatcacattccagcctaggcaacagagtgagaccctgcctctaaaaatcataataataatgataaaaataaaacaagaacttgagaaaaaggaactttttaagaggagagaagaaatccccattccccaaatagatggcctagatctgaagatgtttattccaagggtaaacttttcatactaatagtgtttactgagatcttattgcatgccaggcactgagctaaacactccacattaatcctcccaacaaccctatgaggcgaaaataaacaccaacaaaacaaagaaaccccacaaacattacagatttaaaatctacaggtaacagataaccctccctccctgactccccctctgtctcccccagccccactctacgcaccccctcccatcctttctctctctccctgttcatatttctggaaaagaaaagaagaatggtcaaaaagaagggaaaagggaaaagaaaaccacggaaataaaacagatgggacaagaggagaggaggaaggagggaggtgatcaaaaggaaaggaggagcatattgagcatagttggtgccgtaccatatactgccaataaattctcttttgagtacaaaaccttgcatgggactgttgaagaaggctcagtctttagggtggagtgagaaagacagagcggtgtggtgtgccaaaacaaactcctactttctcattctgctcaagtcagccttgacacactttcctccaatgtggcaggaacaccagctacagaaaaactgctccgtgaaaaccactatttaggtactgatattagcatcttgtgcagggtagcctagagtttgcattttctcctctcaggagccctctatatccatttgatttctgcgatgtacgccagcggctttggctcagtgttaatgactttgttctctttgaattcctgtgagattttattcccttggtgcccaggcgttgtgtgccacagtgatttctgcccagtaagacttctgctgtgataaaaagaaactgcagggaaggcctgctgcttgtcctctgccggttgctgctacccgacaaattactcatactcccattcagagaatgcgagagagtgattctgtttccatggcctcagcctgagactttactctctaataaactgagaacactaagccatgtgctaagcgcacatcgcactacctggaaaaggcaccttctggctagagccaagtggactaatcatgtctggatagcaaaaatgttgtgctcagcaacctagctctctctctttcccaattatgagacagaccacagagctggtaaaccacgttacttgtagacaccagcattgttgtttatgctatcatttcattatgttttgaactagggttctgttggcttgcttgcttcccccgccccatctccctcccctattgaaggaagaagccaaggtaggaaaatatctgcttgaattgttcatgaaatgtaaatttctactttaccatggaaaaccagattttagacactattactcatgctggctcagaactcaatttttaacctttctgaccccacagaaatcacagaagtatcccctttgcttctattcttctacctggggcccagatttgatctgtgtcaatgccactctgaatgcaggacctctattgccttgggccaagcaaaggtacaggaaaaaacttcaggctgatcactctcagcaaataacacaggaacagaaaaccaaacacggcatgttcttgctcataagtgggagttgaacatgagaacacctggacacagcgaggggaacatcacacaccagggcctgtcaggaggtggtggcaagggaagtgaaggcattaggacaaatacctaatgcatgaggggcttaaaacctagtgatgggttaataggtgcagcaaaccaccatggcacatatatacctatgtaacaaacctcacactctgcacatgtatcccagaacttaaagtaaaaaataaataaataaataaattgtcagaaacaaataacattccttaaaattaaaaaaatttaaaaaaaaacttttttaaacttaggctgggacaccaaaacccgattcctgatccagcctttaaaagcaccccaggccggaatggtggctcacacctgtaatcccagcactttgggaggctgaggtgggtggattacttgagccaggagttctagaccagcgtggtcaacatagcaaaaccctctctctactaaaaatacaaaattagccaggcatggtagcgcacacctgtagtcccagctacttgggaggctgaggcggagaattgcttgaacccaggaagtggaggttgcagtgagtcgagatcgtgccactgcatccagccgaggtgactgagcaaggactctgtctcaaaaaaaaaaaaagaaagcatcccaagagtctcaaggtttatataggagccgcagaaaaacagttctcaagtcaaaatgaattcaagctgctttaattaaatgccttttagcactgtgttgaaacagatgaagattttgttacaaatcaaaaaacaagtgattctctagtcttgtttttgttaccagcttcccactgacctattttaaattgcgtgaaaaatgtggccttccccgctccccctccttcctgtcccctctcccctgacctctgtacctcttctcccttctggttctgtcttccataggctctttcttctcccccacttatctcaggtagggtctcaaagctggtcttcatgttcccttcccccttctcccgatgataagaaccctaaccttgtgtcttccctgtgtatctctagaagggagatacccaatctctagacatgactttcatggatgttccaatcacttgaatccaaagggaccgcttatcccctttgctgggacaacctccatgtatgcctgttgttgtaccttattattaatagtgcaccgggcacggtggctcatgcctgtaatcccagtactttgggaggccgaggcaggtggatacctgaagtcaggagttcgagaccagcctgaccaacatggtgaaaccccatctctactaaaatacaaaaaatagccaggtgtgattgcgcacacctgtgatcccatctacttgagaggtgaggcaagaaaatcgcttgaacctgggaggtggaagttgcagtgagccgagattgtgcactgcactccagcctgggtgacaaagcaagaccttgtctcaaaaaaaaaaaaaaaaaaatagtgcgcactttcactctcacaggggtcttggacaatatattatttagtcattctcctaaaagcaggattttcttcctgaatatttacttgatccaacatttcctccctcagctactctttttctgaagctctggccttcttcccagcatttgcatttctgtcagtgcttctgacgtcttccatcttccagaacctggaagccccggcatcctgttgacgcctccctccccatctatcttagccatgcagaatggcgacaccaaggtcaaaggaactggacataactcctgactcatcacttaccagctctgtgcccctgttcacctctggtctctgcctcagtgctgtcattgtaaaacaatgagaacaatacattccttgaacagcgtcactggaagcataaataaggcacttctgaagggccactgggcattgtgcctaacaaaacaaatctgacttcttatttatgttttattcaacacatttattgagcacctactgtatgccaggcactgttctagttcctgggatacatccataagcaagacagtcaaacacatctgtcctcatagaactcacatcccagtgagaaatctgacaataaacaaataaagagctcctaggtcaagtagtgataagggctacaagagaaaaccagacagggtaaggggaacagggagtgcccaggtggagaagggctgctacttaaaacggtggctaagggtcactaataagatgacattcaagcagacacttaaaggagaaagaggtaaaggaattatctaggcagatatttatttatttatttatttatttatttgagaagagtctcgctctgacacccaggctggagtgcagtggcacggtctctgcccattgaaactctgcctcctgggttcaaacaattttcgtgcctcagcctcccgagtagctggagctacagcatgcaccaccacacctgattaatttttgtatccttaatagagacagggtttcgccattttgccaggctggtctcgaattcctggcctcaagtgatccacccacttgggcctcccaagtgctgcgattacaggcgtgagccgccacacttagcctaggcagatatttaagaagaacggcttgggaggccgaggcgggcggatcatgaggtcaggagatcgagaccatcctggctacacggtgaaaccccgtctctactaaaaatacaaaaaattagctgggcgtggtggcaggtcctgtagtcccagctactcgggaggctgaggcaggagaatggcgtgaacccaggaggcgagcttgcagtgagccgagatcacaccactgcactccagcctggagacagcgagactccgataaaaaaagaagaagaagaacaggcataggcaagttccctgaggaaggcctgatgtgtggaggaagtcagggatggcagcctcgtggagtggggtggatgcctagtagggaatgaagcagtggaagcgggattcccacacaggcctcgtagatccgagcgaggcgttcagcttgtctcggagtgcaataggaaagctgccagactgcaaagcggtacctgtgaagagattagaccccgggcaaggccagaggcagaagggttaggggaacattgcagtaatccacacaagaagtacagtcgcctggaccagggtggcagcagtagaggaggtgagaagtggacaccttcccttgaagtctctccagtttcccactgcatttccctctcacagccacagtcctgtccctggcctcatcaccttacccctgaattattgcactagcacccccactccctcactggtgctcacggactgcccgctgcccctgctctcctgttctcaccttcatcacatcattcccctgctcagaaatatgactgtgccttgcccatcgtccccaagtccaaattcctctccctggctctcaagccttccactgagttctacacactcaatgttcttctgaccataaaccagttcctaccagagtccagcaccaattcagatagtaactggcttacctaatgaccaagagatctgctattcatacccaattcaaaattaactggatagttcttttaattgggtcatagaaccagagttccttacaaaaacaattaacggttaacattgattaaatgcttactaagttccagacactaattaagaactttaccaacagcatcccctccaattgtacaacatccctatgaagtgggtactttattatccccaactttacagatgaggaaactaaggcacagaaaagtaaattgcccaactcacaaaggcagttgcgggggcgggggggggaaggaggagctgagatttgaatccagaagtctacctccatcgtcaacacccttaaccatggcactccattgcctcccgtacttggaccggtgtatcaggtttcttcatgtgaatcattaaattctaagttgtgtttacagcaaaacctcattactgccccccaagcttttgctaagcattttgtcttcttcctgtctctaccatcctaccatgtcttctacctatctctaccatgccaaatcccacccagctctcaaggtgtaatcaacttcctgattttccacaaaacttctctaaatacatgagacctcactgaacctccatcttccagctatttgaaatccacttcaaatcactatgtttgatttttttttccatgtgtttcccaactatactggatactgcttatgtagagcaaccataaattatgtttctttttattctctacagtatgtaaaacaatcctgagccattccgttcaacagacattttaaaataaacctacagtgagctagatcctgtgtggctcccgaaaacacagtgaagacagtactcaaaatacttgtgtgccagatgtggtggctcacattcgtaaatccagcactttgggaggctgagcgggagaatcccttgaggtcaagagttcaagatcagcctgggcaacatagagagacaccccgccatctctacaaaaaaaattttgaaaaattagctgggtatagtggcacaagcctgtgtcccagctactggagaggctgaagtgggaggatcacttgagcccagaaggttgaggcacagtgagctatgatcacgtcactgcattccagcctgagctatgatcatgccactgcattcagcctgtatgacagaacaagaccctatctctaaaaaaaagaaaagaaaagaaaagaaaaatacttgtagaccaaatgagaagatccagggaaatgcctgttgaaacataattatctatttaattaacctttttcatataaatgccatcagtgacacttcagatacaaacatatgatttcatgtcattttaatataaattcattgagcatctactttgtgcttgttccaaaaaggatgagacaaagccctgccgtcagagaatcctcagtctgtgttaccatatgtcttagggcaggttggagatcaagaatagaaaagccactaaaatctacttaggtaaaagagaacagaagtaagagagaactgacaggcctgctgtgggtgattggaacagaaaatgaccaaagatgttctttcttcattgccatgttatctcttcctctgcttccctcattttacatttctctctttccccaccttttctccctccccatccaacccattcccagattgccttcctttgctctcctttacaccatccacagtggcttacactggctggtgccctcagcttccaacacgtgctagtaccgtccaggtccagcattactgtctgttaacttgactgtctccattctaatcccaagttccagcaggagactccaaggggcctaccgtggacaggtttccaactctagccgaaacagtatggtggggagtggggaaaggatgcccaaggtcatgctggatggtatgcaagggactgtctttctggggctggactcaaaggtatgggatgatggcttctgtaaaatataatgtgatgggccgagcatggtagctcacgcctgtaatcccagcactttgggaggccgaggtgggtgattgcttgaggtcaggagttcaagaccagcctgaccaacatggtgaaaccccatctttataaaaatacaaaaattagcccagcatggtggcaggcgcctgtaatcccagctactcgggggctaaggcaggagaatggcttgaagccaggaggtggaggttgcagtgagcggagatcaaccattgcactccagcctgggcgaaagagcgagactccgtctcaaaaaaataataatttatatatatatgtataatgtgataaatggtctaatagttgctctacaatacatacacctcgattcacattttgcagacttcacgaattcatagaattttacaaattgtaaaggattccagaatcatttgacacaatccctacacttgagctcattgtaaaccaaagcctgagagcaaaaagggtggattccgtactctctgacttctagtctactccaacatttaccaaaccagagcgtttaagaccacctttgacatgtaggtgaccaaagatagtccacactgcatcatagcattggatttgtttgtcttttttagtataatttctgtacctactaagaactttcacatatatatcctatctagtcctcccagcaatcatgacaagaattgttaagcctattttgcagatgaaaactgagacctaaagaagtcaacagacttgcctacactttacagttcatatcaggcaagccaagatttaaacccatacgatttcacttcagacctccctctttctgctatgccatgcgccttcactctctgggaatcaatgaaatgtcaatttgtattgtttgtaatgtttttctaatgttatgatgttttatttatttatttatttatttgagacagagtattgctctgtcaccaggctggggtgcagtggcacaatctaggctcactgcaacctctgcctcctgggttcaaggattctcctgcctcagcctcccaggtaactaggattacaggcactcggcaccacacccactaatttttgtatttttagtagagatggggttttaccgtgctgaccaggctggtctggactcctgacctcatgggatccgcccgccttcgcctcccaaaaagctgggattacaggtatagccaccgtgcctggcctgttatgatgttttaacatcttaaaaatctagctcaggagagctgccccttttgggttagccagttcttagagatagcagagggctcatggagaatgccttgttatgaaaactaaccagtccagagccatacctcctctaccaggaggcaatattcctctccttaatcatcccaggctgcataccaggaaactaaagactactcctatagcccaaagctacaggaattattcaaactagccaattccagtttcctctgccctgtcttccccatgaaaacccagtaaagatgcctcctgtttccagaccctctggggataataaactttgttttcctggcctctgatgtgtggcctcttgtggccacaccccactgaccatcacataagagaacacaaacacaataacaaaaaaaaaaggattggaaaagcagactgagaagttcagaggatccttagtaatgttcaaggaattagcatgtacgatagaggagtggtcaaaccataatgc

SEQ ID NO: 5107 - DNA, 100000 bp, Homo sapiens
aatgttatcagtgggaacaccctgtgttgataaggttgtaaacaaacagtaatatgctgttctgcctgtgtaacccttccagatagcattgtggctctctgtggcaaaggccagtagggctgttggatcaaggaactccagttctacgctctacaaaggtatgctgaggagatcaataatagaaggaaaaagctgtatgcataaagatgctaattgaaccattagttctaacagaactagaaataacctaaatgtcccacagtaggggaatgggtttccaaataatggcccatcactatgtgatatatgaggtagccattaaaataatggaaaactttgagaaataagatgacttgaggggggaagggaaaaaaagggggggcatgaagccaaataccatgaatccttgaaagcaataacataacatctatagatacaactcagagctgtttgttcagtgattatatgaatataatttgtgatattacttagtattctaaagtgacctcagctaaactagcttggatatatgaaagacacaaagagttaatagacagggtattgctattttagatttttttttttttttttttttttttttacataagcttctaaaaatggtgcctgctggtgaacagaatgggcagtgtattgcaagccaagtctttctggcctagtgttgaccttgatgaacgtcatcaggcctcctcactggagttcaaaacaaaaccactcataaccccattttaaaaagcaaaaccacaagcacagccttcagtcattgctggggaatgcttcaatttcttgtttcctattgataagttgcgcaaggtctcccttaatcaggtgtgaaagtggaaactggccacctttggagttgaaagaacttagggagagagagggacttggaagaaaacgactgcagagaaactggcctactcttctgtttgggtggattctgtagcatcagatgagcgcgaagaactcgggatgttgagtccatagaaggtgcagaccaacttacagtcagaacaggagagagggcctattgagaaatgtaggaaggctgaagccaatattgctggataaatggcatgtacaaaaatgatttgtaaggtttaactggacatttcggtatcaggagaagagccagagctcattcttaaataggaaatcaactgtcttcccttgcagataattcacccattgtatgaatgtaatgtatatatgcttctagtcataggccacacataaaagtagtgtgtagtggaaggcccatgggcttcaaggcagatggactggcttcacatcctgactctgctgtctaccagctatgagactgtggagaggttacttttctctaaaactcactttcatcctatgagcataaagtgatttgcctaacccatcaactggacagagtatgctcagtaaatagcatctgaaattagaagtagcagatgacaccgggtgcgtggctcatgcctgtaatcccagcactctgggaggctgaggcagttggatcactttagggaggagttcgagaccagcctggccaacatggcaaaaccctatctctactaaaaacacaaaattagccaggcatggtggcgggtgcctgtaattccagctattcaggaggctgaggcagggaatctcttgaaccccggaggtggctgtggcagtgagcaaagatcgtgccgctgcactcagcctgggtgacagagcgagactccatctcaaaaaaaaaaaaaaaagtagcagatagagaggatcattattacataaatcatatactacaaatacacacatatatgtacacagaggctctcaacttactatggggttaccgtctaaacccatagtaagttgaaaatataagtcaaaatgcatttaatacacctaatgtattgaacatcatagcatagcccagcctacctttaatgtttcagaaaacttaagtttacctagagttggacaaaggcatttaacacaaccatttaacattagcctgatttattagagggttgaatgtctcatgtaatttattgaatgctatactgaaggaagaaacaatagtcatatgggtactctaagcacagtttctactgaatatcacttttaatcatcgtaaagttcaaaaatcataagtcaaaccatcatgagttagggatcatctgtatcatatatgtgaatatacacatatatatgcaatacatatatgtgcatatgcacatgtgcccatatatgtgttatacatctataatgcctgtgttttacatgtatggcacacatatttgtcatgcatacatgtacatatacacatatagatgtgcacatgacacgtatacatatacagagtgcacgacatatatacatatacacgtgcacgacatacatatacagatgtgcatgacattacatatacagatgtgcacatatgacaaatggggagaaatagggttggccatagaataactaaaataggaataataggaattatgccatgcacttgctcacctgtcaagaatttatcaagaaatagccaaggaaataagattgatgtgtctggcaagagaaaatggcccatggggacgacagtgtctgactgagtgggttcagggagaaatgggcatgagggggcaatcgctactgtacggggcctcagttcatcttcaagtaacgtagataacttctgataaagtggagtaggagttgtgctttgtgaggactcctacagacccaagatgtaaattcctttatagcagaggcttggaggggtttactttaaaccttgaatttccaggatgtagcacttggtatgtttgttaatgaatgaatgtatgaagccttggtctatatgacttggaaatcttgatttgggagaatcccagctacccttacaaagttccccgaggcctcatgttgtcagcctgcagatgtgaaccctcaggatccacagaggaggaagtcagcatagaggccctagacacggccaggaagcaggagccagcatgtcctctcttggttctctttgacattttgcacagcaccttggctgatgatacccaatatcttctttctcgtggctttactttcacttccaccaaatgcttgaagcataactgagtcagacccataaagtcacctctctgatcagcctaagattttaagatggtgcatccaggccaggcacagtggttcatgcctgtaatgggaggattgcttaaggccaggagttccagctagcctggtcaacatagcaagaccccatctctgtttaaaaggaaaaaagatggtgcatctaccagaatggatatagtcaacttatggaaggagcagtggcactggtgcaggcaatctcatgaccttgaaatcaaacactcctgggtgtgaactgcagctctatcaatttatgagcttatggacaacagcagattgacacttcttggcctcagctttttcatcagtaaaatggggaaaggggtgaactggcaagactgtagtcatattagaaatcagatgtaatagccaagcatgtagctcacacctgtaatcccagcactttggggggctgaggtgggtggatcacctgaggtaggagttcgagaccagcctggccaacatggtcaaacccatctcgactgaaaatacaaagttagccaggtgtggttgtgggcacctgtaatcccagctactctgaaggatggggcaggaaatcgcttgaaccggggagggaggttgcagtgagccaaaatcacgccactgcactctagctgggcaacagagtgagattctgtctcaaaaaaaaaaaaaaaaaaaaaaaaaaagccagcacagtggctcacacctgtaatcccagcactttgggaggctgaggagggcagatcacaagtcaggagttcaagaccagcctggccaacatagtgaaaccccgtctctacttaaaatataaaaattagccaggtgtggtggtgtgtacctgtaatcccagctatttggtaggctgaggaggagaatcgcgtgaacctgggaggtggaggttgcagtgagctgagatcatgccattgcctgcagcccgggcgacagtggtaatgtagcctgcttagcacagtgtgtggctcgggatcttgtcacaatgatggaaattattttcctgaacataaagcctagtcacccagaatcattcttcagtggttatttattaagtcagtaagtttgctgtgtgacaggagcagttcaaggtacgtggccaagttgtgaagaaaacagacaaatttcatggagtttcttatagtgggtagacaaaaaaatagacacataatgtgtacaataatattaagtgttgtggagaaaaaatagagggaaggggaataagaatggggtgacaccatgaagacagggataacgtgagcagagactaaaatcagtgaggaagaaaggcatgctggtttctggaaggaaagcatttcagcagaggaaacgcaaatatgcaccccttgagttgggagtgtgcttggcatgttcgaggaacagaggaagatagagtggcttctagtggataaagtgctggaagttgagattagagaggtagctggagacaaattataagagaagtagggtagaaaaaaattaaccttagtgagctgagaagctgtatcgttagcttttgctgagtaacatgtaatcctgaaacttagtggcttaaaataaacttttatatctttttgcagtgctgtgagtgaaatgtgcagtttcttctcctctgaattggcacagtggggctggatagtctgggatggcctcacttacatgtctaactaactaactgctggatgcggttctgggagtgactacgtgtctctcatcatccagcaggctagcccaggagccgttcctatgatggaagttgcagggttccaaagatcaacaaggaaaggcaagccccagtgcaaacactttccaaattggccaaggccagtcacatggccaaagtcagaggtcatatgggagggtgatcccctccaggtgtagattctgagagtggagttctgacggctgcttttgcaaatgaaataatgtctgaaaagtgacattatctgattcatagtttcaaaggtcctgtgataataagattacgtaaggaagactatagccagatgggaggatgtggcaaggctatgggccactgggggcaatggtgtttgtttgttcgactgctctgcaccacagatgcagaggcacagaagttaagacattgtctggcctgaagctgccatgatcaggagggggaacaatgacacccagcctcacaccttcctggtatttcagcagaagcattttctccgtcttgccagagtggactttctatgtgcttgctggaacgggctggaaagcatggtgtccatgagatgggatgcgcagataaagcttctgcacagctcccattctcaaacatagagatacccgctaatcaatcactaagtattgctaattgcaggggagcagaccattgaggactaaaataactcactgtaagtaagtaaaacaaaacatcttaaggtgaaatgaaacaatagtcatttttcttttttctttctttcttaacagaaaatatgctggcatgctaatcgcgtgagacaacttggcccacggacagccacaagcacaaaaacaaaacacaaactcactcagagaagaaacaagaatcgtgttttcctggctctacgagaagcgctttattagaagcgctttatttttcctctagatttcttttctaaaaatgaaaaacaaaaacaaactgaaacaaacatttaaagaaacaatacaaacttcaggtgagatattcaagcatgttcttttattaagcgtaggatgcgaggcacagcaggaggtttaagacaatgtgaaagcaagagaactgagactgtgattgacagacaaagggattaactaacgtttattctctgccccccaaaatatcctgtgtattcttaagtatatacgcttcccttcctgctttcaaggtatctaaggaatgatttgaaaaatttgttataatctctaaagaatttttttatagcattagcaaaggagtctatgacaagtactttgccacctggtagttctgcgtatttactccctctgggtgtcactgtcatcctcactggctgggacaaggttctgagatttgtcccccagcagttgctaagctggctcagtcttggtcaggatgaatgaaacaattatctcctgatcaatgcagcaaggagcagtgaacacttgctttttcttccctaagtaggagaaggccgcccctggctgcagtggtggccgtggtggtagctggatgggacgaggggacctcaggctttctataacagtaaaagaaagagaattgctggtgcttctccagggagatacggaacctaacgccaaccaggtttttactttcaaacaggccaccaccagaaagcaaagagacctatgctagcccagccccagaaaagtgatactttaccccaggaattccctgcttcccattggtactaagatttttcactctgttgtgaatgctcttatttcctttactcttgcggatctgtgttgagggacatttggaaggggcccagccctggcacttgcgtgaggggacacacacagggcggtgtgtgtgcccatccgctctgagctccacttagccggactggctgccaagccgttcttgatcagcctctcgctgagcgcccacagggtccgggccgtctcttcgctctgagcttctgtgagggcatgcagcggcagcagttgttgaagtacatccctcccagaccctccagttctggacagcagcacagtacacggtggtggcagctccctgttgctggaaatccaagaagaaagcaaaaaaaaattttaagaaaaggagtgatgagatggcgtcatttcgactgcctgggcatagcaggcctcccccacctggttcagtttcagctggatcttggcatagcaaagggtactggctgaaagcacatgactgtaaaaagtataatgtgactatcctggaaaaacgagttcataactccgcttgtaaagctggtgtaacttttgacacctcatacagggacaggcttggaaaaaaatacacatatcaatacgtcgtggcaggcgcctcttccacacagagaaaaagatggtaccttctgaacgtgcaagaacaaattcatccaacccctcgacttctccatgtataatgtattcgataccaaatcgtttgtagaaccttctgtctgacaaaccaaccactcttaattgtgtccatcaggtagaaaacccaagtggggctgctgccagatcatccctttatgctttgccccggtgctgctaggggaagggttggcaatgttgtgttaaaacatttaatgcacacacacaacacacacacacacacacacacacactcctcaccatacattcatacttagcacaaacactaacacattaattcatccagatcccatgaaaacctttttctaaatgtcatatttgacccgatttacaatgggaccacaggtaagggggtacatttcctcccagcccacttcaaaatgtagttgcaaagagtgcagctgatcactttcattcaccttttgagtaacagttggggctgtgctagggacgtgtgcagtgatgaggcatcatatcatccaaactgacagaatactgtcaggatgctataaagagggcaagaaatcactttgctttgcaagccataattaaaaataatagctgctgttcagagggagacatggtcggcacgtctctaatttaaaaccaatacagtttattggcatcttatgattatttatgtgtttcagagccctagctgcatccactaattttcagcgatgagagggagaggggttgcaagagaggaccggaaaaggtaactgaagataagctcgccccacaaggaaaacactaaggaactttgattgtgggggaaatggctttccgacccgaccaaagcttatcatttttctgcccctgcagggtttacattgtgaccatgcagggtgcttacagaggagtttccctcaaatggtctggtttgcaatcactatgcttgcattctaggatcccgggagagtcaggtccatactgagaaatagggtcccaaggaaggtgttacgacgtgaagatgtgccataaggcagacttgggtttgttgttgtcattgttgtttggttttagcttcttcgtgtcaggatatctagtaacaatggagttggtctgaaaactgaatggtcaaatgcagtcagtgatacgactctgggcggggtgtggaccgtgagtgagacaaagacttgggttttgatataactggctgcttgatgatactggacaagttccactggtcctgaatttgaataactgaatgacttgaacttaatagtagctggtttgttacctccccaatctccctccattatcatgccactccaaatagccagatattatcctggattcagctgtttcttttcccattgatttgttggctcaagtctaatggaaatgagttcatgtcatccaaatttcctttcactgaattattttcctaataaccctgagcttagcacctggcacatttatctaaacaacttcaaggggttttctggctcttctgcatcccatgtggggaaaagggaagcagaagtgcctctaaagacaaatggagaattgagatgctcatccagctaactcaagccaagtattattttggcctggaatctagagttctggtggagatggtgttttgtatcaacttccagatatctgtcatatattttcttttaccttgcagctgccaaaacgaccagagtggccaagtgacttgccattaactcccggtggtgggagaatccagctcacccatttcaagtccagcctcccgccctctatgccacaaggttatactattcagcattcaaacgtcatgacagactggcctttcactgttctgccaaggtgaggaaagaccaaagcagtccgtttgggaaagcaaaaagcagaattcttcctaacctataaaatattttgccactatgacctactgtaatgataccacgttgcactcttgcattacggaatggtatttttgctaagaaattctgcagtcccattgattcagaatgccattgttgcggagctggggacctaccttttccttccacggaatctaaaggcaattacaactggcttcattcatgccaacctacatttggctacaatgctgagagccatacctttttgaaaagcctaatttttatcaggagatggctttgattcctttgccactaggcttggggtgatttaccatctaattccatcacaagtggctctggctttgtagaacacagtacacaggaggggcacccgaagcaaagacgaccttctctactccaaaaatcaatcgtccacctttggcaaattctccttccagattcatgcttggtgctcatgggtactcactctactttcctcccttgctggacaattagcagtaacaatatcttgttggtcccatacacaccacacctttggtctcttggagaatttcagccgtaccaatggcaacctctgagtgacatcttaatatgatcagatgtgatgacagttagtaacaggttctcatttttggctcaccagcttttcggcctacatatcatcagaatagactgaggcacattagtgaaatctcaatagtaaacaagcaggtactgccaataaaagagaagcattcttaaactgattaaaaaaaaaatttaaagagcactttaatcaccatcagatgctttcattcataccaccttttggggcatcagttcataatgcagaaaagatgaaagagcctctaaaggaaataatgttaacaactccgttataaaatatctgaagcaataccttgccagtgtcatcaatgcttactgatccattgtgataaataataataccttgacatacaaacactgctggagctatgggttcccctaaacgatttttttttttttgagaatcaatcatttatcaaagcctgtaggttgtatatggttgctaatcatgggaaacgggggaggtgtctatcccgcgcaatggcaatgagttaggttgttgacgacacaggactgagaatttctgggaagcccagagaatctttttaatcatgcccgaatgccatttccgatctagtcaaacatttgtgagctgcagaggagaactgtgcaatcaatcttgagagtatatgtaaaattacccaggactcttgttgggattaagagtatcttggtaataaggattcatcattctctttcaaaaatcatctgtcgatttgcagcacaatcttcaactacagaaaggtgggatttagaaagcagttgctgtttattatagttgaggccctcagatctaaattatccatccttccaaaactcggtgttgggatgaaatgttaagtagctgcttttcatcaacattcatttgataactgctagccatcaatttaagttgtcagcacagaatacaaatgaatattgactcctttaaaggaaagggtacagaggttctgataaacaatatatggtaaagaaaaaaaaaagcacccacatattgatatttgtaatcattggttagtactctaatataatactcacagggacacatgttacaccgtgttttgcttcaggtttttctattttaaaatgcatgctcatttaaaagaaagaggagattcctgtcttaagtagacttaactatgagatatataaaaaatagacacaatatcatggcatatctatatatcaatgattgtgagagagtagatgttctaagattgctttcttacagggacattgcacagaaatgctgaattaatccacttatgcaaaaagtagagttatgaaaggaatgaaccctggagttagattaggcttggaacaccaagagcagggaaggagaacagcccttttgaagacggcgtgttcccatgactaacgtcccaggacaaagtggtgatctgaagtgagcaggtttggctaaaggaaagacacatacctcttcaaaccctgcctacttccattgttactcatctggtgttgttggacaaagcaaatacttctcaaatgcaaagccagccaccttatccactgactctggaatacaccactaggaacagaatcatttatcagagagctacatttatcagagagctgctcggtggagatgagggggtgagccctcatgtcacaggtggaatagatggccgtctacacgcctgtctttccctgtctcccagtaacactcccccaggagaggctataaccactctcccaaacagtgcagaggtcatctccagatacctcggtgcttgggatacagccattcctcacaacaattacagcttcaatctctcattggaaacacaaatgaaagcaaactgctccaaaaggcacttgttccctactcactatccaagagcaatcttttaggggacacatttgccacaaattcatttgttcataaagtaatgcagcctatacaggaatgaggctcataggcctccctggctggtgaccacaccagtaagtcaccctcttcttccaccgtgatacttctataatgaaattaacaattcaatttggaataagtgctaaccaacgaacacaccaacttccaccaaaatgatggaagcagcagacgagaacagagatgtctactccaaagtcctcagccctgcaaactgcccgctttttcagtgagttgtagccaacgagtactattcaagtgacatcaatgactagcattattgagaggttacgatttgccaggctctgcatggagagctttgtaagcattgttgcctaccctcacagagctctatgagccagggacagttagtatttccatttatttagagagaagctacctgatatcagagatcaaaagcaactcgtccaaagccatacagataattacgtagaggagtgacttcagactccgtgtccgttggtacatgaaacctgctccccaaatatgtgacaaaatatttgcacgtggcccatttcctcatctatgtcttccacggggctccggcttcctagcctctctgcctgctctgccgccttctcagccaggccatgtctggccatgaggtgatgcctaacatggcctaaaatgaaatgtgggggctgtcgtgtgttcacccgagaaatgttaaaggagatttttttttccattgatttactcatggagctaaattgaaatgatatccatttggtgaacaaaaatgaagactcagcacccccttcgatgatccaacagcaagtgacccttactaaaaggtcgtccgattcaaaatgccatctccaggtgccagatttgcagaactaagaaactactctttgatgatagaattttttcaaagcaccgacatcccatacaagtgaagtggacaaacccccatcttatcagttcccacgcatgtaggtgcgggctctggagtgtttcatcaggttgcagagaaaatactgatccatccctctgactccctctcctccaatgattcctaacacgtcattcctacaaattcctgacaactgactcccacaaaggccttcaacaatccagccttgacacatgcaaatacttcctgtaggtattgaaatgtaactttcttcataaacctttggggttttgctaactcacaggctattcttaacctttattatagaagaggaatgcactcaattcccaaaaagaaacaatgaagatgatcaggaaagcaaatatttgttttcaggctttagaatgtgagaaagtgttctggagaatccatttagatcccatgccaactcttagccctccagagagaacatgccctccctaacaaattagacgtggacaatgtgtttagatgttgatcttttccacaaggaaaaatatttctttgctagcaacaggttcacaaaggtagaaaaacctcaggtccttttcagttgcctctcccatgacaggtgaagagtgtcattccccaggtgacactaggacagtgtctatgacaggggcttgatggccgtggctcagagagagtaaagtgccagtcctcaccataaatgcaacaggttcaagcacagaccacaaccacaaattacaagggacacctgagagaaacgcatgcagggggaagagtgccatgcagcttttaaatgacaggcacgtgctacaggcttctgttcagagagaacctgtgagctgtcctgtggcctttcctgtttgcggtgagccatcccaaatatgatgcccccaaatccgagtctggctagaaggaagtgtcatacaaggccatgccattctccctgacaaaagacatgagtttcttgcaagagcactaagaagtttaagaggtggactcgaagagaggagaatgaattggaaagccagcaagaatgtggctcttatcctctgtgaaatatttgcaggaacgagcctggagaccagcaggttcaggatggaaagcggaaagaattctttcctaaaacttaagttttagagaaaaataggcagccagtcccaacccccaaaggcgtccaaagccatgtttgttctgggaaggccaaggcatgggaggatgttaattgggctatcagcaggattgaagggcagggtgaccttggtacgctgtcagggcctgtgttccaagtcgacaaactgttctgagcttttccatgaaacgagtgaagcccttttcataccccttcgtgttccagaattcttgccatcgatgttccaaaggatctgtgatagatttatgttagccttaaatgggacgagttgtaacattcagaattattttatctttctgagacctgctttattgtgagaccctagacatgctttgctggggttagggtgagggtactcctaacgaggaaggaaaaagaaacggcttcaaggcaatccatgtgggtcattacatgcacacttgttcctcttccatttgtgcctgcccaaagcgttctagaactgaccggacctgagaggctgtctcttagaactaagagaaggtattgttgatgatgtcttatatccatggaagaattccctgggattccctctgatgctgcctgggatacctacattgctcaaagtacagtttctttatgaatgggatgaaacatcgcattggggtatctattcttccatggttggtttgaaatagccaagcgaagtgccatagaaatttgccaacaaaataagcatctaactgatagtgtcgtccttctaatggaacaaatctgatggcatgtcactgaaattttccaactgggccaccttgatgcccggctaaaggactgctgggtgtttataagatataaaagaagatatttagtgtgtgtttattgaaacattttacatttttactctacttctttaacctctgttatggttatagctagctcggtactgcgtataaatgtatgcatctgtattcgccatctacaccaaaataaacctttgaattattgccaggcagaattaatgagctcagttctaacagcgcaaagaatatcttcatactcaggtaaaacaaacagcttctcccttcccttcttctgcacagaatggctctacgaagtcgcctgcaaaattacgtcttttagaaaaccaagtagctggctgttttgtgagcagggaggtttcaggacgaaccacaaacaagctgtttgtttagattttaaggttgacagttcatttaacgtatgccccataagtattctataacatagtcctgaaaaagcactgaagaaaaaaaaaaaaaaaacacaaggtctccgctggggccacatcatgggaaggaattaactcttaactctccttccagaaacaaattaagaggatgtactttgcaataattcagatctcacaggtaggccccaatgtccagccccgctatttcaaatcgggcatgtctgagttaggtgtgtggatttcatacagagctcactggaacagaccatttctcaggttccaagacgctggccttgttaatattcatttagaacatactgtggagagtgtctcatttatattacttccataattaatggtgtagcttaggcactgcctttacacagagagatctcttcacagtggtcgatgggtaatgagaacaatagatatttcattcaccagcagcgtgttgctagttagtaggaaatgatcgtgtggctgttgctttaattgcccgggtaaataattctgcctcggtgttagtgagcattttaaacacttgatgcccatagactagaaacaaacaaaaattaaccttgattatgcaacaccttacatagaaagttacaaaggtatgtctttttcaaagtttgcattctatcatgcaaatattactaaatatgcatgtgctgactactcatctactgtattttaggaaatacaattaggctgctttctcttcccctatgtagactgtaaataactgtagatctttctcttgtttccctatgtaatatatgtaaatactaacaagctatgcatgctgctattctaggcaatttcaggtactttataatatgaaggcatgtacttgaactcgtttgttaacagaggggaaaaaacgctctcaactctttaaagctgaatagaaattaaagatttcttcctagactgttgtggcttcttttgttgccttctcttgccggaatcgagtgccccactccagctctgaccttctcccagcaaagcacacagcacacacaggcccgggaacaacagtggaaggacttggcttgggctttttcatctttctttgggtttcctaaaaaacatctagaatcacaaggtaggtttctttggatcttttagcaaaagaatctcgacggaatgtaattcctatttgttgttcctttaccgtgtgcctttatcccaaaacactactgagggtcccgtcattcccatctcaacaatacggagactgagtaggtcaaggccaatgacaaaagtgacaacactactaagtgccacccaagccctcattcttcctgtatataataggtcagtaaactacttctgcaaagggccagagattaagtaatttagctctgtggcccatataatgtctggcacgatcactcaactctgctattgttgtgaaagcgccatcgacaacgtctacccaaatgaacgtgtctgtattccaataaaactttatttattaaaaaaaggcactgggccagatttagccggcaggccatagtttgtcaatctctgctctaacacgattaagactgttattaaagactgagagcatttccctttttaacttgtgtgtttgtggatcatggaaatgatttgatcaaatgaaaattcttctttttcctgcaagtgtcatgaataaacaggtgaacaaaaatgaaatcacctgagcttataaaacaggctgccttcctctgcaaattacattgtcaaggtttcaatttagttatctttttgttttcataaatagggatggagaaaaaagtcaggaagacaaaagtgaaaaaaaaacaggaaaaaagtaactgagcaacatcactcttcaatgagaggaaggaggctattacctcaggtatccatggaaaccaagcagccataaactttttaatggttggaaaacagcgtttgcgtttgaagatgtttttcccaaatagatgcttcagtgtaaatgcattaattgacagtttccttcgggacttttttattgaagttccaaacttaatttgatggcacaagggactctctggagcccttgaagaatgctgcaaagtaggtctttagaaaaccgagccagctcaggcatcgtgtacaaatccaactctcttgcaaacaaatgaagaaacagatcttattccctgtaagtttcccatttaaaaaaaaaaaaagaaagaaaagaaaaaggaaaccctctctattcagctagggaagggagaggccctttctaaccttatcaagtgagaatcaatatcatctcttcagtcctggagggagctgagaatcagcaggagaagatagatccaggtatttttgcagatggggtggcaatatgggatggtaggaaaatccctgtgctgaagccagaagtccttacattggactcctgtctttgacacctatgacaagccctgagcctcagtctcctcatctggaaagtcgacataataatataaccttcatgtggttctggaaggatgagtgataacatttggccatttcctgggcacacaacaagtactagttcaaagcagctataactctgatttttacaagtttaaagcagctataactctgattatcacaagttaaagaaggaagcatacacatcaaagtatagatgaagcctgcacctccattttttgggctgccgtatagagactcgcctgtcacctggccccagcacctctcctttagccagaccacgagcccaggtacaatatcagcacagaggcacttgccagtcctttcaccatttctagatccccttccaaatcatccagagtttttcatgtctttgtccagggagtgtgaggctcaatagtgcttagggagggttagtctaatcccaactgtaatggccaaaaaaaaagacgacgacggggtgatgactgctggttactgagagtctcttaggtgccaacgacctgttattacttctgttcgcacaatatcctcactccccaccaggcaggtgttattgtagtggaggggagacagagctaaaggaggtgaagtaactcacggccaagcaacggggcagtgctggaactcagattcaactgaggtctgggttcaaaacccatattcttgttgacgtgtaatgttctaactccatatctataccctttgtagcaccccagaatcatgcatacacttgaaaatctggcctcagatcgagagcgggatacttatttcctgcctgggccatttgatccctctggtggccaaggcccttccacagaccagcagggacctttctcctcctttctgagctccatttctagtgcctaaaacctggcttcccaccaggcctctggcggatgtcatgtgattttgaacagtacagaccagaggggtctatggtgcctcccctgcagtgttctcttctgcaaattgctcttcgtgcaaaggggtcctgaaggctggcagggctcaggtgaggagcttggcatttgtggatcatctggcagaaccaccggggcagtctcacaacaagccagttgcaattggaactctctgcccccacagtaacagaaatgatgaactcatgacaatggggtacaccaaggaacatcttattcttctcccgcccctgccctctggctgccatacctgttaggattcatcctcttagaaatgcctggcaagggaaggcacacaaatgcacattgctactcagggaggtgtcagcgaggaacacaagccattgtgtagctgaccttcgaactgtcaaggggttgaaaatctgtcctctaccagtacacctctggatccctaatcaaatgactttacaaggcagtcctcttcatgtatgaatcccatacggggccaggataccttctgtgacatgttctaggtggcaaggtggagaattttagctgaatcttgcaagagccctatgaagttactacagtctcattgtattaataggaaaactgaggccaagtcagtaaatgacttcataacataattctcaatgatgcagttttgattttgtgccactggcggcctcctgctaagagattcgtgtgtctttgacgctttctgtgagggtccacctacgcatgatagatcctttagggggaattctgcacacattatccccagttaaagacaggaaggcctggcaccatggctcacacctgtgatctcaacactttgggaggccaaggcaggtgatcacttgaggtcaggagttcgagaccagcctggccaacatggtgaaacctcatctctataaaaatacaaaaattagccaggcgtggtggcgcacacctgtagtcccacttacttgggggctgaggcgggaggatggcttgaagccaggaggcagaggttgcagtgagccaagattgaccactgcactccagcttgggtgacagaatgagactccatcttgaaaaataaaataaaaaaaaacaccggggactgaagcccaaagaggcaaagttttctgcctaggtcaaagagcaatgacagagttaggagctgaaccaaatcacatggctctagacacccagtctcaacaactgactatgataaataggaacatgtccacagcacaagtgaagcaggaacatagcacaccttcggtcaggattttgagccatcatcatagtgacctttcaacaacaaagactagcaaacatttatgagggtttctggttcacattaagtgtttgatgggtactatttacaatatttataatatatggtatttccatctaaccaatgtggaatcaaaagtccagaaaagttaagcaacctgcccaggtcacacagctactacgtaggggtggggaaatttggacctgtgtcatctgtgccttgaccccactgctactaagcatcctgagccacagaaatcagacactcacaatgcattttcaattatcccgtagtatgattaatgtctctagttaggttgctccaccaaggggcacctagactcttaggtttgatgtgaaaactgcagtggaggccagggctttaattgcccatgggaaataataactcaaaccagtgagcagaggatgcagccatacccatgaaggagcaaaaaagcgggaggatttattttctttacttgtttttaatcttactcttttcttttctttactttctctttttttgagacagtctctctctcactcaggctggagtacagtggcgcaatctcggttacatcaacctccgcctcccaggttcaagcgattctcctgcctcagcctcccgagtagtgggattgcaggcacatgccaccatgcccagctaatttttgtggtttttgttttttttttagtagagacggggtttcaccatgttggccaggctggtctccaactcctgtcctcaggtatccacctgtcttggcctccccaagtgctgggattataggcatgagccaccatgcccagccattttctaaagctgctcttgttcctcagattttggtagatgaccaattgatttaaacgttgtacacataagggaagatttataactgccccagatttcagttctccttaactcctagctttcctagaggctgggaagcataacttcctgctgattggaaagtgagagccttatataggacacaagatccctggagtcctgatataaggacttcccatcatcatggtgggatgaactgcctcccatcgtcatggtgggatgaaccttgccctttgtcctgggtgtttgtgttttaccacaatccgtagcaaacattgggaacaaataaataaattaccaagcaatatgtttttatgtcattacagaactgcctttctaaagcgatcaaaaaagcccagattatcaccacaacacctgtttgtggcagtgaggaatctaatgaaatggtctgataattaaatttactttccctgaattgctttgcttaaaggacatgtctacaaaaagcagggttggtgacagtggtgtacagtaagtgttcaagaactcgctcactggaggggggcagtgcagggggtgggtttgattccagtgtctgccaattcccatggtatgaatactctcaccacaagcaatttaaactgaatgagagttgggaggaaatgtacacactcagctcttggaagctgctatgatccagttctagcgtcccttggtgatgacctgtggaatacagctgtaagaatttttgaggaagatcaagagcatgataaaacagatcaggacctcaaggtcataaagccattgggatgtggtaggcactgtggaatgtataaacccaaaccagcttagggtacctgaaggacagaatggtacagacttgtaattttaagcatgtttcaacttggtccctataacctaaaagttgactccactcaggtagtcccctggcccaaggtaactatacttcctactgggtcaatatgagccctaaatatcatttagaaacggtgcaacgttgcctcagttaatactgcagcacctctgcaggtagataataacccatttcagagatgaggagactgaagttcaaggaattgaaagatgctcagggtgacacgaactcccgaaatgcattgccaggattcagatccagatctgccagaccttagacttcatatttccctagctctccagggaattgtgctccctttgagctctgtatccttgaaaatagacatctctacaacaagtgaaatctacatgttgtaacaaataatttggctccccctaaaaaaaaagtctctcattgggggagacaggatctgaatccctgggggtctggaggtagtgtacggatgagaactggagggtgggggaagaaggaatggagactgggtatgtggagtatcagggaagagaggctagggctgcttatgggattggaaatcttgcgatttaaattatttctcagcattaatggaagttgggtccgaatagactcagcattttctccttttgcccaacatcacaacctaagtgagcagagataaccctggggcctccaggagcttccagcacacagagcacatttcctcagctgaaggtccctcggttcaaactggtataaacccaaaccagcttggggtactggaggacagaatgatatagacttgtgaattttaagcatttttcaacttggtctctcatgtgaaatctgcacgttatgacaagtaatttgtatatgtgtaatacacaatgtatgttgttacatgtaatatacaatgtacatgtgtaatttccgagtctctcaccttggtctctcactttcaccaacaggtgaagaacagagaagaggatgatttttgctcacactgcacttctgtactttatcagaggtgccaaacctcgaagctacttttggctttggtacttcctcaaatgaaatgcaaacaggttcctactgattaaattgcatgagaagcgtcagtactagaaattagtatattattgtccccactaacagaagaatattttaaacaaaggcatctttaccacctgagaaaccaaatttttcccacttgagaggaacagcatctccaaataagaaaaacagtgacgcagaaatgaaaaactgaaatgttctttcccctttcaactataattcctcacacatttgcattacaatgtcaaactcacccagtcactgatcttgtgctaggattctatgtaccactacctgagtgtttccccaaaacacacttcttgaatctgacttaaccattatcattgccattcctcacaaggagctagctcccggtctagacaagctggcttacctttgtagctttaccttctcctttcccccatccctgcacctcacttacatgaatataccctgaagttagagaggcatggttcagagcaagcccaagaaactgtagtggatattgtagtgtgctgctgagatcccccatctgggccaggaggcactcatttcctcagatgctaggctgtcctatgagtccctcctcagaactgcccacagccaaagcgagctccctaccaaagcaacacgcactccaggagggagccacatcaatgacttcctgacctccttgcatctctgaagaataatccagcttcagagtttcttgggattgactggagcattcgcatctcccacagcacagctcaatcctccctccacccctcctgcttgctacgttcccctacaggtgtggatcctagaacactccccagtaatcttccacatgccaatctcagttgcagaatctacttcctggggtacccaacctacaacaaacaatgctgggggacttagagaaatatacataaccagtctgagcctctgttttctcctctgtaatctgagatacgggtatgctcacactttagccatccggaatgaccaaatcacaccatatgataatgttctcatatggaacaggcatataatccatactcagcagaagacagcagtggcgtagtagtagaactgacagcattagcagtagcatctactcatctcattctgcctgcatggtctttctcatcctttagtttggggagtatggcatgggggaaaaaagcatagactctggggcatctgcttagacgtggtagattcagttaggcgtttttgtatgcactctctccagaaatctactgaatgtataatacggggaaaaattatttaactcagtgatcaagaaacatcaacaaaattttggacgatggaaagcagatggagaaagtagcacctcctgactcagcagagcggggctgtagaacagaaaggcagtgagaaatgagccagttcacacaaggggagcctgggactgaacgggggtggagaaggatggaagtgggaaaaggtaaggtgaggccccacactgctcctgtaacgtcggagccgagatctcatatgggccaggaaacttgttaaaccacttgtgtcttacaaagttcagccgtcacttcctctgtgagttcataaccagaacctttcttcatctcacagtccatctatatttcatagttgggtgtgtgctgttagactgtgatctcactgagagggttccaggtatccaacccaaagcttggcgcacggtaggtgcttagagaatatttctcaaaaggatgaatgaatgaatgctcaaatttcctttgaaggccaaaggaaaaatatatcatccaactcagttgatggataaacaaaatgaccagtcaaattatttcctttccaaatcgttttggtgtggttttgacatagctgttctctacaagtaacaactcacattggagctacactacataatatgcattacgtgccacacgctgctctaaactttctttgtacacatacacaccacagacacacacacacagaatcttcataacaaccacgttagctagatttactaagatttccccagtttacagaaaactgagacaaagagaggtccagcaacatgtgcaaatctacacattactaagtggcagagctgggatccaaactcacgtcctgtgactccaaaggccatgtttacagaaggcaaggagctagttgcttctgtaggttactggggccttctcttgtccctgactcgttaaaccacaatcttgtctgtctactgattcagcttctccccagctgccacccccttgtgaggagctgggctttgcaatcttcaggtatcctaaattgtttttgcccaagtgggactttcctctccttcctccaaaccagtgggatctcacctggggtctttgctggctaggtaccggcagtaagaaaagatgtgcgagggtcaatttgcaatatttttaaaagttgaatgaacgcttactttatccacagagaccacgcagatggatgactggactaaatctcatctgctggtaagcagcactttcataccctgaggtctccctgaagaagggagcagaaggcatctcttgacgcaagacccagcagtactgcccggtggcaaagctctttttcctccagccgcttttgattcaagtttcagtgaggcataaagaataaaagcagtttggggagatgccctacatcgctgaagtctcctctgttccaggcttagtgctgagatcttctgtgcagacaacaaagagtcttccagtgagcctcagaggtgcttactattatggtcattttacagggcccccaagggtagcaacttgtatgcagagggaatcaaatttggagatgaactttggtctatctgattccaaacctgtgctttctgttctgtattgggagattccagcagaaagcacccacaagagaatgagtctaatggaatggaaagtgctggccttgcccctgggatcacagaggtcaaagatcgtgagaattggcaactctttggcagttcacagccatggacacaaacttctgtctccttttgtgagccaaagagaagtagcagaaaggaatgtgagacaaggagtaaaacgaggcccttcctcattcaccttttcttcaaccactgtaccagtgacagcaggtccttaacctcagtcctgggccctgtgaggaaattagagctcagagaggctaagtgactttcccaaggatgcacagcggtgaatgacagagttgcgattcaaatgtgaaaagggatgggtgggctctgaagttcacttcttctcactctactgcctcttttgtgctgagaataagcaaaggggctggactccacaaggaaataaaaagtgagaggcaaaagaaataaagcaaaaatgagggaaaggctccactttaagcatagggccacacaaatcagttttaggggtgcttctgaatacctaggcaccttaaagaaatctctccatgctaaacctttccttgaccaatagagaccttaccaggtacaacctacatctttttcagttgttaaattatttcttgcactaacgagatgaggctaaaatgtgcacaggcaataagctccttgaaaatgagattttgttcacacacatctccccagtatttggcctgggtctggtatacaggggtgatgagttgccatgtgatgagtgaatgaatgaatggatggtggatgaatgaatgaatgaatgaatgaatgaatgaatgaatcactgcgaaaataacactgtttggggcactttctgccccatttcacgccaaagggaggcgtattgtggaaatgaccacagtgcttacccagactttaaaaatacacacattccctattagagctggcaggagcattttggtcctgagagcagagctccctgcccacctaatattacacgaggtgttaactacatatctggaaataccctatgactaattccccatcccttatcttgaggagaagaaaattgttctaacgcgaatgccccagattcctggtcagtttatgtaaggcgtttcaagtgattgcgtattttaagccatttttagcttaaatcacctgatgtgtggtgagcccagaagacctgattcttgctcccttaaactccctgtttttccactaattttgtttaaactacttatgcgcatagtaattctccattgaagaatgggcttagaagtgtatatcccctagacgctatgattttttaaatagacatttattcagtggattttccagtcacatctccctgagcttgaggctccatacttttgggtgagcacacatttgccaggttggggtaggtggtatttattctttatcatgcctatttggtgcttctctagtttgaaaacatttcactgcagtccaactaggatttgatgaaaccttctccaaattatgtctcaaatggtcatcagtgattgagaaaaacgtgagctccacaggaccttcgaccagctagaagcaaaaacttggcttttataaagtagcaggagaggcagcccattctttgtgcagttgtagctactttgaaataagcaaaatgtatggaaatgcaagataaaggtgttagatttaatagaatccatgtcctgatgtccacttactatctcggtgcctttctctcccatgaagagaagtcatgggctgggcgcggtggctcacgcctgtgatccagcactttgggaggcagaggcgggcagactgcctgagctcaggagttcgagaccagcctggcaacacggtgaaaccctgtctctgctaaaatacaaaaaaaattagccaggtgtggtgcaggtgcctgtagtcccagctactcgggaagctgaggcagaagaatcgcttgaacccgaaggcggaggctgcactgagccaaggttgtgccactgcactccagcctgggcgacactgcacagagcgagaccccgtctcttaaaaacaaacaaacaacaaaaaaaagaagtcatgcttgctcatcttcccagcatcttattatacacacatcacctttgatacatgattttatttgatgtgtagacaaatgagagatttagccacaattcacaaaatttaggtaacaccaactaatagctgtctaactcaagagtcctcaaatttacctgcaaaagggcagatagtaaatattttgactttgcaggctctacatttataagtactcaactttgctactgtagtgcaaaagcagcatagacaataggtaaacaaatgcacctggctgtgttccaataaaactttatttacaaaacaaacagcaggcaggatttggtccatgaactgtagttggcagagccctcttctacctaagccaagtagttaatcatctaagtaacaccaactagttcatcttctgaatgagttccctccttgacaaaatggacttgacatttgactgaactgtcgtgccagtttaatccaagttggaacgtgaagtgaatttcagtggagccagagggtgtgaggcctctctcttggggcctctcttagcggggtaaggcctctgtgggtctgaattttcagagacctacgaatattccaaagtcagtggtctttggaattcatatccagaccttaggcaggaatctacgcctaatagctacacctaattcccgattttttttttccataaaaaaggatatgaggccgggcacggtggctcaccctgtaatcccagcactgtgagaggctgaggcaggcagatcacttgaggtcaggagttcagaccagcctggccaacacggtgaaaccctgtctttactaaaaatacaaaagttagccagcgtggtgttgcacacctaaaatcccagctactcgggaggctgaggcagaagaattgcttaacctgggagactgaggttgcagtgagccgagatcacaccgccgccctgggcgactcatgagactctgtctcaaaaaataataataataattaaaaaacaacgcgttatgaaaacattccatgggaagatgataaaataatggagcaatcaaatgcttccaaattaatatctttatcccccccccttccccaccccataccagctgtcacctaaaactaggtagaatatgaaaccctggaagtttttaaggagttaaactacctactaaaatcactcagctcctatcaattgcagatgccaaataaatatcccccccctcccaccgggagcaggtaacaactgcgtattcgcatttcaggacagccaagcaaatgaacacggcgggatgaaacccctcccttgctccatttctatctctcctagctaacatctattgtcaaaagataacctcaaaccccttagattagaacgaaattactagaaataattattcctcaaaaatatgctttcctaggctgggcacagtggccatgcaggtaatcctagcactttgagaggccaaggtaggaggatcgcttgaagctaggatttgagaccggcctggccaacacagtgagaccctgtctctacaaaacacacacacacaccacacacacacacacacacacacacacacacacacacaaagctgggagtggtggtgcatcctgtagtcccagctactcgggaggctgagacaggaggatcacctaagcctgggaagtcaggctgcagtgagccacaatggtgacactgtactccagcctgggtgacaaagtgagatctgtctcagaaaaaacaaaaagaaaaaaaaaagaaataggctttcctaatagatgcctgtccaaatgctcaggcaatttttccaaaattaaatgccattatggaagacgacagaccatgtggaaacagaaagtccaatgtcccaggggcaataccatctctctccctaggtttctagcgacaagtttttgtctttctctatatatacacgtatctgtattttttttcttttctttttacctgcaaatctctgtcaactcttccacacagaatccaaaagctttccactatgtgtcaaatatagatttgcatgcaataaagactataattattgagcatttatgagaagtaatatttccctctggtgcatgttagctcagctgctcacacacaagtgtgaatactaatgccttcacttaccttggcgccacagaaatgcaaggtgagagaaccgagcagccccaggaaaagcaacactgaaccccaccgttgtctgtagggaagaatgtggatttcgaggagaacttggaaataaggtggcaattcgcttgcaggatttaaacatcaggactttgtgctaagagacttggagacccaacccagcacatgcaaccaagaggtctgcagatcctgcctagcaacagatggctcgaagaaatgaattgctagataaacatttaactgagagtttgacttcgtaagtgtggaaataggtgaaacaaaaggagaatgattctgaggcattccaattagtcatctgtgatttctcggcaatgcgtgctgaacctcctactggtcctgacattctcaaagaaagaaattttggaatccgtgaaaggaaatgtaaagtatctaagagaactttagtaacacagttactgaaaaaaagagagagcatttgcaagggaaataggtcttggccacaccggtcacgactcaaagctgttctaaaaccacaaacacgaggccagcttgaacgcctgcctccaccgacatttccttttggtacagagggcaaaagtgtgtgtttccatttttatcccatgcagcaccactaccgcctccaccttgtcccttctcccatctctgcttcgtttagctcaagacttcgtgggttttcttcgtggcacattccaggaaggagatgagaaaaatcaaagtgactctacactgtactgcccaaattagcaacctcagggaagaaaagagcataactacccaggaagtgggagaaggaattttgtttgaagagcacagcttgactccccgtgcatgggagagagagtggacatttcgagatagagggaacattatcaatcgtgccttgccatccatgcctggtgcacaggaaggactcacgctcagaagaattcattcataattctttctttctcttctcaaaaaatacaagtgaaaggggccaggcatggtggctcacgcctgtaatcccagcaatgtgggaggccaaggccagtgcttgcttgagcccaggagttcgagaccagcctggccaacatagtgaaaccccatctctacaaaaatacaaaaattagccaggcatggtggcgcatgcctgtaatcccatcactgtgggagctgaggcaggccgatcacttgaggtcaggagttcaagaccagcctggccaacatggtgaaccctgtctccactaaaaatcagctgggcgtggtggcggtgtgcggtgtggaggggccgtagtcccagctacttgggaggctgaggcaggagaatcgcttgaacctgggaaatggagatgcagtcagcagagatcacgccgctgcactccagcctgggtgacagagcgatactctgctcaaaaacacaacagaacaaaagcaagtgaaaggagtggatttctagtacctggttcgaggggcataggaggtatttgatcaatgcttgttaaatccatgtttgggggcaccacgatttctttctagtaataataaccactatagataagcacgtttagctttctcaaaaactatggataagtgctgatattaacccgttttacaggggaggaaaatgaagtacgcagcatttaataactttctcaaagtcattcaattcgtaagtggtggagctgggatttgaacccagggggtcggctcagtgtctatgattttctaatgacccccctaacaaacacaatacccaaagagtattctacttcctgctctgcacatttagggtgttttcttttactgcacaatttatatttttcaagcacttctggcttttgaaattcttcatattatgatatagtgacacctgtcactcccatgtctacttttgggcttgggagtgaacattcactgcagtgagcatgtggtgaaaaacaatatgttgaaaaactggctgggggatgggagaaaaggagaaaaggtgagaaatgtggataagcttccctgacccccagtttcctcattactagaaatgctagcgtgaggattggagaaaattcccagactaatgtcccaagtatactagatacttgaggtatggcaactgtactgttacaggagtgagatgattactagtattacttgttataggttgaatcatgtcccgaagaaatatgttcaagtcccaaccgccattgcctcagaatgtgacgttacttggaaatagacattaattagattggaatacagagttaaacagttaagatgcagtcagactggaatagggtagcccttaatccaatgtgaccagtgtcctgataacaaaggagaagagatccagaaacacacgggagaaggccgtgggaggacagacgcagaggtcagatagttgcagctgcaagccaggaacaccaagcgttgccactgaaccaccggaagcgagaggagcaaggagagttctctagagaggagcatggccctgtccacactgtggtctcagacgtctggcttctaggactgtgagatatattcctgttgtttgaagccctctaggctgtgcagtttgttacagcagccatgggaagacacactgaattattcctgttatcatctggctcatgtctcttctcagccaccccaaatagtcagcacagtcctggatgtatcctttaggaacatatgaccatctgtgtgaacacagagcccacagccacaggcagaaaacacccaacatcattttttgacaatacaggccatgtgaaaagacttcagaaaattctctgaatgtaccttctcaaggccagcagacatattaataataacacacacacacacgcatgcacacacacacacacacagacatggcatctgttctaaatgatgccttaccgtatttttcctaatatcaggcctcagatatctgagcactaaatttatctttttatagtacttcctagaaaacagatgagtcccttctcacactaggcagtgtccgatgattctaccctgagaaccacaccctctcgtttatcctcactctcatttctttcctgattcctttaacctgccaccttctctgctctcaagacaacacagaaggaaatctatgatgtcttgcacaggctctgccaaacgctcatcggcaggtgtttgacaaaaggccctccctgcatccgacaacccaagccgtgaaagacagacgcgcctgtctttgacatgagatctgtgcggcgactctcaatccgttctgaggctacctggatgacaaatggatcttggctggccaggggggcggaggtgtcacatctcctttaactaacaagtaatatgtccaaaagtaattgttaaagaaaaaattgtctcccagttagaaaatatggtcaaatacactttcaagtattacctctttttcccctcaaactgtaaataagtagaggtgagaagatgaactgcctgccaccaaagcggagatgggttgaaattttgttttttattgagactgcctctgctcttattgaagagaggcagttcctgtctggttcagggggcttcaccaggaaatgatgctatttgggactgtaagtccaatattctgaaactaggagaaaagaaaaacaacttttccctatatttcacagagggaagggcctctccccctcagccattctcaattcaatagttcagtaaaattcatccacagtttttctatctcaagacctctcaaatcacaaaaggaccagaaggtgagcgttaatcaaattattttgtgtttcctgatttttataaacagcataaatgtttcattgtcagtgctagggacagaccaacctcatccctctttaaaatgtaaaggagaatccctacagccaatgattatccaaaaagtaacacgttcttgattgttccttgactgattcctttttatcaccttcctctggagccactgtctcactgccaagagcatggggaaatcagaactaaattagctggaggaattaacacccaaattgccattggtgcctcctcttcaaactcctatcttggctatttgtcttcctagctcccactcttctgggaaaggtggaaaattctcagggtcagatatgaatcaccacgggggggagacttcaccaaggctggatgccatattgaccctcaggagaggcaggtacaggctgcactacagggctggagcttggagagttgcagagtgggtgcacaacaccagagtcagaggagggtcagggaaagatgctaaaatccaagtggacaagagtttgtcttgtgcttttggtcgtctgcagcaaagacaacagaaacatacaaggcgtggaaattggtggtctggtgaatttcttacatggtgactgattattccaggtctctgcccccatggacacactttgttcctacagcattgccactgtctgtcacagtgatgggtgttcaaaagcatttgttgaataaatgaatgtaggctctttgtgcaaagaaaattggactcttctgtgtggactctacaaactaatagttacactgttactatagactgttacactaactgcatctgactcaatgaatttgaattagtaattcaacagttctgagcatttgggggagggtttaatttacaatccattcagaagattttcagtgattgtgctggcaattgctgccacttttccccattttgagtccttttgacaatgtcatgcttgcctcctccagcaaaagcactaataaaggagagttataaagatgcagtcacgaggtgaggagagttgagaaagtgacaagggcaaaggcaagcacgacaccaaagcgtgtttcttctggagtcatctgagtggcaggtctcgaagctctaagtatagagaccagagcaggagaaaaggactgagtgacagtgttagtgtgatgcagagataagaatacaaatttgggagcacagaacctttggttcaaattccagctctgggacctagggcagatgatttaacttttgtgcctccattttctcatctgtagagtgggtgcaatagtagaaaccacctccgtaggtatgggtattaaatgggctgaaacatgcagagttcacacatagttatttgatacatttgtttaataattattattgccacttagtatgttattaagtataaggaacacactgatttactccagcactggagagggagagtaagaatacagtaaattagcacaatgattatggttggatgcaattcagagacacagaaaaaaataaaatgtgtatcttccaaaagcagaaataagacattaatctctttgagcctaagcttttatgtctgctcacagggcagttctgaacgtcatctggctagcatttcatagcacggtggctgacaaaatgcatcttcttttcttgtgtccctccccctctcatttttttccttctgggaggacaaagactagaaggttgaaggtgctatgcaagctcacagggagccttgaccttgtacctacattaggtttgcaagaaaaggaaaagagtctgctggtcagccacagacagtgggcaaggctagccctgcctcatggtgcctgccacctgcctgctcacgccttctcccctcggcttgggtcttcccggtgtggttccacctgcatgaagccagcagtggagtacccatagtgggttgccagagaagagcaccccaacatggaagacggaggggtgacccctcctgaaatatgtgtgtcagacgagggccaccactatgctgacccgctagtacatgtctttaccttcttagtcctgctgccttaaaagagctccctcagcctacttctgaggatgctcatcagcccagaaggcttttgttaaatatgtctttgcctagctggaatacggaaaacagaaacacacccacccacatatatttctgtaacacacacacagtgctcgtctgtgccaggcacgaagtgtctcagaaatagtgactcatttactcctcataacaaaacttgcagtaaaaactataattatcccatatttatagtaaaataaaggcataaagaggttaaaacttgcccggtgtcacaagcttgcaagaggaggggtcaggatttgaacccaggccttcgactccagaatcttggcttttaaacaccctgatattctactttaaaagcacaaataacccaccaaccccattataacaggccccgctaattactttccctccttctgatcccttccaacccagtgaagaatcactgcattctcagagagttcttacaccaaaagcccataaacaaagtggcacatatttagataacatatattaacgggataaggaaaaatatagatgtgaatatcagaccaagggctgacatgttaaaaagggaagtagggagacacaaaaggcatttccggtcttttgatgacaacatggcgctggtatatcatggggcagggccaggaatcctggatacccacagtgtgcagtacaaagacgtgtacagccccagatgctaatggtgcctgagtcaggtgcacagggcatgacctgaagatgaaaacgaaccaccagaaagaacaagagtccctcccttccaccgagaagtaatgctctaatgtctccagctggctggtgtgagcaggaatcatccttgggtagggtggggatgttggaaggttcccctgcggtacccttcagcacacgataacctgctgctgcagaatccacaaactgccccgggattgtcagaaggttcactaatgagctgtgggaggctggataaagctttcaaacgaatgatgtttgtaaaattatattaataacaatgcttatcccagtggggaacagaattattcctagggtttatgctgtggtttgtaaaatgctacgctgcaaatggatgaaacatgcagcctaaacctgcagtgggattgtttgcaggctgagattaaaagacctctccatttgtgacctccgacccagtaattccacttctagaactccaagatgtcaaaagaaggaaaaagagccatgcagaaagatgttcatctcagcattatttatcaagcaaagaactggataccacccaaaggctgagtaataagggggatgttaagcaaactttgtacaactatatgatgaagtgcttccagccaattaaaaaaaaaacccctaccaagagtttcaacaatacgaggaaatcgttctgcatagtgttaagtaaaaccacaggatacaaaatttgtcacctgacctttgactcagaaatcccatctgtcctacaaaattaaaaccagcagtaataataacatatattgctgtagtattcataagggctaaaacaacaataatatcaaaattaaaagaaatggaatgcccataaacagaggaatgattgatttaattagggctactccacacacagagcagtatgcaagcatttttaaaaatttttgtttgatctatacgtgttccgtattcttgaccaaataaagcaagttttaaaataatggacaaaatattacgctattaagtcactacattccactcctatagtgcatgtataatctgcatgtttgcacggtcacagaaggtccaaattgccacttagcaaagggaagaggtagagcataaattacgagcgttttcttcttattattcatattgtttgacttatttaaatgagcatgtattaacttaataatgtaaaaaatcaatacgctaaaaaatcagacatacaatatgatctcaactgtattaaaatgcatgtgcctgaatagggaaaaagaccagacacaaatgtccttgtatgtagcagtggttattattaagtttggaattagaaacagtagcaattttgtcaaggtttcttgcattttcctagtttttcatttgtatatctatattaggtttctattcagagtggataaatggattgatgaatggatggaggatggatagatgaatagatatacacagacagatagacagggagacaagaaaggaatgagaaatggagggagggagggagaaagagagagagaagagagagaaagaagaagagaaaaaaaagaagcaaattaagcaattgaatgaatgactgaccttccttttctctttccacttctcagggtttctaaggttcctatttccccaattcctcctgcccctatctccttcccacattgagggtccacaaggaggctcacgaagacacacagctgagcctggttacagaggcagcacatcaccaccccaggctttatgtccattttataatgggtgaaaccctctggaattaatattgatgaagaaataaacctgttaacggatagatttatagtattcaaatcactattgatccttcagtacacaactaataaaaagcttccttgcgtgaccttccaccttgtgcacacttaacaaattatctgtaataaacaagtattataaggacccaaggaaaatgtcagcctataaatactgatctctctctctctccttctttgtctggaactagaagttaggcaccagcgtcgtttgatgtacccgtgaccaagactctggattccccagagtctcttctaacatagcaaagatctttcttgttgaactgggcaaaagtgcacaatagaatctctcaaaaagcaactcagtggaacctcaagacaacaaccatcttctatgggataaggggaaaaaaaaaacctggtctaggatccagtaacatggacttaagtcttgtatgtaaacttcatcacctgtgtgtccttggacagtcacttcacatctatgctgtaattccaacctaaatcaaatgtgttcatagggtacttgactcatttggttaagttccatgacagctgctgaaatgtttaaaaacagcttatacatcccattacacatcccaaggagttaagggattcaaggttgagatctttcagtcctttcccatcaaacatctactggattcactgagcctggccatacccaactaaagaaggatctggtaagaaagatcaggtaatagatttccagtggctcaaatacaatggaagggaagctctgctcccatggtcactcaaggaaccagccagaagctacattgctttccacacctagattctaacacattctgaatgttgccttcattttagctaggctgaaggaaaaacaaaaacaaaagcatgaggattgcatgtttgcaggttttcccttggttcggactggagctgccaggcgtcacatatgcattagttaggattccattagttggtcaggcattactgctggggagggtggaaagtgacccaagaagtctgcctaggaataaggcgtgatttgctaagagtacctctcatggctggttcagaggaaacataaaaatggaaaaatgttgtaatcggtttttatgttcattcaccacctggtccaagtcaagtaagcattgcttacctggcatttagacacgttgttttacatctcgagtttaatgctacacttttggaagacaggacttttaattatgtcccttccaggttttggagtttaaatgagatgatgagtttctggtagttcccccatgtgtccttagcaggaccttgtcccctaactcttgacctccaggctcacagaatattgctgaggcagggccaggtttagacagtagactgattcttctcactgctgcatttaccttgcaggagtatgataaactcacattccctagaaggtcctgcatagtcaatgggaaatataatactcagtcttctaactaaacgctctctgtgccaccatgaagttatttcttaagtgaagtacttcaagatatattaaacaaaaaaattgtttctattattcaaaagaaagcaaagaggaaaaaaattgtagttggaaacgtcataaaattagtcgaccaaacgtttttggtaatattctcccatccaggaagagcattggtaggcacatcccatacctttggaagacaagagctacttaaaaatggactacggattctcgaagattggagagatgaaatttttaatatgtaaaacaggaatcaggctgggtgtggtgctctcaactgtaattctagcactttgagaggtcgaggcgggaggatcacttgagctcagagtttgagaccagcctggacaacacagtgagaccttgtctctacaaaaaatttagaaattagccaggcatggtggtgctcacctgtcatccagctactcgggtggctaaggcaagaaactgcttgatcccaggaggttgaagctgtagtgagctgtgaccgcaccactgcactccacctgggtgacacagtgagaccctatctcaatcaataatattaactaattaataaaacaggatcagcaaactgcagcccatgggtcaaatcctgcccactgttttttgttttttgtaaaaaaactattagcaaatagtcacttgttcatttgtgtattgtccatggttgttttgcacttgatagtgctatggtctgaaggtttgcatcctcaaaaaattcaagcgttgaaaaggaattccaatgtgataatattagaagatagggcctttgaaaggtgattagatcacaagagtggtttgtgcctttctaaaagaagccccagagagctgctttatcccctcccactaagttgaccagcaagaagtcatcatctatgagccagggaacgagccctcaacagaagctgaatctgcgttgctttgctcttggacttcccaggctccagaactttaagaattacatttctgttattataagctacctagtttatggtatctgttatagcagcctgaacaaagtaaggaaaatggtacatttagtacttttgacacaggccctatggtccacaaagcctaaaatatttactatcttcccttttcagaaagtctgctgaccctttttgtaaaagaataagtaaggctgggactacgaatatggctcaaatgtaagtgccaagcatgagccagaactgaacacacattgagaaacttagtccaaataaagtgggttttcagctgatgctcccacttttttcccccactccatcaccattttcaaataaaagagccggtgaattgattagagacaagagaattattgaaagctgaaggagagggatttgagggatctgtaatgaccccataaaagctttgttgggttgctttttgagcctgaccataagaggttagcggaagtgtgtaaaagccttgccttttggataaatgatatccaaacccagccacggagggagagtggaaaaaagggaaataaatgacaagtacagactttaacagggaaaatttcctccgaaacgaagcgagcaatgaggccaggcgaggaataatggtgtagaaatgacagtcgcttttcagtcggccacaacggcactcgcggctgataagtccagcatgtgtcagttgccacgtctctcttttcacacttcaatgtgaacttcacagcaaaggggaaccggaggcagcgaaggggaaaacagtgcctcagaaggacttgtgcactgaggtgaagccatttcaattttatattcgaaaggactttgtaggtgatcccatgaatgcaatatgcccacctaataaaagcaacatatgctaagacaattaaaagattttattatacatctttcattgtactccattttcagcaggaggggtggaaactgatgagagggaaagggtgcattcacaggaaggggagccaaagtcggcctggattatgccagtggggaaataaatggatgagatatacttttcaaataaagatgaattactatattactcttttccaggggtcttttcgcttacaaatgccaaggctcaggtttcctatgactctatattatgagaaaatacagctgaaataccactatgcctccttaaagccctcggtgttttgtattcaatcacaaaatgaagaccccaaactatgccagaaagaaaaagacatgtccgtagattcaaagtttaatgacatgaagcacacagacatcagtttaactttctcacatccatacattctatgtatatttatcagggacaaagagaagactcaagtttataccagagactggagatgctaatggggagaaaactgtggtatcctcaagtagctcctgtgacagactgccagcttcttaacaaaaatccatttgctctcttcctgagcaaagggctagaggatatttgacatcctacttttcagtgggagatagcctgtgactagtgcttaccaatagaatgaggttaaggctggtaagaaataccagatgactgatgcagatatcagcagggagaatggaaccactaagtgtctgcagcctggatccctgagtactttgtggaacgtagctgccattggccaggactacccacttatgttgctttctgtgttgaaatccccctttgggggtttcagctataatgcattttgggggctatttcttactgtagtcagcctatcctaactaatacatttgcaacacaggtgtgcaaacaatccatataggggtacttcaaactgtaacagctgctctaatgtgcagcttagggaatggagacaaagggaaaaccagtttcatagagcaggtaacatttctgctaaaattcaaaggcatgaagctaaggaattgacaggcaagggtggaggcaggaatggaactcaggtagagattacagcatgaccaaaactcagaggtgtgaaaggatgtggctgttagtgcaatcatgagtaattaggggagtgggggcaggatgtgtgggaggaaggagtgagacaaaaagggcacattgggaccaaacagagttgagctcccatgggaatgtgtaagtcgtatgagtaactctgaaaggatcttttttgttaacatcggtgccaggacacagaacaggcacacaggcctgcctctaatgctaacatccttcacagaatcagagcacgtcctcatcacagctgagttagacacagtccatggaaggtcaggaccctatgaactacctacattttccactccctgggattctttcacccaggaatgaagatcaaacaaggacaagtgagaaatctacctagtaatatccacggagctaatcacagacacagttgtcacgtgattcctgctaaagagagtcagactgaccagagccacagctttgtggccgcctggtggccatgtgtaaacatgaacaaagctcatccaaaatatatttaaaacccacaccagaagtcttagataccttacagtaagtgaaaaggtctgtctttaagctccagagtataaggctttcttatgttgaataaagttggatttcaaactgatctgtaacatttcatcactggaagcacttcagcaattttcaaatgccttcgttcaattcaagcaactagaatgaggcatttaaaaattagcgccattaaggcagagttgttcaacttttatggggtcatagctagaccagtaggttgccccaaatcccaaacactagagaagtgatctgcacagttgatgtggttgtctggcagagattggtgggataatgagagggaggttagaagttaataagacacggtatgcgagggagagaacgcgtgcatgttgatataagacacatccaggtaagaataccaagtcctagggttactgctaatattagatggaatacattttgcaaaatgacaaccatttatgcaagtggcatctagtaaaggctcaataagtgaagctactttattcatcatctttttactcttattagtattaatatttctgttaaagttatcaaatatatacttattagcttctaaaattaacatgagtactgctcactcatattctaaaagaaccatctaggcttcatttcacctcagtgttagggcggacatagaaattcactggacatcagtccctcttaatttttgtttttgagatgagtttcactcttgttgcccaggctggagtgcaatggtgcgatctcggctcactgaaactctgtctcccaggttcaagtgattttcctgcctcaggcccagagtagctgggattatagcatgcgccaccacgcctggctaatttttgtatttttagtagagacggggtttcactatgtggtcaagctaatctcaaactcctgacctcaggtgatccacctgcctcagcctcccaaaagctgggattacaggcgtgagccaccacacccggctagtcccttcttaatcttgaaggattgctgtaacttgtctggccaaggcactaattattgtatttgggggaaaagataattttcagtaactgcctgacaggtaaggaaacagaaacaaagtgtacagcattggtggccaagagcatttgccactgaaaactgggctgagggaagcttgctttatcaacctgtctacaatactgtcccggtatcgtcactaacctgcctctcaggacctttcactctacaaagccatgggaccaagccctcacaagatcaaggtcaaataaacattctgactgtatgtgagcaccacttaaattgcgtatcttgaaaatacagtatcctgccagtttataagctgccacagatttcactgggaggcattttaagttagacattttcaaattctaaaggctgtgcaacacattaaacacttgaaaagtgaaaaaaagtatctatgtagataatatatcacccaccgtcctctcccccaccatctttcttttaatatagttctagtcagagagtatctctcattttgaaccccacttttcattaaaccttttatcataagtattttttccaactgtcattttattttagtggctaccagtattccattaagtgaatatactatgatttatggaatcattcacctgctgttgaacctcaggttgattctaaggtttcactaggtgggttttttttttttcttcaaatttttcaagaaaaggctttatttgataggaaatagttatttccagtggctttgactgtgagtgttgtgactacagtctctttttgtgtggctgaagacttatcaagggaaactgcttctcaggccatcgaagccaccagttcaactgcttgcttagaaccacagtgagcttctggtcccagtctctgctgtttgctcacttgggtcatgcacgtgggtgtgtgaaagagacccatgtgggccatccaagaatcacatatctgcaccaatgggttactgagttgtaccccaaacatacaaagtgttttacgtctctaagatggcacatggcacatggcacatggacatgcagggttcccttcctgggaatgtgccactctcacacccctcaggaggcccaggaggggagcaggtgatgtgaaccaaagggttcactctgcagtgacgtagatgcctatggacacaggcccagagacatgggcaacatgtgtgtcaaatgtgattaacaatggattttatgttgggaaagattcttctgcagaaatcctggaggtctttccaatgcaatgaaatggattcacagaggcatttatttacttattagagatggggtcttgctctgtcacacagcctggagtgcagtggcaccatcatggttcatgcagccttgacgtcccaggctcaagcaatcttcctgcctcagccccctgagtagctggactacaggcgcacaccactacacctggcatttttttttttttctttttgcaggtagtcttattgccctgactggtctcaaacttctaggctcaagtgatcctctcatcttggcctcccgagtgctggaattacaggcgtgagccaccataactggccgtgaaggcatttaggttacattttatatttccatggcctttttacacacacacatacgtgcgcgtgcacacaaacaaaaaacacctcacagtttgtctttgccattggtagtgagatcaccagattccgagggagggcaaaacacactcctaaagaggctccacaggttctttcccagagtagacatgctggatgcattcatgcagccactcagtgaggaggagcaaacatttatgtagggcctactctgagccagcacagggctcgggactacaggtaccaagataagtggttgctgctcttgagtttgcagccagagcagaaacacaaggcattgaagtgactcagatacaggtttaaaagggctgcctgcttgaaatcatggatctttgaccaaatctgaagtccgcgcttcctgcacgaaagcagctgctttaatacattcctacgtgccaagtgccatgcaaagctgtgggatatacacagttcctgtccctaaggctcagtgccaagtggggaaataaaacaagggcattattttggatataattaggaaatgagagaagttcatggggcgtacaactaaccaccaggaacccaagaaaatgtattcctggcctccacctgctacatggtgacagaggacagtcacgtgctaacacaggggagatcccaacttgccctcgctccacaggcttctgcaggagctccgtgttcctgagagtcagatgacctgtctgactcatggcaaactgccaactgcatctgaaacccaagcttatgcgtaatcgaaatgcaggaagccatcttaaaaggatgcactaattagcttcctgggatttcagatttaaaagcttctgtgatcatatttgttttggtaatttttttttttattgaaaaggattcgaagattgattctgctgtcaggacatcagaaaacaaaacaaacaaaaaataagacaataactttactcgtttccatagcgaagtgctttcaacgtgaatgaagaaagaacatctgctattggatgataaaaaagcaaaatggcattaaaaggccatgatgcacagtgaagaaccagctcccttgggtggctggactcaacactgagatactcttgaagagcatttgtaagcccacgtgaaatcagcacccactgttaggggacctgggggctaccattcttatttcaaattaaacagcagcaaaaaaggaatgtttaaattctgggtagcaaactgatgtgaaagatcacaccacaaaaaacttcttataaaccaccaaccactgttttcattaaaaatggagagagctaatatggaaagggtgtatatgataattatatttgttcagtgtgggaaataaataacaactatgtgctacactattaagagagtatgtaatcatgttattagatatgtcctataattgaaagcattatcagaatacttccttatagagttaattcctcctctgagcaacccctaaacctcgctacattttccccgggtgtccctatgttgtaattatctgtcgctatgtgtgtctcccaatcagtgtgtgatatccaaggcaactcctgcaagcattccatccctctcactctcacgtgctagcactgggtcagcaaataatcaccactgaataaacatagttcctcttaaagttcactctctaggctgactaatcctttggtctattcttggaaacatttcccaacatctcacattttcttagattggggagtgtgcatgcaggaatatttagataagtcaatgtattaaaaattgtaggcaaggcactaataatcagcacacaggaatccacgaaggtttggccaaagttgataagaatcacgagctatcaccctcaaacctggaaagacctcatctcctgcttaaatttcttaaaaaaggatgaccttgcaaattacctccttgtaaatgtaacttctaaatttagaaactacagaaaaagaaaaaaaaatcatgaattgagcttgcaacatcttaaagagcgcatttatgtaaaaaaaaatagaagtaactcttgactgtgaaagtgagttccattttttaatttgttggtttaagtaaaaaatttttattttctacaatagaatcaagcaatcatttgctcctaggaagtaatttacagtcagatttcattttcttaatctggcataatttagggtatgaaactattgatttatgagagtggtaccatttttaatccaaagataacattaagtggtcttaacattgtattgcaggatgctccctataagaaaatgtattaggaggcaaaagaggaaagtgctctggagtcagacctgggtcaaattccatctttgctacttcctagctgggggaccttgcaagatcacgtagcttctctgatcctctatttcctcaactataaattggagatgacactatagttttgtggtgaggattaaatgagatgatgtttgtaaggagaaatgtgcaaaaggaactaggacattctaccgggaatcatttccactggaaaaacatggttagactgggttattgaggacatgatagcaacttttccagagatgatgaaaaatactcctgtattttcaccagacagttaggagatcctaacttgtttgagctggttggcgctcattataaaatctccttttaggggggtaatgaaggtgtcctaaagattgcaatgccctgcaggagagcacccaagcctggtaacagagccagttctgctgagccactgtgcatggccatcaacatagagggttgttttttccatcttgatttctgggcccatcaagcccgctgtaagaacttccctgcaatacagcaattcaaaccagacttttcccactatttagagtcaggaaaaacgtctggggaggaaaagggtgtccctagagtgacaaaaggaggctgtggcaaggttgggcactggcgatcccagccatctgcccacccacccatttggcaggtccattctaaactgcaatttgtcttggacaacctacttcctagttgttggttagggcttgtgccatcatttctgtctttagctatttgtgtgaagaggaagcacattctcaaaattcctcttccccatccttgattctgggtgctggggactttccctggctttaaaaggacagccaggaggtggctgaaaggaaatgcaaaaaaggcttacagcccagcttttaagaattccaagaatagtgctcagtgagaccctctgcagctgcagggagcactgcatttctccaagttcctccaacttgcagatgaagacgtgacaggcagccacgcgttgttgtggtttatgcagtcatggccctctggggcttgatcttgtgatcaaagtccttgtgctttctaacacatcacaagtctcagacatttgatgtgctaaaaacaaactactgtcagagtcagaaaaacctggagccaaatgcccctgtctctgaaatgggagactttggacatttatttaatgtttcaagtcttggtttcctcctctctaccatgggccaaatttgttgactttcagaattgtgaagtggaggattaagtgggatcatgtttataaaacagctagcacacgcttgcccgtattaatttgtatctaatagattctccataactttcactttaaaggggtgaaagatttttaaggaagctccggaatcaagatttttacagtgggccagttttcaaagtgaatagtttgtataaggaaaacctttaactttctaaagggatttttcccatgcaaaagtttttgttttaaaaaatgttaaggaactcgaggccacagctgatggaggtgtggagagagtgattctggtctcaactggatctcagctggatacaaacaagctccgggatcttgggaaactgaatgactttcctgggacttggtttacccctcccccttgcccagctttcctcctcttcctgaggggcttcacaaaagccaggtaagagcctagaggtgaaagtacctggaaattctagcgacaagtgtagatggcataattatcactctcttgcctccctccacatttctaggcccccattgtcccttcctgggtaatatggagcttcagaggtgtgggcagggaggcggggagagctgaaataacagggactggatgcctgccagatatttcagttgcacatgcacaacttgagaagtccctgggggttgattatagttacctgagaacactccttaactctttctgcagaaagaacttaatgaaaagcctagtgccttagaacacatccagaagtattaaaagcagagatttctgtaaaatggtacaggcagccactgtggatagcagtttgtcagttcatcaaaaagttaacctagactgatcatatgacccagcaattccacccctaagtatatacccaagaaaagtagaacatgtccacacagaaacttgtatacaaatgtttatggcaacacaagtcattatactagaaggcggaaacaacccaaatgtccatcaatggatgaacagataaacaagatgtggttatccatgcagtggaatactatgcagccataaaaaagaataaagtactgacacatgccaaacttagacaagccttggaaacagcatgctaagtgaacggagctagacacaaaaggtcaatattctttgattccttttatgtggtatacccagaataggcaaatccacagagaccaaagcagagaagttggaagaagggaatggggcagtgatgactttatgtgtatgcttttctgggtgatgacaaagttttgaaactaaaaagaggtgacggtggcataacactgagttcactaatgccactgaagtgtacactttaaaatggttaactgtatattacgtgaatttcatctcactaaaacaatgtttgcagggaaacgaaacaaaacaaggatacaagggtttttgaagtcatgtggcctgaatttgaatctcatctctgtcttatttgacttggataaccttgggcaagtacttgggcactgtgggcattcgcttcgctgccttaagctgatgggaattacgatgcgtgaggccatggagcattccaggagactctggaagcaaaacatctagtgcaggtcagtgcatatggacacaccagagatgccagctccttacctcccattccttcactaaatgtctccctgctccaaggtcagagccatctgagccctcagtgtcatggagggaaactacacactacagaaaaaaccaaatactaagaataatataataatcacacttatactcaccactcagaagttatagcattttggaattgttagcattttgtcatatttgcttctttgctaattttttaaaatgtgaaataaaatatttctgatggccgggcatggtggttcatgcctgttatcccagcatttgggaggccgaggtgggtggattgctcgagcacatgagttccagatcagcttggccaactggcaaaaccccgtctctaataaaatacaaaaaaattagccggccgtggtagcacacactgtaatcacagctactcaggaggctgacgcatgagaattgtttgaacctgggaggtggagttgcagagagtagagatcaggccatgcactccagcctggatgacacagcaaggctctgctcaaaaaaaaataattattatatatatgatgaagttgaaatttaccgagtgttgtatattagcttaatgtctcttctgaacaaataagcaagttcactaaagaattaatacatggaaaatagtttatttgttcaactggtctttattcagggcctactattaacaagatatatactaagaatgcaaacacagtgttaaagagcttcattgtaatgaataatctgagcaggtgctgaagtggtagttcagcggtcttgagggacagtagtcaccatgtgccttggttagctcatttattaaatgaaattggtagtttgcttcctaaacttggattgcagttaaccagcacaactgaaaaataagtctacctgacatagtcaattcaattgttagctacctaacaattgtgctgtaggaaatgttgaaaatgcggactactgcccgtatggtgtggttctgaactctcgttgaaaataggatggtctatgaaagtacacagtggctctgtgacaaaggagggaggatttatcttggaatgaactaaagaggaggcaaaagggaagaaaagctgcaaactaagaaggatttaaacacaatctttgtggtggaaataatgtaattccatcctcctgtgtcagagaaattaagcctggaaaagccctggctgaaacacccaggttgctgagttgggagtgaggggaatgaggggggaggcaactcagtgctctgcctccagaagtgattgaagtcaatttctttataatttatgttttcctaaaaacaagatgatttgtttgcactattaaaaaaagtcaagaatggactcggcaataccccaacttgtctgaagactacgctgggaggtaaagctggtctatgctgctggacgcagcctttttaaaggagatcactgtacctgaaatgcagatagttataaaaatgaattaatttgcttagaccgaaagattttcacaggagagcaactaccagaaaacattatgaaatgtctgagagggctggtaattgagttgattagtatgaccttggttatgaaggtaataaagagggacgggtgcttagactgagttataaccctgttcccggttcggcgaccgagtgaggatgtaatttgttcaggctgactcggagaagccaagcctgcctgtgacaaagtaatgcttgactagccgagcttggcctgtgcttttcaccctgacagagtaaacaggacagagtcaataagaaatcatggactgggtttgtgtgctacttctctgcgtaaaaccagctgtaggcaaatcttctggacaatgagtcctgagaagcacgctttcactgcctctgaactagcaaagaggaacagaatacaactgcaccccagctgaaacaacacaaaacaaaacaccaacataaacaagaataaacatcccaaggaggtctatgctgaatttgctctgattctatttttcgtattttttatagacatttatgaagcaatatgctaccggctgcagtgggaaatttagctgcattatcataagaaaggattccatgtctggctctaaagcccatgttgtttccacgacacctgctcaaacaggcaagtttccctctgtaacatatacgcacccatgtgtgcacacacacatgaattgacctccgcaatggcaaggtcattggatgccggaagccgttaccatgagtatatgagtcactagcgttgtaactacttctacaaaagttcatgtccagggagatttatctagttttttttttttttccttcgttttaatctgtgaagaccttccatatcaagtttaccctaggaagagatcttacatggaacgtaggataagtgatacttcagaaacaactatggtcctcccaagaccctcaaatagaggttaaaagtctatacataagggtgtggaacattttacacttacgtttatacatgaattagagagttgtactgggtgaataacaacagggtatctttatgcacctttgcctcttctctgtggtgtgtgggtttgcctggtttgtgtttgtgtgtgtatttgtggttttatgagtctccgatttcagggctggtgctacataaatgacaaagggccctgaatccttgtctccttgcctctgtcactgagtttgctgaccctctagtgaaaaggatctgaccccacatgcgagtggaataaattatcgctgacactccagtatttaattatgcagctgtcaagcggccctttcgaaattcattttaataaagtgggaactttccctttcaaggttagagtaggggagtcacctttggtgtcagccggaggtctccaccatgagctctgcattcttgctcggacgcctgtcacttggcctgatagaaggtcctgataacagcgctgatgcctggtggccccccccatccccccatccctgcctgaatgaacatccttcatttaaacccacaataatgagacctcaaagtcagagaggcgggcacaagggcagcctgtcggggaaaaaatggcttcttttataaaattcactcaatgtggaagtggcaatctaaaagcaatcatggccatctccccgtttaactggttaaccagcaacatttcacatggtggaaggaaaaaaacaaactctgagctagtggcgtggtagtggtggggcatccagacactggcaagcctcaattgctgtagctcccaacacgtcaaacagacatgaaagtattgatttatatttttctataaaataaaaagcagtttaaagtttttgtagccttgtttctgggccataaagtggcaccgaggaaaagcttttattggcaaactgaatgggtgaacgcgatcacgcctgcctattatgtatatgcctaaagtcttgtttagcttatacttctcactgtttatttgcaaaccatgcccacagacaccctgcagaggaaaaccgtgggctgggctagaaacggcagaagcaactcgacagatacagccagatcattccttttttttttttttttttccaattctcttccttactgttgctttcactttctctctttccccctctgaccttattctctctctctctttttttttttttgaggtggagttttgccgttgtccaggccagagtgcaatggcacgatctcagctcactgcaacctccgcctcccattccagtgattctcctgcctcagcctcaaaagtggctgggattacaggcatgcaccacttgccaggctaattttgtatgtttagtagagatggcgtttctccattttgggcaggctagcttgaactcctggcttcaggtgatccacccccttcggcctcccaaagtgctgggattacggtgtgagccaccatgcccggcctttctctaacatcatgatgaatatgcattgattactactgtgtgcaaggcactgtccaaagttttctgtatgcttatctcttatagagctcagagaacttcataaatgaggcgccttaatgacgattcctacttctactaaactgaggctcaggagactaatgggcttcctcaagaccccccagttagtacatagctccaccacgcagttttcatgcttggatgtttaaccaccctgctaatgtttatttcttttctctttctctggtctcttctcactaagcctattcctcactttcttccctcctcccaatctctccctcctaggtttgatacacagtgtctcccccagcatatataacagctccaagtaaacacacacaatgagccactcctgcacacaaatgtcgcttgtcaacaaacactggtttgacaaagaggcctcatccttgtgtttggataaatgcctgaaagaatacttgcatgtgactgttgaaaggcgctttctcaaaccataagcaataactaaatctatccataaggactttttctgggggacaacattctctcccagagatgggaaagatggttgctgagatgaattacagagcaacaggaggcagagagaacacctttgctttggcttagaagctctctgggaagacatggtttgcagaaggttggggaggacctccagatccacctgaagtctctactggctcccccagcacagcttccagggcagaaatttgcaggatgcccttttgtctcaattcttgagcctctgaatggggactcaggaagcggtgaacacaggaccttggcatgatctgttgagagcataaggatgaaagcagaagacaggtccaagggcaaactgtttgcatctcccaaggcctgatctttattgtcctgtccctaagtctccgccccaagggtatccctgtgtcttcagggctagaggtaactgaggccttccatactttctatgtttaccatcaatgttgcctactagaggaacaccagtggcatcaggacagtgagagtcagcatcctacctacggaatccagaagaagcccctaacttgaatcaggcaacagggacaagagagagtattacaacctgtgcacgtaactctggtctgcgtggccttaactcaaacttgcaaggcaggaaactgtactttgaagaagtaaattcctccttagagccccagatctgtcacagaggcagacttccgtgatgacttactgaaagaatggctgaacgaatgatcataccagcatctcatcaacccaaaggcaaatataaaaatatctcttgggccaagaaaaacttgtgcaaaaccaggcaccctttactcacaggtaggaacactcagtaaaaaatcaggaatgattcagggggtagccagtgaccaattcaataactacccgtaacttcaagctatccagaaaaggacagatctgggagacaggtgtcctggttctggtcctggccactgccaatttctgagacactctgtgtaggtggattcctatctccaggcttctcttggcctttccaaggctgggagggaaaattaaagcctcatatttcccctcaaagaaacaaatccaagacagtccaggaggtgacagaaaaagcatttcttaaagtgaaaaaatctcaaccacgtgaggtggctctgtctgtaatcccagcactttggcaggccaaggcgggtggattgcttgaggtcacgagttgagaccagcctggccaacatggtgaaaccccatctctactaaaaatacaaaaactagcgggcatggtggtgggtgtaatcccagctactcgggaagctgaggcaggggaatcgcttgatccgggagacagcagctacagtgagccaagatcacgccactgcactccagcctgggcatggaacaagaccctgtcctgaaaacaataaaaaataaaaagtgaaaaaacttagacatacttattcagaaacattttcatttcctctcttctctccttctctcccctactcctcctcttctttagtcagtattcatcgggtgcttattttatgtgtcaagcttatgctgtggactttcatttcatccttaacaacaaccttaggtgggatgaagggagtacaatgacgtccatcctgagataagctgaggcttaggaggtgaggagccagcacaaggtcatttagctgggaaaagcagagggaggatttgaaaccaccttcacttgcctgtgtgcactcaaatgtcatgtcatattttaccaaatatattggtacttgtctttgccttctatcctggaagtgagtccagaattccttatctaatccatggcaaacctatttcatgaggtctgtgttaaacaatacctagagggtttgtgcggaaaagtgatctcctatatcagcagtgttgccatagtcagagtaatggaattgtagtataatcccagcaacattattgaaccaaacaaggtgccaggaaacgtgctacatatatatagcatgtatacacatatatgtacatatgtgtatcagaatatatgtattgtattgtatatgtatatgtgtatgtacacaatttatgtatgtgtgcgtgtatacgtacacacagcatctatacatgtctacatatacacagaacatatacatatatgtacacacagacatataatgcacaaatcacatttttttctctaatctgcaccattactactgttcccattttatcctaaatcgatggaattcagctaagtatctgccaagattgtatgggacgtgatcagtgagcgagtgtgggctgcagatctgcttgacccatagctcttcaaaaaaagaataaatgaaataaataaaacaaaataaaatgcatccataatgcctccacttcacctcagaatttatatgaactttcaagtaggttacatcattgtatttaatccttagagcagtcctatgatcggctctattgatattaatatcgagggttcatctgatctctgttttacagatgatgagatcaaggacctgaggtgctgtgatttgtctaggggaatgcaggtgacagtaggtggagccgggactagtagcaaccctccacctcccgcttggtgccacacccactgtgttgcatggagtctatctccttctttctcacgaaatagtctgccttgcttggtggctctgtggaccagggatgtctaacatcaaaacactcttcccataggagctctcacaactgacagctcccatcttgaacaaaagaccagtgttcatttggatgttctcggcctcacgtggcacccactccaacggcttcttccgagtgaatttagacaatgtgcttgatgccagcactctcactgcaaatgggaacagatcacagagcacccagcagcagacatttgtcaggaattttgcagtcagaaataatgacgggcaaagtcagccccaaatcccaaagccccctaggtatgaatcccggtgctttcacctgggagggttgggagtcagatcacccctccaaatgaagatcctcttcaaagaggaggtgcggctacaccccaagctgacaagcccaggctagaaggcgagaatggagaaataaatcctgactaactagaaggattagaaagtcacctagcatgaggagaattcgcactccacaaatttttccgactgagtaaatttgaagaaataaaactagattgagcatgcgtttaatactgcctgcttctttccccctgttctgctcagtggcttgttaaatatgaaaagatttgtcctgcaagggacacggggagagacaatctctgggggactcatcagctaccctgagcctcctctttgtaaccaggtaagaaagagagcattttccaattccagcatctgagtgccctggtcttgtgtacagtctcaaatataatcagtggtataacaaccgtctcccagtagaaggtgtgatataaaggctcattcgagatgccaggagcttccctttctgaccctggctgcctgagaggcaaattgattagaaaatgacatgccattcatctagccagtacttgcaggaacatttagctaattaatgattaataaatttaacactgctttataatttcatttagctgtgttggaaatcacacgggagctgcgtatgcaccgaatgagattaggtgggagtgagggtttcagaggctgccctggaattgagattagtctattactacagtgacctttttaacttttatattctcttgttaaaggaaataaaattttattcacttttaaggcatatttacttagagaaatttacatgaaattaagaaacaccaagcccagaagcctactggggctggaatccatgcactatttctttcgtaatttcagagctgctttaggaaattgttcttgagttggctgcaggcagagtgaagagcaattggtttttacactgttctttcatctattcaataaatgtcacgttcctggtgtgtcctggcactgttgtaggaactgggactacagcagtgaaaatgacctaggtccttgttgtcacaacttgagttctagtgggaaaatacagatgacaagcaaatgaataaacaacaaaataaacggagtgagaagcacagtgctgagaactggaggaggtggcttctttagactggagagttaaaaaaatctgtctgtaaaggcgacaattaatctgagatctgacttacaaaaagcaatcagtgtgcaaagctggggaggatagcaggtggggacagagaggctgaaggtgaaggccctgagcgggaatgcaggaacttggtgtgttcaaggaattgaaagaacagggaggcgtgaagtgtccagcatatgtggaaagggtcagattaagcaagcccctgctgacaggataaggagttgatttgtaagtgtggtgggaagccatgaaggggtttaaagcagagttaaacgccatccgcgggtgattccatctaaagcaagtgatcctgcagctgcaattcagaatggtgttaaagccgacttggtttcccttaccttcagtctcctgtccaacgtgtgatttttccacctgaaaacctatttgctagtcttgtttctctgtctttttcttgaaatgtggttctttgtttgttccagtattttgaaaatgtttctgatcatctcctccttaatagttcttcccggccaattttttctcacctcatctatgaaatcccaacatatatatttttaaacttccagaggtctctgtctcttctctcttgtgggaaccatgctgtttcttttctgtcctcccatgctttgacatctggatctcccctcccagggtcaataaattcctagaggcagcaaacaactcacttgggggcacccttttgaatgcaacccaaccaatccagaacttacaccccaccacctcctttatttctctgccccaggccaccatccaccctttctaatcacccagggccaggtaccagaaaaataggacagcccctcttccccagagcctgctgaacttactcaaaccctagtctacttaccctgctcgttcagtcctccccacagaacccacggtttgaccctctccctctgcctcttgaccagcctggtgcctccccatgtccctccactctgacatagcatgtccccttcccttgcaaacttaaaggacacagatcacaatcatcacaactctcacaaactgtcttttcagtggtcattgctcctgatctgctggtcttagcatacctaaataataataaaacctgtattttaaaacattccagatagccagtttcatcgtgcaccaaataataaaaactactgattactgaggttccctacatgccaaatgccttagagatgtgattgacttcaacctattctagttcaaccttccttacacaaccctgcaaagaaggtatggttttgtggtttctttcttttttttttttttggcattgtataaatgaaaaaactgagacacagtttatgagacttgaccaaggctcactgtttctaactgtgagagctaagagtgaagcccagaatagagatggtatagttcttaaaatcaaaaaagatcagttttcttgctactaaaatgaactaaaggccaccacttcctgacagactttgaatgctcttgttttgtctttttggctcatccagccaaactggtttggaattcatagcacaatttcttgctcactttttctcttctccctgctttgcctagtgtatcatcaggaattttctacagaattactctgtttttcctaatactttctctcaagttaatataagtacaaaaaaatgtctaaaggaatggccagggccattttaccatgtgccctgtgccattcttctacacaagggccagttcttcagggtatctgcaacaatcatcaaagaacctcattcttctgatataattcacatattgtaaatctacatattcgacatgaaaagtttttctgttagttgttattttgttttttctttccttcagcctgtagagaagatgaaataaaaggtcttctttcagcagtgtttaaactacagtagtttcaatttcaggtaattatgcatacatcatacatcccttgatattcttaagactttgaacacaggcccccacccccctcttaaatttgaaatcctgtgtacctgctgtaaaccctaaaatctgtgagcaattacctctgtaagcagtgtttctggaaataacagctgtgtgtgcttcacaatttttttttaacttgttaattgtctggtttttaacctgactactaatcttctgaagcttaagaattcctaattttccttccaacaccttctactggtgtggcaaatttgaacccacctgtgtaatattttctgcctttaaaaactgcaattgtgctgggagcggtggctcacgcctgttatcccagcactttgggaggctgaggcgggtgaacacttgaggtcaggagttcgagaatagcttgagcagcatggcaaaaccccatctctacaaatgcacaaaaattagccaagtgtgttggtgcgcacctgggtcttagctattctggaggtgacgtgggaggattgcttgagcccaggatgcaaaggttgcagtgagctgaaattgtacactgcactccagcctgggcaacagagtgagaccttgtctcaaagaaacgaacaacctccattgctagacctacagacaatcacattagcactgttagtagtaacagatgggcctatgatagtgagactgtgcaaattccagtcgttgaagaggtggtggtgacctgtctgatttcctgaaattgtaaactaactatttttctcttttaatagtgaaatgactaagtgagttatgaggcttaggtgctttaagtatttccttcatcttcattcgatgtttagaaatcaacagagagcttgtacctagattaaaaaaaaaacaactggaattcctcctccctccctttctccttctatatgtattagtcctctataaacctgacaccatgctaggcaccactggtataagacaaggaaaaaaaaactctggctttttgcataatcctttctattcaaaatgcgatccatggatttcagcctgttaggagcttcttaggaatgtagaattgaggcccctccctgacctcctataccaaatctgcactttgtacacaatcccccaagcaattcatgcgcactgtatcattgagtaaagccctgctggagatgagggattggctctctatgtcaacttggccaaatccagccaacatgtagtttttcctgctgtttttttatggtctacgatctaaaagtgatttctacatttaaaatgattacattttaaatgctatatgaatacctacataataacctcaattttgtctctagacttcaaagtctaaaatattttactctctgcccacccccccaccttttttgttgttttgttgaaacagagtctccctctgtcgccaggctggagtgcaatggcgtgatctcagctactgcaacctcttcctccctggttcaagtgattctcctgcctcggcctcccgagtagctgaactacaggcacacgccaccatgcccagctaatttttgtatttttaggagagatggggttcaccatgttggccagaatggtttccatctcttgacttcatgatctgcctgcctcggctcccaaagtgctgggattacaggcgtgagccaccattcccggcttgccttcttaagcaaagcttgccagtgcctgctgtagaatctagaagaatctagaaccctaagtctgggtgaagcacagatgaagctatcttttgaaataagcatgacatcatgaccctaattccactgaaaaacttgtcagaggaatgacagctcttcctcttctttctttctttcattttttccaaaacctgatatgtattaaacaggaaacaggcactgagagcctaaaccttggatcaagtttataaagcacaggtgtaataggaatttcatggttcatgctcagaggttcatgaggacctaaaaatggttatcttcagactcaaaaggacccaaaagacatgaaaactggtttaactggctccaccacatacactatgaaagtgattaacagtttaccaaacgtggttgttttacagtgtacaccatcagcataagggttgtattttttttaaatgttgcaaactttttagtttttccaagtaagaaaacacaaaattgccatcgaatatccccatcacttcagaaaagagtggctatatctttcaactaaattcacctctttttttttttttttttgcaaaagaggattttaaaaaatttttatatgtccatgtctatctttgagaggtagatttagctgaggaagtgaaatgaggggcagtattgaaaatggatgagagtgaaagaagaggagacaggaatcagagtcacagagaaagagaactggtgtctaggacaggcaatcttcagaaaaggaaactcagctggaaacaaaagctttgttcctgcccagccattcccacggtgacctcaccggtgtccagggcagaggacattacacaaatacttgttgcactagactaaattaaaaggatttagtgggtgtcgatctgtgtggcatgacccaagttgcctatttttcataccatttagggctctgacattgaatagatagaacttgtttttaaaagactatccatgatgcatccactcagcatgttagaatggaggcaaagggagccaaagttgttttggatttgggcagtatgccttgctcctttttctcccaaatctaaatgcttctggggtgcatccatggctagcatcacgggaggcaggacaagaaattgggacagtccagcctggcctgacagcaggcctggaaaacgctttcaaaccttaggggccaaccttgccaagagcatctcttttgagtgtaggttacaacctgttcttatttgaagagattccctaaaagagcacgcattctcctacccataaacagctaaacaacaacaacaaaaaacccccccaaaaaacagatgatactaaaggttgctttcactaacctttaaatggtactgggggaatagaaaagtatgtacaatgagattaaggccttctatgatccccaatttatgattatatggtgaccacaaaatctagaggttctttattgctttttggacaggcaactgattgtggcaggtattattaggattgttactcagtgtaatccacagtccgaatttccacaagtgcatgccgtgggctgttctccaggggtctagacataacgacaaaaggcattcccgatgtaaacaaatgacttggtatgaccccacacaccagtggctacctgaggacacctccacagttcctaagtaagtacccacagcagaggagggctctgcttggattccttcgcactgaaagggcgcttggcgtgactcatgtgactctagaccctccagaaaaattgtacaggggagtctcacactggagaaaggaagtcaggtaggactggggtcaaactttagtgctggaatcttttcgcagccactacgctgggcctgaatctcctcctcctcacatggagatgataaagctgcctctcagatttcttggcggttgaatgaaaaatatagcaagcccatgaccctgagcgtgtactcagtgagtttggattttcctgccctgtgcttcacagaaaccaggcctccgctcgctctgcagtctccttgcccggctcttttgagctgcctgcattctcttccttccttgtatttcccccgcaagcttccctgacactctcacgctaggagcagtcctctctttccaccgtctcctagaccggagcccacttctatccctgctcttccctcagtgcaactgggtactccgttctatctccagggagtgagctcacaagctgtctcggcctccaccccagtgctggcccacctgacacaagaaggtgctagatgttagctgcactgcagaataattccctgagctctgcccacactagctgactgctggccactctgtttgggcatggctgggcagggcaggtttttgttttttttttttttctttgagatggagactcactctgtcgccaagctggagtgcagtggcgtgatctggctcactgcaacctctgcctcccgggttcaagcgattctcctgcctcaacctcccgagagctgagactacaggaacacgccaccacgcccagctaatttttgtattttttagtagagcagggtttcaccatgttggccagaatgatctggatctcttgacctcgtgatccgcccgctcatcgtcccaaagtgctgggattacaggcatgagacactgcgcccggctgggcagttgttttttaaagcttaactgtcttccccttggcttcaccccagactcctcttccactcctgttcaggaggaagcctgttccacctgcattccccatcgcatggtccagccagcctgtaccttctctgcctcatccatcacccgttctgccagcatgggtcagcgaatcccgctcctcaggcctcgcctcgcgtgggggagggatgcaagcaagttccaaggcagtgccgacagaaacaaatcgatatcttttactctacaggaaaaagtagaggataaacttctcaatagtattagagaaatttaacaagggatatggtaacatcaaggtcttctatgattcccaacttctgcttatacagtgacaatgaaaactagttcccccttcgtaacagagacctttctgttgccttttaagactcagagcccagatatcctcggctatttacatgtgatatttcatggctaaaacaacaaaaaagataaacaaaggcaagtccccagtcaaagaaaagagaattatcatcacattaggtcaaaacttcaacactggggctggaggccatggtttttcttgccattacagcaactccggatcaaataggcccattaggtggctctggctgtcaggcaccctggcaggccgttcggaactagcatgctctcaacacgagatagggtggccactttacttcttgcctatcctctagccccctgatctgcaggcatggcctctgcattctgcgttatttcactgagaaaggcatgcacccataagcagagggtgaggtctcagctctgtcgccttctaaatcacaacataattggaccctgtttgtcttcaacctgaacactgatcatgtagaaggagcggtattggttactgtctctccctctgccacctcctgccaatgcaagccagtgctgaggaatgtctggtccagggtaccaaaaagaaggcgcacatactcttcatgtctaggaaataagagcctacggatttggggaatccacacaacacctgctggagacgttttgttagtgacctccaggagcacaccacaagaataacgcctttacttggaaagaacctcaaaggcagtgaaaagtcaaccaccgtaggaagaatgttccagatttcaaatgatcagaatagctggctgtttaagaggtggtgccactttacagttaactatataacatatggaaagcaggaggggaattttctggggaaatgagtcaatttgtgtttcctctttagtattaaaatgatagctttacgtatttcatagatgtgccaaagcagagttgcactggtaaaatgaaaactaacgtttaaaagggaaataattcctgtgcacgtcctacaaagcctcaaatcagggagaaatgaaaagagcctagaataaactaggctgaaaagtcttctacaccaatgacagcagaatgatggcctgcaggttgaatctggactgcagtgtattttatttggctcactccaactggcctacgcaatgatttcattgccaccatttacaatcggataacttaagctggatgcagtgacacacgcctgtagtcccggctacccaggagccaaaggggtaaagtcacttgagtccaggagttccagggtggcctggacaacataaacgtggcctgggcaacgacgtgacaccatctcaagaaaaagggatgatttaatatttaaaaaatatgaatttctaatctaatctctccagaaaaactggaggttctggcaagtttatagctatttccacgtggcaacattcagctggacgtcaataatggctgccccttagagatgaggctgcacactatctttggcactttctcctgtcttccctatattggggacatagatttagcacatttatcatcgtatacacagcaacttcattcctttattctacctacctggtagttgaacatctgaaactgccctatgctatgctatataattatgaattattaacagggctttatctcaagttcctgatgcatgagtcagagaggtgaaatcccttgtttagtgtgaattatcctcactggaaaaattaaggcattgagtacaaagttcagtgctgctctttgacagttccatgatctatggtttgggaaaggatctcttctacctctaacaagaagagttttcatttttaatctctgctaaaggtagactgagcagagctaagcttggtgaaccagagccattgccagtgaacacatctgtgagtcttctcaactgccttaaaatgagaggcctaatcagagaagaacgtattgaccagaaaagcatttccttcttaggttcccataaaaaacataaatgggctcttttggcccacagatgtggtcttactggtcatcggcatctgagagtccctttttcagtgatgtgatgggtgggttgatggatagaaggatctgaaccctcttatctgaatccctgtgtgatccccaaacccatactgcaagatggctgatggggtataggaggagcatccatgccaacagaatgagtgatgtataccaagcaacgtgaggccagaacttggagtctggtctcctgctgtaaccactggctgcggtcctaaatgtagtctgtggcagaatgccagctgagagaagtacagagaaaatataagcaggcagattatttatgagacatgaaactaaatgctcattggttcttagcaactaaagctgagctccctggtggctgatggggactcatttgagaccgtccctaggagggagctatattcttctcctaaccacaaaaatggaacccacccaacaaacagtatgcttccttgttgggcactaaactgagacggatgttttctgaataaaagttggtgagctatccaaaaatgttagcaaactgtatccaacaatgtataaaaaaacatatatgccatgaccaagtggatttattccaggtcttcaaggctggttcaatatttaaaatcaatatagtccaccatacaaaaagctaaaggaaaatcatatgatcatatagattggcatacaaaaagcagttgataaaagtacacacccattatcattttcaaaagtttcttagtaatttaggaattgagaagaacacttcaacttgataaagaacatctacaaaaaatttacagctagcatcaaatttagtgggaaatggtaaataacttccccctccctaagatcaggagcaaggcaaggatgttctcactctcttgttcaacatagcacaggaagttctagccactacaataaggcaataaaaaaagggacacatattataaaggaagaaataaaattctctatttgcatatgacatgacaggctagaagaaaatcccaagaaatctcaaaaaaactaacaaatacaaacaaaaataaaaaactcctgaactttataataaatgcaatcagcaagctcataggatcaagatcaacacacaaaactcatcatatttctagatatatgtagaagttggaattaaaaacacaatgccatttacaatcgtccaaagaaaatgaaatgcttaggtacacactccagtgggtttatactaaataaatagattacataccatgtccacaaactggaagactcaacatagtaaagatgtcaattctcccgattgatctataggtttaatgttagacctatagatttaaaccccattaaaactgcagcaagcttctggtagacatagacaaccatattgtacaatttatatgaaaaagcacaggtcttagaagctaaaataatcttaataaaaaagaatacagtgagaagaatcactctacctgacatgggcttactacatagctatagtaatgaagacagcgtataattgtcagagagacagacacaagatcagtggaataaagaagccagaaagatacccacacaaacatgctcaattcattttgataaaggtaaaaaaattctctggaggaagatcattttcagcaaatggtgctaaaacaatagatgttcctaggcaaaatttattagacttgaccttaacctcacatcttatacaaaaataactcaaaatttatcatgggcatacatgcaaaatgcaaaaatatatgacttttaggaaaaaatattagaaattatttgggatatatggttacccaaagaattattagatttggcaacaaagctcagttgatgaaaggaaaaattgataaattggacctcattaaaactaaatactttattttgcaaatgtccatgtaaagatgatgaaaagacaagctgtagattgagagaagatattgcaaaccacatatccaacaaagaaccaataactagaatatataaagaattttcaaaagcaacaataatacaacaattcaaatagaaaatgagaaaaaaacattaatagacatttcacgaagaggatatatagatgacaaacaaatgaaaatatgtttaaaattattagctatcaggcaatttaattaaaaccacagtgaaatatcactacatgtttaccagaatggctaaaataaaaactgcaacaccaccaaatgctggtgaagatatagtgaaactagatcaccaaatgctgtggaaatgtaaaatagcatggaaacagcttgacagtttcttatacaaactaatcatgtattaccctacaacccaccaattgcattcatgggcatttatcccagagaaaagaaaactttatttacacaaacacttgtgtacaaatgtttataatagcattactttcaatagccaagatagatttccttcagcgggagagtgattaaacatacgatcacttatatgtacaataccatgaatactactgagcaatgaaattaaacaagctaccgacacgtgcaacaactgggaagaactccacggaattgtaccgagtgaaaaaagtcagtccccaaaagattacatactatgctatctgcttatataataattttgaaaaaacaacattttaaaagtggagaacagtttagtggtgccaggggtcagggatgaggcaggcgcagaaggaaggtgggtgtggtttgcaaggcaagcaagggaattttgtggtgatgcactgttcactgtcttgatgtagttgtgtataaaggagctacacatttgatgacactgtataaaactacatatgtagacacagacacacatatacaacttgagtacaggtaaaatgagaaatctgaataagatccatagattctgtaagtgtcaaactgtgatattgcacaattgttttgcaaaagctatcactgggggaaactgagctaagaaatgaggaatcattgtatattatttcttacaactacatgtgagtcttcaattaaaatttcattaaaaaatcagtgaactagacatgaagggacacatgtagaagtacaagcgaaggtgctccaacctccttaaacctcacacagtatttgctacttctgctggggtctccaatcctagactaaaatctcttgttcagtagtcttcgcttcctagaatgtaagctccttgaaggcgagaccacacctttctgaccacctaattctcaaaacttcccataatataaaccagatgcttataagcacttgctgagtgaatgaaccttaattctcagggtactggctgcattctcccactaaatattaatacgaactctaaaatggctgttattatccttattttatcctgtgtgggagggaaatgaaggttcagataggttaaatgacttgcgcaaactgtaatatagttatgagtttgaaaactcgttacgactccaaatctcaagacccttctactacgctgcccaggtcagcccagacctgtgatcggatgcagcaacacaggatgatataagccagttctggaggaaaagttctaaaatagaagcctcacagatgggaaaacatggcaggttgaagacggggcatcaaagaggctctgctggtaggagaataccttcagggtcaggctgacattccaagaaaaagggactattgataagaaataaaaatgcaaaagactctttttgttttctcctctgcattatattcaggtaacataatccaagagctcatctgactaaattataagcctacttcatatcatacactccttccttgaaaaatgcaagttaccaggaatacagataaaacacagcatgttactttattgaaatattccaagttctaccggtatttatgttatcaaagaactaagggttagaaaatatcttaattcacagctgagcttttgctgactgccccctttttagctgatattttatggtaaattatatcattttatgggtgactttcaaaaaattcctttcaataaattatataatttaatacaggtatttgatcactcttatacatttattcttaaatatctgatagttgtgttaaattttgaatggggtttttttctatctccatcttaaattataactagtatataccagctatttgtgtatatttaccttacatctagccaactcttcaaattatttcattgctagtaattttactgaatattttagcttctctaggattataattacagaagtttaaaacaaagaacatttggtttcatcccattacttaagactttttttgtcttactgtatttgttaaaacttctaaataatgtgacaattgacagctatcatgaatattcttgtctagtttctgattctaatgcaaacatttcacgattttacagtttggaataatacttgtgggctggatgcggtggctcatactgtaatctcaacactttgggaggttgagatgggaggactgcttgagcctaggagatcagaccagcctgggcaacatagtgagaccatctctaaaaataaaaataattaacaaaaaatccttgactctactgaaagtgttttcctttctcccaattttagttacaagtattgctgttcgttggttggttggctttatcacgacttctgaatttgagcaaatgcttttttggcatcctgatagaaccataaaattgttctttaattggttgctgtaataaattacactgatagagataaaaacaataagtaaagaaatgacatgaaaatttaattagttttagtaaataatggataataccctttcaacaagctctgacccataatcagtggcaccattcaacaaaatccaagacgcgctcacttacaggcaaatgtatgtacagtagcctccgcttctgcacaggggatatctccaagacccccagtagatgcctaaagcctcagatggttccaaaccctacatatatttatttcttcctatacatacatacctacaataaagtatacttataaattaggcacagtaaggatgagcaacaataatagaacaattataacaataaattgtaataaaagttacataaatgggtctctctctctcaaaatatcgtattgtaagtaatatatttgtaccacagttgacaattataactgaaaccttggaaaccaaaactgtaaataaggactactgtacagaacattaggcaataaaatttatataagaatctaagagagatatgaacgaacttaatattataaagtcaaagtagggtttttcctccctaagaaatattcctttttccactcgatattttttttaatgactccaaaattcaatagcttagtgcttaaatcatgttacaaacaggaagctgaaatagatagaaaaggaactagcaggaggcaagcgtgaagccaggtcttttcatggacattattatccatttcatcttcagaatgttccagttctctctgtacaaggagataagcagcagctatccctgagaagtgctgggcattcgtaactcctgggtcccccaaaaagctggccttctcaggaggtgctattaatttctcccatctatcagttgaagggactgaagtcttgacaggctaaaaggttgaccaggcccacacagctgggggattggagagctgggatgaaaatcctggtgtgtggagtgaaaaagctgaccttggctgtgtgcagtggctcatgcctgtaatctccacacttgggaggctgagacaggaggatcgctttgaggccaggagttcaagacaagcctgggcaaatagcaatactccatctctaccaaaaaataataaacttagctgggtatggaggcctgtgctgtagtcacagctactcagtaagctgaaaatcactggagcccaggagttcaagattgcgtgagctatgactgtgccactgcactccacccagggtaacatagcaagacccagtctcaaagaaaaaaattaagctcatcttattttcatgactatgggtgggtataacatggtggctgctgcatcggcttcatatcagcagatcgagactggaatattggctaaaactcctaccagtgtgtgttcttgggtcacttacttaacacctctgtgccccagtttcccatgggcgcataagacaaaccggcacctatccctcagggctgctataaggttcaaatgagtcaccacacacagacatagggtgtgaaacataatgggcactctatacatattggcgaatactctatttatgtcaatattattatcataatttttatcatccctaaaactattttttctaacggatctgataaatcattggtatgtatcaagaataaaactccaacagaagccactcaaatggtttgtctagctagtaaaatctattaaagtcgaagaatccacttagccgagccacagaatacaccacgttcaggtaagtcataaagccttccctgcagctgttacaatgattgatcttcaggcacgttaaaattcaagaaatacactgacattttaatagaacaaataatttaaatacatttaagtgttaggcggtaacagtttttgtaatatatactgacagatttgggaacttcccaaaaagagtgtagagaaagacttcatccaggagggggaagcagggaaagacaataggattgacatctttgagagaaactataaaatctgcagctacctggaatgaggcattaaatttggaagacagaccccatgacaaacagtcccttaaacttttttttcaaagccaaatacttctgaacctaaacttctatgagcgttctctttcctttatttttttttctgtcatctccaaaatgctattaaaaaacagataaatggctgggtgtggtagctcacgcctgtaatctctgctctttggaggctgaggcaggctggtggcttgagcccaggagttcaagatcagcctgggcaataagggagaacttgtctctgtaaaaaaatatatataaaaattagctcagcatgatggtgtgtcctgtagtcccagctacttgggagactgaggcaggaggatcagttgggcctgggaggtcaagctgcagtaaaccataatggtgccactgcagtcccgcctagggaacggaatgagacccttctcaaaaagaaacaaaacaaaaacaaaaactgatccaggcacttcttatatttctattacgttgaaaaaatgttttgagatatactgactcgaagaggagaaataaatggactctgtatttttcatgctacaactgaaattgaaaattctctctaataacaattaagatcaatgttcctcttcccagatgccttccaggtatgttctagaaaatgtttaatgatcagctttggtgggaggagggagccctgatgtgtagcatgtgccaatttccgtggtgaaaatattctcacttggctgaaatcaagctatcaacatgatgtcactaaacatgggagatgggtaatcattggtcctgctggtgcagccagttccagcacaaaattgagccatttctactctaacttcccattcactaccctgttttatatgcttggaggcacccgtcactaccaggaattatcttctgtattgtgatttgtgcttccttagcctgtcactatggccatgtctgcttggtcacctccatcctggaatatctacactgtggcctgacacagagcaaggactcactaaatatctgtgaaaaaataaataaatgacaggcaggaagaagtaagggcaggagatggagaagaaggagaaaaaagaaggtaagatatatacctcttaactgggccccatcctgtccttactgctcttttctggcagtttggagaacaccgtgtagacatctcctccctgctagacgggcttatcacaatagcaagaagcactggagagtcatactaacggacactgcttccttctggcccgccctgttagcgggctaatcacaacgccaagaagcactgaagagtcatcctaatggacactgcttcctttggccctccgtgctagacgggcttatcacaacaccaagaagcaatggagagtcatcctatggacactgcttccttctggccctccgtgctagacgggcttatcacaacaccaagaagcctggagagtcaacctaatggacactgcttccttctggccaaatatgaacaagaaactgtatgtgttttcaccccaaacttctttggaggacatttttgaatctcttaaatttggagaatcgaccttctacaaagccaaagagctggtaaaacttccttccgattaaaatgagacttgaaacgggtgctatcaccactgacagttcatgttgacaggtctgtgaaccctgaaaatctagccaggtctcagctaatttagaaagtttattttgccaaggttgaggatgtgcacctgtacacagcctcaggagggcctgatgacacatgcccaaagtggtcagagcacagtttggtttacacattctagggagacatgagacatcaatcaacatatgcaagatgaacactcgttcgtctggaaaggtgggacaactcagagcaaaggtaggaagacttgaaatgaggagggggctccaggtcataggtagataagagacaaatgtttgcattcttttgagtttctgaatagccttccaaaggaggcaatccgatatgtatttatctcagtgaacagaggggtgacttcgagtaaatgggaggcaggttggccctaagcagttcccagcttgacttttccctttagcttagtgtttgggggcccaagatttatcttcctttcacaggtcctttctaagcgtacgcctatattttcctttaattttgatttcctcctgttgaaagtcagaggtccaaccatctctatttcaatcccagacatcagcatccttcccaacagagacatgcagaacagaggtgtgaaactgacgacggaaactgtttgagtgacaagaagactctccggatccccctacttactcagaagtataacgtcagcttgatgaaacaagcagacttgcctctgcacaactcaccttgaaagcttattttaacagacaaaagaccatgtcccattttgtgtgaatgagatgttttctgaagccaacggcctctaaatccagatctagagaattgggagcagcgcttcttgcttcttaattaccactggtggcttgcctgcctcagggcacccacccttcatgcggtcaatgctgagagaggtttcaaagttcaggggagatcaagaggaggctgcattgttttctgctgattttccagagacaggaatctactgaactccaaaaggactggacttctcaggtgtcagtgctgtatggtaggaagaaagcagctaaaaactcaccatcagcaaagggcaagtgattataagagctggcggatctgcggtggaagttcgattcaattctaactccctctgtacaaatgaagggagatgtcactgcctaagaatgtagcaagtccaagaaatcggccacaccaccgcatccaatagactgctagagcgtgcatttcagggcagggtctgcaagtttatttttggtttagccacgagttagatgttaacgtaagtcaatttgttaggactgcagataaagtcctttaccagaaagaaaaacataacaacaaccacaaaacacaggtaaggagcttaatgttctcaacagcattgagaccagggggcactgtgagtaggaaaaatccaaaaatgctttatcaggccccatggtgctgacacgcagcaaagctcagctggaactgtggtcggctgccagagtttgaaccaatgttggtgcaaaatgatcagaaatgtacaagtccgtatttggagaattacaactttgcttctttcaaaagtttatggggagggtcttgggtatgcgccataacacgtaacagaattagtatcagtttagtagatactgtcactaaagtcattcgggcaagtgcccagggacatttttcaagagcccttctgcctcttttattggactgcccctctgcccatgatgcatataaatcattctggtgaagtcagctttcataagcaaacaccctaaacctattttattatttggagattttaaaaactttcaacaagatcggcctgcttttcttctgtgatccttaaaaaaagaaaagaaagaaagaagaaaaagaaaagaaaaaagaaaaagcccacgtgacttccacagctcgattccaaagagctaaagacatcgtgtttggacatcagtaaaaatgatggacaaatctttttgcaaaaattcaccctggcttgccttgaaaaatataaagcagctctctggcactagatgtcaaattaatgcaggcaaagtgtgttacagtaattcacttggcagtttaagcaaaaccaagagaacaaattaaagtggatccccacatgccaacggggcaccaacactttgcttctgtagctggaattgactgtaaatctctcctggcttaacgtgatcagcagcagcacaaagaaaatctgtcctctctctgcattgtgtaaaatggtttatttgccctcttaggaggcacgctgaaatataaacccaggtatgattattattattttgaactattattatgagttactattattactttcctagacagagggaatggggccggggaagctggtggatgagacggaaccatgtgtgaacgctaggggggaccatctatcttcgttcagggcagtttctgtaatatttcaggagagaaaggtatcaatactaaagggagttatatgtgtggatgggggaagactctgcactgaatggattgctgtaagccttaccctggtcgaattctccttggcatccagcctgctgtgctctctgctctgtggatagcatatctttaaggcatctatggacaattccctcaccctgccacatctggtagtccctactgtgggcctgcatctctgctgtgactgcaaagagaaatgagatgtcagtccaccctctggaggctcacagtctaattaacagcagggcagagacatctaaacaagtgtggcaagcaagtgaccacgttagagagttgtgatcatggctgtacatggaggacccctctagtgttgggttaaaaaggtgcatccctggcacaggtaaacttacttgcccagagcaccctataacgggcctaatcaagactgcctgccaggtctgatgccagggcccatgttctctaactgtctatggcacagtggggccacaggagtgaggcagttgttccaacaggaaagagacgagaatgtgtctggcaagacttcatagaggaggtgatacttaaactgtggcagaaaatctagtcaaatggggaaggcactgggcagcgtactgaaggatacatcatgagtcactaagggatcccaagttgagaagtggaccaccgccatcctctccacacaaaaggatcatgacgaattcacattttcctatgagtacagcaccttgctcttagaacataaaaccttccccaactggatgactccctgaaacaatttctggcctttggaaagtggggcatccaagaaaaatgatcaagaccatttgaaggcacacgcagtattctcggggaattatttctggctgtggcccctgcttggatcacagggcttgggctttcaatcacaaggttgaacagtattaacaagaacccacaggtccatggaaacagtttgggtaaaacatttcccttccttggaatgtaaacgggtctatttcatctagaattatttttaccaatttcatcctcaaaacttcaaagttttttttttcttctctgatgttgtacttctggagtcccccaccccctaactttggtcttgtgtttgtggagcacagacccagcctccccaggacggggccagaagcctgacccagcaggcacacctggaatcattaaggatacaaggaagaaggggaggaacacagaggggacagaggccaggctggaggcaggaggagtgggggcaggaaggggatggaggagggtcgggggaaggagacggaggaggaggagaaaagagaagcagcccatttctttcccaacacattgacactttttttccatgaggcaggtcagagccaaaggtgaacatgttcaaaacaaacagctaacagacaaacactcttaaaaattccacaacgttgcctcgggacaatgccacgggtccaacatgtcactccaagtagagaaaggaaactacctgaagagaatcctaaactttctgacattttagaacattcatagtgaattctgtctctaaatgcttacatctccaagttatcagctgtgataaaaactgaattaataaaagtagtgttaacttaaggctaacacatgaattttcttttgataagccttgccagattgtcaagctcctcagctcgttctccatgtgataccatcattttcttctaaaaggagcatggtgatttctataaggtctatcgaggaaatagagagcatgggtatggcatgcatataaaaccgccacattaccagcagggaagcactggacgttgcatgtgcctgctacagagaccataacattccaagaatttccttctggaagcgtgagaatattcatattaatgaaaccgaattagctggcagatggagggctacgactaacccttggcagtttatggtaataaaacatacaatagcctcctctcagttgtcttttcctccaccttggagctctattttctctcctatctctgtaagatagggggaggattaatcacatgtaattgattgatctactgcctcctgcagttggacagtttacacataatttcatattgcatgtaacaaatatgattacacatattctgaaatgttaagaagttcccggcataacacaggcatgtacatggcatgtgcctattgaatttgttggcttcaagggatattattactcctgccatatgtcaggaagctgaggcttagcccataaagtcacctgccccaggtcatgcaactagaaaggacccggtgaggaactggtgccaccctgtctctggaatccatgcactgaccaccagtgaagggcaggtagctttcctctgcggctttaagttcctgttcactttttcctcccaatcacaatttcacagaaattagcctaaaagtgacatcagggccaggcatggtagctcacgcctgtaatcccagcactttgggaggcgaggcgggtggatcatgaggtcaggagatcaagaccatcctggccaacatggtaaaatccgtctctactaaaaatacaaaaattagctgggtgtgatggtgcatgcctgtaatcccagtacttgggaggcggaggcaggagaatcgcttgaaccagggagtcaaatgttgcagtgagcgagattgcaccactgcactccagcctggcaaaagagcaagactccgtcttaaaaaaaaaaaaaagaagaagtgacatcagtatgccagttgcaccttcatggctttcctgactctcactggacgctttcaggtataaatatttcctgttcaggcaacattggcagttggacgttgatagctttggaaaatacaagacttaaatggtattctgccaaattcactgtgcattcagagatatttgaatatagaaagttaaaattgctgcacaggaaaaaattacaaggttgcaaacaacgacaaacattaaaatatttacaatagtcagccattcgaaggtggtgatggtttccttatttacacagagctctcaccagtaaatgagagcaatcttatagaaagctggaccgagaaatggaaaggcagttcagaaaagaagaaatgtgaatggtcaataaaagtacaaaaatctaccaacatcactcacaattacaatgtaaaattaagaaataatggtgaggattttttttaccgactgatagctatattatttttttaaaatggtaatactccaaatcagcatctgtgtgtacacagacacttagatttggtgggtgtgtgaatacattttgggaggtcaatactgaaattctgttaaaaatttgaagtacatctcattggtccacaattgaatttctaggaatatacttacctattgatgtatatgtcaaagaaagtcaaggtataagctgaaatgcaacttataattgcaaagattagaaataacttaaatctcttttaatagatggatagatgaatagatttatttaaaattatttaacagatttattacgtaagtaaatgatggtgaagacagacaatgggaaacaggcagccttttaaaagaattaactaaatatacagaaatgaaaataaatgtaatcctaaaattatgggaaaaggaaaggtatagaacaatgtatataaatcaagacatacatgtaattaacaagtgtactcatacacaaaatatgaatgcatatttatgagtatgcatatttactgtatggatcaaaaataaatatttttttctagcaaggttaacaatacactgtcaacagtgttattttggaggtataagaagaaaacatttcctgagaagaagaaaaaaattgttagaaattcaagccacagtgaaaaacaatgtttatgtattatttgtatatattttttatttatagagagaaaaattaatccaatgaacagcataagccctcatttcaatttcaaatcatcctattttcaaatgtatgtagctcctgtctgcaaacacataccctgtttggaactcattattgtggcattcactccactttgctacagaacaccttccagtgggaatgcagttgctttctccttccaagccacccctggtggggacccattaggccatcccgtgtcaaatgaaaagaaacagcaactggagccatccctgggtggatttctaaatcccctggctaagtactgtacagactagctgagttacttcatttctctgagccccaagtcccttcatgacatgtctataagaatgccttgtgaagaaatcgcgacctaaatgtgtatatgtttctgtgtgtgtctgtatgtgtggtgtgggtgtctgtatgtgtctgcatttataaaaaatctactgtggagttctaataagtagcagcaatgaggaagaggccccaggtaggagtgggccccgggtagggaagaacaacaacaatccgcaggcacaatgacctcgacctcattctgcacatagctccctccaacaggacctgtataacttcagtccctccagcccctgcctctttgcagacagccccttccatgctgggtgcctgttgcaaccttacagtgtactttcttatcttctccaataaatccacctttctttcctacaactgtcttggtgaatcctttactgcctgtgccaccagtcccagatagtgactactgcaacatgtactgccctcagcagttatttataacaaattggattctttctttttccttgtaagaaaattaaagagaaaaaaaaatcataagataatcccaattattccctccactggaatagcaaaatgtgacctcacccagatcagcatatttttaaaaaaaaacacaggcccatcttcatagtgacaaccaaacctctatggccacagcaggaagaaacaaactcttcctactgcttgcttagatagtccagcatgagatcctggctcacatatttgctccttaaatttttttcttgaggacttgcctgaattcactgagtattatattaatctcttccctgacaaatgccccaaaaaaatctacctccaagattttgcacattttttgtgccaagcctttgaaaaaaaatttactgaggattgaccaatgtcatttcattacatcctgcatttcccctcaattctatcgcctagttaagtaatacgtttgaccagccaccattaggaaaacttcttcagctggtagacacttgctggcttttaaaattactgatacaatatacaactccccagtgcaggccaccgcaaggacagcagaaatataaagtagcacttagcttttataaggccacattctacatcttaaaaagactgcaccttgcactccattaaaataataaagaaacagaatgaaggaaaaagaaagaacatttaaggacctgaagtttaaatatactaaaatgagaaccacctgttctgtacttactgttagagaccgtactcgttctgtgtaaggatttcttaccctttctgcaatatgatgtgtgtcctagtttatattgacatcaatctttgctcccatttaaggaactgatattggttccccgttaatgttgagggggacctcaaatttggcaaggtggaaaattgttaagtggctctcattgacgaaagtaaagggctgtgatctgaaggggaaggtcagaagatgaagggcagaggaaccatgaaatgcgtttcattagatcaataaaatgtatgacttcactcgcttaatacataaataaagttgttaaaaagaaaataaactcgggcacacaccatgctaaattagcagggctttatgtaagacgaagaaactagaaacaaccctagaaaggtcacttgcatgtatggttttcttttcaaaagcttcatgcaaagccagaaggaaaatctcacagagctgtgtgccgccaggactggtaagatccaagtgacagaacagacccaggcaagatcgaggaggcgaaatcagatcagccaagaagccccaccactaatccagtgctccatccatctggtttaaatcgggtttgaagcatatttatgtgataaagaattaaagctgtttctcttggccacctaaatattgggacactctcttttgaaaagtcattgacatcagtacaagcatattcaaaactgaattagaattaaagaggcttgagtgtgcttaacttttttaaagtatgccagagcctctttccaagttttttttaagcgacaatataagtaataacttagcaaggtcctaagggatttattctgttttaaaaaaagaaaagcgatgtttgagggaaaaagagagacacagagaaaccagacgagagcaaatggaaaggttgctgctatcgagatcaagaaacaaactcagaatattcctgaaagactacctcccaatcatctgaaacgtggcaagtaactctcccaaataagtaccattttttaatcacgaaacactatttctgtaacactggctgtggctttatttaggttgtctctatgaagcgttagacaaagagaaaactattcttgagcaaaatccaccaaccggaagtcccatactgggacctaacaaaatcttgcctgaaatcaaagcctaggtgccctcttccagcttaccactgctgcctttttatgtaaaatgtaacttataaagtcaactaaagttccagcagcatgatttaaatatgattgctttccaagtacagggatgtaggacgtaggaaggggtgtgttgtgtgtgtgtgtgtgtgtgtgtgtgtgtgtgtttctgcaagtgttgggtgggagagtgtacggtttgactctgtgtccccacccaaatctcatcttgtatctcccataattcccatggttatggaagggacctggagggagacaactgaatcatgggggtgggtctttcctgtactttctcatgatagtgaataagtctcgtgagatctgatggttttaaaaacaggggtttcccgaacaagctcactctctttgcctgctgccatccgtgtaagacgtgacttgctcctccttccttccaccatgattgtaaggcttccccagcaatatggaactgtaagtccattaaaccgtttttcttcccaggctagggtatgtttttatcaagcagtgtgaaaatggactaatacaagagtaaagagatatactgctgcttgatcacccatgtcctgtttttgaaaagttaagacacctgtgttaattcactgatgctgacaccatggcagagataaagcctcaatatatatcctccagtgtgactttaactatgacaaggttatcacttaatacaccatcattcaagagttgattactggctcctgggtgtccccgtcttgcactcaactctcaactttcctgggactaggaattcaggggtattgcttaacatttcataaattgcataagagtatgtgatagatctaattccataaatgaacacaaacaacattttttttccctccgaatcaggagggaaaaaaagacccaaagcctcctgcttttcaggctctctttgtgtcctcatgtgcaaactaattttttccagcacataactcactcaaggatccatgcctcttgggagtacagcttcttcttttgcttctatattttgtgtctcactctcacaaatggccctggaggaagggagagaccagcagtcttctgctgaatcaccttgcttgttacatgcagaggagagctcatccctgcttgggaaggaagcccgggaggcaggggcagcatggagtctgtccaactctcacagaaagcccacttttcagagtgaaatcaaacaaaaaaagagaagcctgctggtcattgtgtgttctggttgtgatatacttcatccaaaaaaggattatgtcaatgttctttttatgatatcccacacatctcactgtttcacttatggccaacaatgcagtggtctcttcggttggcatgcagccatttccccctttctatttcaagggtcacagggcccccttggctcacacacccgcagtagctccgcacttgcggagaacatggaaatctcaaagaactgctggggagcatatgtacttgatcacagccaacaagatgaagactctgcatctgtaatacattgtggcgattacaagtcaaatctggaagacgccagtaccgcagcacttcattagggtctaattagtcattgtttcttgttgccctggttaatttgttcttggcttcctaagtgatcagcataggagtttcaactccatgggggcacctcaatgtccctggagtcttctgagcaatgtaagattaccaggatgtgaatgtacaggtccacagtccttgagtcctgatctctggagtctcaagactcagctcaaaggacatcttcctctgaggcctttactaaccctgtttttacgtagaactgaccctaccctcctcatgatcgtgctgtacttcatactgtcttttgtgcctataatactaatgcactatttattagttgtttaatcatcatgctgtatgttattttatatttaattatccaatgaaaacaatatattttaggtctaagtggcaggcactatgctaagcactttatatagaaattattttgtcccctctttgtatgtggtactgaaggaagagacaagagcacaggttcaggaatcagacactctgggttgaaatcccaactccaccagcctgtgactgtgagcttgggcaaattccctttctattaacatctcatctgtaacacacagatggaaataaaaatggcaaccttacacggttattccataaatacacccattaattaatgaaaactgctaacaaggagtaagctctctgtaaatattgctgtttttattacctctattttacagatgaggaaacggagacttaaagtggcaaagtgtaaagggacctaccaaagatgactcagccagtgaacagcgacgcttacacttcactccaggagcctgacccctgcctgtgtgctcagcaccaatttgacccaggctgtcaccctccttgactggtccatgagctctttgagggatggactgtgactgtctttgaatgagctagataatcaatgcatggattgaataatttatttattaatggctttagattttaataaatcataggacagtgccaggcatggaatgcagtccataaaggaatgttgggatgcaactaatgtgaaagaatttcatttgagaatttattttcagtgtatgctttgcttgtccctgcaaatataccagtagaggtaatcctaattatttaagcataaatacagcagtctttcggaataaaccgccatttctgcagcttaaacctaatgtatgtagcttttaaaacacaatcatgtactcctttataataaactttttacacattttaagtggtttttctcccgtgtttgatagatacatcaagacgttccatacgagatagactgcatcataacaaattttaaggcactgagaggtgtgtgacatgtgcataacgaacatatcaggaagtgtgcccccctcatttatacaatcttttaatatgggcagcacgctaaaactacatctctattttgcgttggaggttttccaatcctaggcccgatggtctctccccaccttctcttagacttgtcttgatacttgatgaagttcaaatgctgaacagtgcctactgagatacaggaggcaacattttataactaccgttgtttgcaagcatcctatcaagatccatacttgcaaactctcagcataaaagaagaaacagagttctgtgtaggacaatgaacttggactgttgtttaccagcaaatggaaaacaacatttctaacccaggaagggacgcttggccccctttggtgatgcctcagctcccttcacactgggcaacaatgcgcctttgtgcgggttgtgggatcgtgacaccagtcaggccttactgcttgggcaactgatcacaaccttcatactctgcagagtgttctagtcccattgtgaacaaaatatgtaagggacctagcctccgcccccggctctgttatccctgacttcagattgaatcctactggcttcaaatgcacttttcaaaccttggcaaattcaccccaacactttagaaataagtaggatgtgttaaaacattagaattcctcagttgagtgaaatcattctttggaaataaatgcccagcccttctgtgccactgcatttgctactgaaatcaaaccgttataaagctcaggatttaagttaacctgggtccaagacatggtaccattccttaatagctgtgtgaccttggccaagtatttaacctctctgagccttaattttcttacctgtaacagggggatgataatgactttaagggttgctgaaagtgttaaaaggacaaatttggggtttagtgtttttttttttgtttttgttttttgtttttcacacttctaagacctatttttttttaactcttagctattaggggcgttgtactaacaaaattagtgtttgtctgaacacacgtggattggaagtgataggaaaatttctccaatgggatcaggagtaagtgacattgccacaaacaacattaagcttttgctaaatgattctggcagggcgttttatcttcatcaaaccacagccattgtcttcttcttaatctcttcttctctcctggtccttactggataataacatcagtgggtggtgggggatggaaagggggtaaccaaatcatcagcatctcccctgctccattcctcacatccagtcactcacaatgatgggtctttgccatgcactttctctctctcttgttcctctatcagaccaggccttgcgtaactgtcacgtggactactgcaagttgtactgatttcctgccctgaatccaatttctccttcttgcagtctaacttctgtgtcccaacaaaatatttctccttaaagcacatttgagagcattcacttgcaccttcccatccacatgtactctcagtccacccctccacccgctacaaagcatggagtcaggaaatgccaccctaactgtcgtatgttgcttagtgggaagtaaatcagaacaacctccgtagagggcaatttggcaatatctatgaaaacgaccggaggcatactctctcagccgatgctgctatttctaagactcaatcctgcaaatacatgcatgacgtgggaagcgatgtcggtgcaaggttacacgttgcggcacaatttgcaatagcaaaagctgggaacaacccaaatgtctatcaatagggaattggttcaatgaattatgaaacatcacacagtgtaatactcagcagttgttaaaaaatgaagaaataatttatatgctgatttaaaccatctctaagatatattgtcaagcaaaaagagcaaggtgtgtatagcaaagtgaagggagggcagaagaatatacaaacatattgccttgtaaatgcataataatgtctagaaggtgcaccaggaaataacatcggttcagaagaggaattaggtgctaaaggaaaggggtagaggagattttaacacacataaagaaaaacataggtgtgtgtgtgtatatgtatacaaggatttatatatgcacataggtatataaatatatatacatatacaccttgtttttatcttctcttttgatttttgaaccatataaaagtattacctattcaaaaataaatattttatgtgttatgtacattttttaatcctaatttaaaaaaaaataaaattaaagaaataagtttaaaaaaaagcagtggccacataagccaggcacctattttctgtcttctctaggcaactgtgatcataaattacttcccactctctccttttctctgtcttacacacagaggctgtatttacccctcaaaattcagctttgagcacaatttcctgttccaaaattccctgtggctttgcatgcctataggacatccagtcattctgcatggagtctacatttatgtaggctggagtctaaattcttagtctaaccttcagggtccaccactgacccctcaactcagttttccagcctgtgtccatcactgctcccttgctgtattagtctgttcttacactgctacacagaaatacctggactgggtagtttataaaggaaagaggtttaattgactcaccgtttcacatgactggggggcctcaggaaacttaccaccatggcagaagacgaaggggaagcaagaaccttcttcacaggcggcaggagggagaatgaacacagaacgaactaccaaacacttacaaagccatcagtctcatgacaactcactcactagcatgagaacagcatggggaaaaccacccccatgatcaattacctccacctggtccctcctttgacacgtggggattacaattcgagatgacatttagttgggacacagagccaaatcatatcacttgatcagctcccaaagctaaatcactcatttgactaggtgcttacccttcttacctctgtttccagcattctgtcctcccagcaccccaagcccaagctctgcttggttccaagcctcagctcacatcctctttccccatcacatcaccagaatgacagctcacctccatccccaagctggaagaaagccccttcttctgtgaaacccagggcacattatgttgcttccctaccatatttaacacaagggatcataattttgtactgtttatccattcattcagtaaacatctactaagcacctactgtatgtatgtactgaaaaggtgttagagtaaaaacaccaccagccggattcctgcactcacagagatgacagtctctggagaagacagatagtaaagaaaccacgccttcgacgataatctttgataatttcaactggagaagtaaaaagctatggcaaaaatgctaattgtttgctcaaagcaacaccataattttcaatttagcacaaggggctctgaagtccaaagaacccatattaaatcctggcactgcccaaagctatgttcctccagatcagggattcacaatgtcaacattgttgacacttggtcatggcctgggggttggggttgctctagagttatggcccagaacttgtctccttgggagatgcaggaagggtcttcatcccaagggtccagctacatttgccacacggatggattcaaaagttgggactccctacacttggatgtaggagttgaaatgtctatcatttgagcctggggtactggatcccataaaaatgccacatgaaagaaagcgtaattaagaagctgttacaattcaggcttcagataatgcactctcttcaaaggcttattttgcacatcccaaattctcctataaaccatttactttcccatgctattggacgctatgagcatttaggaaatgttctcaggtgtttgaaatcaacaagacaattacggaggtttggaagattctaaaatacaatcaacatactctggaaatgccaatcgaattcttggcctggcagactacagctgtaatatacatcttaaggacattttaagatgatgttaaaatgaatattcatcattctgaattccaggatttctttcaaactgagaaatggatagagggatgggcagtctctagcaggatctgcatatagttgggagaaatttatccctaaaaaaaaaaaaaaatgggaaaataggtttcagagtcagacagcatggattataatcccagctgtgtaacagaaatgaatgtgaatgatctggagaaaatcttaactctctcagagcttggttcttcagcctgaaaatgaggacagtaataccaccttaattaaaatatgtaagggtctggcaagatgtctttgcaaaccttcattttcattcctcatccctttagggaacagagtccagactcattggtttatatttttataaagcttgcaaaattgacactttctaaccaatttagtttctcttgaccaaaacactttaagacacaaatgtttcaatctgttttgctccactaaacaatataagcccaacccatcacccttcttttcttgccataacagcctccctgaacatattcatcattccacaagaagtctcgcttaaaaataaaggcattctttctatggctgggacagggccatggaatgcacttcgggtataacaaaagatgctgatctgaacaagaatgaactcagtcctaacgtgacaggtcagacagagccgcctttgtgcacaccaccctcctgccctgtcttcctttcccttaacgtatcatgatgaggaacctcggtgtattttaaaaagcataataattacttatacttctctatggtttccaataaaccagtgattttttttcaaaaagtccatgaataaaacaaaccccgtcaccattggaaatgcatttcctgcaagcgcggatgcttttaagaccatttgccgagcgctctgcaccgtttgaccagttcggggcagggggcacgctctaattactgattgtggagtttggtatctatagcaacgggcaaattgacaacaggaagcttcaccctctggggcaccatccgaagtttataaaatcaacttaggccaaggctatagttaatcaggagggctttcagagcacgagtgctccgagtccacactaagaggcaaagaaattatttaataagacaatcaggggctcgagaaggcagagtttattagcttggctttgcagtgcctcttgtagtaatttatcctaatggtaccaattcgcccatgtttgatacagcaggagacccagggtatcggtttaatcaaacctccatcgatgctgcctgttcttaactattgttgctgtatatcaatcagtttctcttgattcactaatcggatggcaggggatatgaattgtcctgggattcaagaaatcaggttgacataattctttataatgtgctgcttttaaatggcattatttcaccccactcacattatttcatgttcctacagctgacggtaaagggtccagattgcaattggctgtgggtgagaaagaaatagggaaaaagcctgggccttggggtcaaactattttgactgctggctctactactgcctgttagatgagaccccctgggtctcaacgtccttaatccttacataaggacaagaatctactcaggcacagaactttatgaggatgaatgaactggtgtatgaatgagcctagatcagtgtctggcaagcaggaaaagagcctcaacaaacgacagattcactccccagctgccctcatttccactcccgaaacctggggagttacgaatgtatctgcattatttttataggtaagatgccaagatgtgcagattttatgggcctgatcacgcctacgttggtaatcctaggagggcgtctaaacttagatcttatgctcagctctcctgtccccaccgaggacagagtcaggcaattgccatcatgcttattcatgtggtgctggcctggctgttgagcacagaccagcggtgtcctccctctcactatgggtactctgttgcttccctacccaaaccttcttccttatacagcacgcacagaccagaattacaagaccagaccttttccccttggaaggcagcaacttttgaaggcggagaaggccatcctcaccttgcgttcacattgttcaagagagaagaaggaaaagggcaactggaatccaaattttgaggcaatgaccatgtggatggcgaggccccggcaagggtcccattgctgctcagagacctaaaagttgaggtggccattgcaagcctcagtacaacagccctcagttgcgcttctgtaaaatgggcatatgaagatgtatttcattgagctcacttcccaaggcaaaatgggcaaggtattctggccctttttcctacaatgagaactaaatctgggcctttcaccatcagcttagctgtacaaattttacctcagttatcctagcttacggttatttcctgcgagagacccaaaaacaaattaaggaattagcgtgaaaacaaagggaagggaagaagaaaagtgagagtatgggagggaggaaagaaagacggagaaagagagagggaaagaaagaatgagggaaggaagggacaaaaaggaaggatagagagaaggaaggaaggaagggaaggaaaaagaagaaaggaaatagcaagagaaggaaagaaacagaaaaagaagaaaaagaaagaagagatccgtgcttgcccacaccttttccacactccttttctccgttcttaatattggaggatttgtgcggcttttagaagcgctattgttccaatagccagggtaagggggttaatgccgcctaacaagggactcgttgcttcctccctcccacctcctcccttttcttttttggctcagccaaatttctaacactacctgatgaaatgtagtatacagcttttaattgtgcccagaggcgtacaacttcacagaggtttagaagcaagtggcggatgatttgagaaacagctgtgttccggcccacgcgctccgaggtggaacagccccgtcagcacctgtgcccgctgagcacacacctcacaccctacatgcgtgtgcacagctgggacccatcagggttgtaaggaattaatgccttaacttggtattttattgtacctagaggagcctgacgctatattaaatccgtagcactaagtagggttttgttcaatcttagggttactggggctgggggctggatgggatattaaaaaacacaaacacacacacgacctcttttctgatgctgagaacgaattgttttaatatccaatgtttggtttatttattattagggatgagtggccacttttaaagagtaatggacctatctggcactaacctagttttcccaattgaatctatctcagactcccagcaattgtgggagccaccagttcggattcttttctcttcccaaagcccagcttcccttggcgcatgccccaaacacacctcccaccttttggactccatggagtctttgaaatcctactgcaaactccactctcaccagcacggtctcttgttattcaactgcaggcctcccgagtccctggaagttcagtagacgagtgtctatgtacccatcccacagccccgtaaacagagccgaacagaaaccatgcccaagtcatggcaaaccgacatcggaccttagaattccatctactggccataagtaaacactttgtctctaagccatgttatatattctgttgtaaacacaatgcgtaaaatttttccacagcagctggtactgactgcgactatggagaagatatcatgagcgagttttcacaatgctgtactcatgtaattagcaatgcacctcagtatctgtggtaggcagaaaagtgcccctgccccagaggatacccatgtcaactccccggaacctgtaactgtgactctatttgaaacagggtatacgcaggtgtgagtaaacattttttgatacgatagttctggatattccagtgggtcctacatttaaagacaagtatccttacagaagaaacgcagatagccaggcatgtgactcacgcctgtaatcccagcactttgggaggccaaggcaggtggatcacctgaggcacgagttcgaaaccagcctggccaacatggtgaaacctcgtctctactaaaaatacaaaattgaccgggcatggtggcgcacgcctgtaatcccatctactcaggaggctgcggcagagaattacttaagcctgggagatggaggatgcagtgagccaagatcatgccactgcactcagccggggcaacagagtgagactgtgtctcagaaacaaacaacaacaaaaaataaacgagagggaaatttcagacagacagaagggaagtccaagtgaccatggaggcacagatagataatgtgaccaccagttaaggaatgcttaccgcgacctgaagccgggaagggcgaagaaaaagtctcctctagtgtccccagaagcagtgtcaatttcagacgtctgggctccaacacgtgagcaaatgtatctctgctgttttacgtcactcagtttgccgttattacagcagccaaaaaaactagcacagggtcctttgctctgggcaccatgtgagatatattttgctgctaagggggctcttggcaggaggggcgcctaaacttcgggtactgtggaagtgcagaaagggcacattgcccactgttaccccatctgtacctacttttgaggaaatggtagttcagctctgagggtaaatgcgcctgacagcaatagcttgagcataccttgagaatgactctctgaaggtatatgtacctgaatgtctgttcctagctagggaatctgggagtggccaatcaggagatcattccctgtctatgaggaacaactgagccccctggcctcacaggccgtatggaaaatcagtccctgagttttggattaaataaaggttgccaggtggaggtcattaacggcaggatgtaagtgaaaatgttatctaaataaactgcactcttcctgcaggcagttgcggtttccctcccaggccacggccactgggctgtgtggttatgttgtccagccactgacactggactgtggaaagtggagtcttgtccattccacggcccctgaaccatttctgtacataaggcagtttcctgcccagcccactgccactaaactctctcctttgtaggtaaacccctaataaaacctatgtcttgtttgctggctctgggtctcttctctggcctcttgatcctagtgtcttcccatgaggttaatagggttcagcacaacagcatcgtggagaagccagccactgccatcatgttcaaaccaaacagttctcagagaagggtacagagggaggtgaaaagcatactgtcctccggctggacagtcccgttctcttcgtggctggaccatttgctatgtgtgtgccgctggccattattgaatccatgccttagttgccttgttggaaaaatgagattctcaatgtaaaaccactttgaaaaaactgcaaaacatcatatgaacgtcactcatttgcttcaatccatattataaagcacctacaaagtgtcagactcatggagcgcggatggcactccgattttgagggggacacaatctctagtaggtattattgcaactttctccaaaatacactttttcttaagttccacttgtcatccattaatataacgaaacctctttagaaaccctccaatccaaaatgcgggttaatgtagcccataaattgaatttccgctgtgtttctctggattctccaaatttgttctttcaacccaacaataacacaccatttgtttgtttatcatattagtaatgatttttttttttttaatgagcactcaatactggttagacgaaactggacttcagtgctgcttctgtcatttaaattgctacaaaccttttggagagcaatttggcaatatgtctcacaaaccttaaaaaatgtgcccaacctttgacctagtaattccatttctgggaatctatcctaaagactaatgggaactatagaaactgctttatgcacagagatgtttatcacaacactccttatgcaccaaaagtatttaaaaccatataaatgaccaacaacatagaaatggataaataaacacaatgcttcccctctgtggactatcacaaccactaagaattgcagttaagaagcatttaaacaacatgatgaaatgtataaagacagggaaaaataagcaatgtgccaaatgggcgtaggcaatgatctctatgtgggacaaacaccacacaacacaacacgtggtaaaaagactggaggcaggcatgggttaattgtggttgccatgggcagcagaattatgagtgattttcttcttctttttaaatatttttaagatattcttcactgagctgtatgtattatcggcatacctattttattgcatttccttttattgcactttgcaaatactgtgttttttacaaatcgaagtttctggcaactttgcattaaggaagactatcggcaccatttttccaatggtacctgctacttcatgtctctgtatcacattttgataattcttacaatatttcaagcttttaaattatattatatcagttttggtgatctgtgatcagtgatctttgatgtccccattgtcatttttggggcaccacaaactgcacccatatcagatggcaaacttaattgataaatgttatattatgaataccacactggctccagcaacctgctgttctccttctctttccccctccttgggctccctattacctgagacacaacagtattgaaattaggcaaacttacaacccttcaatgcttttcagtgcccaagagaaagtcagagttgcatgtctctcactttaaatcaaaagctaaagtgattaagcttaacgagaaagccatgtcgaaaactgacataggctgaaagccagattcgtgccaaacaggcaagttgtgaatgcaaagaaaaagttcttgaaggaaattaaaagtctattctagtgaacacacaaatgatagaaaccaaaacagcgttatcacccatatgaagatgtttgagtggtttggatacaggatcaaaccagccacaacattccctgaagccaaaatcaatccagagcaaggccctcactctctataattgtgtgaaggctgagaggggtgaggaagtgcagaagaaaacttggaagctagcagaggtcggttcatgaggtttaaggaagaaagcctctccataacaaaaaagtgcaacatgaagcagcaagtgctgatgcagaagctgcagcaattttccagaagatctagataagaccactaaggtggctacactaacagattttcaatgtaacaaaacagctttctgttggaagaagatgctgtctaggactttgagagctagggaggagaggcaatgcctggcttcaaagctgcgaagcacaggctgactctcttccctgctggtgactcaagttgaagccaagctcatttaccattcccaaaatcctagggtccttaagaattatgtaaacctactctccctgtgctctataaatggaataacaaaccctggatgagaccacgtcatttatggcatgatttactgaataatttatgcccactgtcgagacctactgttgggaaaaatttgtattcctttaaaaatattctgcttggtccagtgtggtggctcacacctgtaatgtggcactgtgggaggctgatttgggcagattgattcaccacaagttcaagaccagcctggcaacacggtgaaattgtgtctctactaaaaatacaaaaatagcccagcctagtggcagtgcctgtagtcccagctactgggaaggctggagtaggaggataatttgagctgcagtctgccagtgcattccagaccaggctgtctcaaaacaataacaataaaaaaaataaaaatatccacttgttgacaatgtacctcgtacctaagagctctgatggagatgtacaagattaagtagtttccatgcctgctaatacaatgcccagtctgcagcctatgtatcaaaga

SEQ ID NO: 5108 - DNA, 13310 bp, Homo sapiens
ccattagaaaggacaattggactactgatgatttccgatcaagtagaataaatcaatatgaatggctcatcttggctaaaattctgtgacagtctctggttatgaaaatttaccatcagatcctgttcacataggacactttattcagcagtggggagagtttagcagaattctcttctgcacagtttaagatggagctgggaaaagaacccaagtttttagatacagcagtctgttgctacttgaatcttttcttctccgccataccaggactggaagacatagattgtgcccatttctatatcctaattacctaccagaggattgggcatgtaaaatattttcagaggggataatggatgagaaatattgttcacaggcttagaggtatacactcaaggaagattttacttttaacctgaaaattgcaaaacaggtgcttgtagagctgtacccacagcagtacattgattcgcaagtatcggggcgggaaaaactacaattgctgcgtggggtggggtgggggtgacctagttccctttattagccagagatataagtgacaggagtctaaatgagaacctgaagccaacaggaacatttatttgatcaggtaactaaaaagttcagggtatctggcttccagcacgctgaatacagatatataacaatgtcttcgagaacgtcttcctgtacctgggctccgcttcctctgtcagactcagtctttggcagattctccttaagtgatggcaaagataacaccaccacaacagatgttcatccttcaacttggccacctcagaaggaagaggggctccagagatgccccaagattatcattggctggtccagtgccatgtgctcatctctgcacccatcaccgggtctccctctcattgttcagaccaagtcacttgtgcaccattagcacaaggggtgccagtccacagggataaaggggcaagcagggacaattcttcagtaaaaaactagaatggatcttgatgaggaaagatattctatgtccactatatttctattgtcattatggaatgaaccgtgtattttttatcttaacactcatttccattcttctggtaattgtatgtaatcaatcttgttaagccctctccccagctgtagcccctgagctttttgtagagattcctcctggtgcgagatggagcatatggttcagtgctggaacaatgtggtcattatatgctcctggtcccttgaacagttcggggatggttatctggtccaggaagacccagtgaggtgaaatgagacttacctcaaacttgagtaaaagagattcttttttcaaaattaactttttattatgatgatttccaaaatgcatgaaaatagaggtaactctaatcataagcagagataactctcctataccaccatccagcttcagcatttatcaactcatggacaatcttaattcattttattgccaccacagtagattattttggagcaaattcccaacatcctatcatttcatctctatacttttaatatgcgtctctaaagataagagctcctgggggaaaagacttggtattttctattaaagtgaacctgaaaagatgtagggaataaaatcactgctaccatcttgcttccacttggagcaacaattggagccaacaactagagccaactgtgtggcagcagaacagcaagaaggaggacacgaaatccagatgacagattttgggtcctgaattcacctgtgcatggagtaagcttgctactttttttttttttttcagtcacttgagctagaatattccctgtagctatgttgtgatgccccactcatatcctcttggcccaccctgagggtcacctgaagcttagatggacattcccaacacagtgatggcttctcacctcaagcacaggcatctctctgcctaagaatgtctctggccatacgattgtgtttggctcctgcatatggcagacctgaagtggcaggggataataaatgccccccagaactgtctttaatgatgagggatagaagttggcataccctggctctttgctgctcagggagacagtaatgaggtgtgtcctacactgttattggagggccctgtggggttaaatccctgttatccccagaagtaaccttcccatgaatttccctgctgctgcttcttttcctttcctgtcttatttttctacttcctcaccacacttcctgtgatcacctccaactaaaccatgtccccccagtttcttgctttagcatctgctctaaagtaaaacttactgaagtaattcccctttgcttcattttgcttaagcttccatggttctatttcctttttaaaatttctatttaattttaagttctgggatacatgtacagaacataggtttgttacctggtagacatttgccataatggattgctgcacctctcaacctatcacctaggtattaagcccatatgcattagctatttatcctgatgctctcccttccccaccaccaacagactctgggtgtgttcccctccctgtgtccatgtgttctcattgttcagctctcacttatgagtgagacatgtggtttttggttttctgttcctgtgttggtttgttgaggatgatggcttccagctcatccatgtccctgcaaaggacgtgatctcattcctttttatggctggatagtattcctaatatgtatgtaccacattttctttatccagtctatcattgatgggcatttgggttaatccatgtctttgctattgtggatagtgctaaaataaacatacgtgtgcatgtatctttagacggaatggtttatattcctttaagtatataccctgtaacgggattgctgggtcaaatgtatttctggttctagatcttagaagaatcactacactgtcttccacaatggttgaactatttacattcccaccaaaagtgttcatggttctatttctggtcattcttaaaacaaaaaaaagtcctgagtaattatgctccatatttccatccccagtatttgcttgagaaatgaaaaatgaaggcttctgagaaacagtgtccccacgcccccataccccattcacacaaaatgtttcagcttgagaatacagttgcggaagccaagttgggtctcaggaatatctggtttgcataaatttcacctgcagaattataaaattcaggtgctgttgccttgggcacaactgctggctctgataagtagagtgggtgtcccagcagcctgtcctgttggttcagataatgatttagggggggcgcaggccccagggtgtgcacatggatggatgctctgcttatcctcctccagtaggtttctggcatctaagacaagagaggagtggggtcaacaaggagagcttctgtctctcctgtttaagcatctctcctactacctacaaatgaaaacatacaaatactatgttgatgtatagcaagtaactttaaagaaggcccccagaaatacttcactaattggagaccagtttccagcattttgaaaccataaggaaattacaaagtaagctgaaaaaaaaaaacttagatatgcaaaagagtggtcaacaaagtccatgtattctacacaaaggagagccgtcttaagatgtctctccaggctagtttacttttactttatacacaattgcaacagagcattgaaagcgcacattttaagcagggaaggaacatgcacagcaagggctgcaaactcaaaaaattaaagaaccagagaataattttaaacaagtgaaagaggccagttgatggattaatgccatgtgggacgtgggtccagtgttgacagttcttccatgttttcaggaagaaactgaaaattggattttaagtgaaataaccttagttttacatagaaaatatctaaacaaaaaatttttaaaaagcatgcagacctggcacatcgggggcgtgactttgccccattaaatgaagcataaatttctattttgccagtgttcctatttggctcatataggacactttaatttgtgattctttgttattagatcactagctttttaagcacaggctttgggctctgtttgccttcttgggaaaactgtcagaaatcagtgggttcataaccttttgaagaagtcactcttattttggttgaggggcagtgttcttagctacccaaaacaaactagctattcacttcctgggatcgctgggacggtgcctgcgggtttctggggacacagaagatacatcttcctcctccctctcctgtgttacacaatctgctttgaaaggttatgattcttctgtgggcgactggcctacagcatctgctgctttgcttgatttggttcatttcacccaggctggcatcttcgagtctggggtcctttggctttacccgcacataatctcttgggtggatcaaaacctcttcaactctctcttgagttccaagcaggctcccctgtggggcttttctaagagtgtttagcattggcattgctgcaagcacagtctcactgtgtggttttatgaaggatttgttttttaaaatttattttctattttgtgtctttagaggcagggtcttgctctgttgcccaggctggagtgcagtggcatgatatagctcactgcagcgttgaactcaggctcaggcaatttttcttgcctcagcctccagatagctggcactacaggcacacaccaccatgcatggctaattaaatctttttttttctttttttttaagaacgagggtctttgttatccaggttggtcttgaactctgccctagccttcgagtagctgggattacatgtgtgagccaccatgcccaactaaggttaaaaatcttaagagcccttcaagactctactcctcaaggtcatgaaatagtcttttaaatttgttaaaaatatgctgagtgtattttattttcaactcaataacgctgtcacacatattaaacaataatggattttcccatttatttccttctgcatatatatgtgtgcattgatgtgcatgtgtatgtagtatctgtatttatacaagtacataagatataaatatatccatacctatttgtaattgccacaatttatacatgcagtagtgtataagctgcatgtttcacttactatcaaaatctcttaagcataatttttatttattctgattatttaatacacagtgatgtaactgtgatcccaaatgtgcaaagttaaagccttcaactgcagctgaggagagggcaggaatggtatatgggacggtggtgagtcacgaatgatgggcaggcggccatgagcagggcagcctcctccccgggccagggacaggggaatggcctaaggagccaggacccaagggtagcccaggaccggggagggggcagagacctccccttggcctaggtcaggagctcagaagtgccacatggctgaggggcagcggcccgggaagagccagaggcagagccaggaaagcaccatttcctgggggggcgggggcagggaggtaccctacaggagaagccaggtggggcctcctgtccctggggtggggccatgctggagcatgctgcagcaagaaagacctgaggcaggcgcagggcctgagagccggctggctgggctggggggcgcccccaggcagcctggcccagggagcaggcccgactcttaggggatgctcagcgaggggctgcagagccctcaggacctctcctcctctctccctggaaggagctggggaacccgtagtgcaaatctgtggaccactcagttatggagagaggttggcccgaaggtggacactggggtatgctccctccaccacctcatcctccactgctatcctagtacagctgcttctggtaagcgtgcaggccatggacgccaccctcgatctgggctgactggtccacttctcaaatttgagctctcctgagtacatcatggagccatgctggttactcctatgaggtagggcacaaacttctgaatggaccctttgtcctggatggaggccgagacacctgcacaatattcaccttttccccctcgctgaagtatcgtttctggctgctgctgctctctccatggcatctagcgagcccatgccccagtacttcttgagctgcaccctgtctgagagaagtactcgccgctgggcctccgtggtggtggccagcagggagcccatcatcactgtgaggctccaagggccagggccttgaccacgtgccccacggtctggatgccacatcggcttgatggacacaccaaagtgctgagcgtacttggccaccttgtacacagcagtgccctgggctgaccgcaggccatcacttcctgggtgatgcagatagagctgcagcccataactacagcagtccatccacaccagtgtcaatcaggttcttagcctgggctgctgtcaccacattctcccaatcacctggaggtggaggtacttctgtttgatgtaatgcaccatggtgatttgaacaccgagttcccttgggaggagtccaagactatgacgttgatgcctacccaggtgagcggtccaggcagtatttgtcatcctcatgggtgcccacagctgccctgcacagcagctgctgtgggaatccttggaggccagaatgtagtctcgattcttcttcaggttggtgtgggagcgatggccactagctcatggcgatcattgaccataggcagcttcccttgctaggctgaagatctcatttgcctgtttcaatgtcatgcctgctggagccaccatcagcttgatccttgcgtcatcacctcactgaggagggtggtgtggtccttctcagcaagaaagttgatgtctcggaggagatgatgcccaccaacttgctccccatggtgcccatctcagtgatgaggatgcagagaagccatgccggatcttggcctccagcacatcacccacagtgtgtgaggggctcacaccacggggtccgtgatgaagccctgttcaaacttcttgaccttatgcacctcgttggctggaactctggggtgcagttgtggtgaatgaaaccaatacctcccatcagagccatcggatggccatgtcggcctctgtctcagtgtccataggggaagagatcagtggtgtcttcacatgatcttccgggtcagggctgaagttaggtctacctcatcagctatgaaatctatgaccatgggagaatcaggaagttgttgtgggtgcggcagttggcgccgaggaagagctgctcacggtgagccagtcctggggcacgtagccggtgccgccactgatcagatggtccgccagctgccgcaaggccccgcgaagcgacaaacacccgcgcggccgcctgccgctgctgccgtgctgctgacgctgtgggcctgggaactgtaagcataatttttaatgcccatagtggtgttatttaaccacttagtgttgggtgccttggtcattttcatggaaacttttgctaatataatgccactgataaacatctctgtgcataaacctttatatttactgttattttctcagttagattccttttagaaatggaattgaacaaatcccttgaaagcctccaaactgtctcattcaatcagttcttttaagagctgaagtaagagtattcttagctccacttaattggtcgactgatatactagctttttcttgatttttgtctgaagtaattaggttaagaaaagttagttaacacatacatccctgaatagcagaaactgaatccaccacagatgtacttcttactcgctgaagtcaaatgtggatgtttgtattcagagggcggccctctgacaagtgacgattcagggctcagctcctttcatcttttggttctgccaccttcaacatatggcttctaaggccatgacatcatctgtgttgagctgtgaaaggagtggagcctgggaagttttttatggactaatattcccaggaggaaaacggagtaggatttatgatcacttatccagaacctgctacaaatttctccttatctcatacttgcagtctgtcagcaaatcctgttggttttatctttgaatatcccttgacttacccacttttctcccttgcccatgcaccccccagtcctggctggcgcatcactcccctggatcactccaatagcttcctcattggtatctctcttccactttgccccttgccacttgcttctccatattctgttaagaaatctttattaaaacaaacagttccagacattccccaggtaaaaaccatgtaatagcgtccattagaatttattaaaaaatccaactatttaccttgatgaggtcctgtgtgatctagccttgtctattctccagtctcatccataccacgttcccctaactcgttaaatgctattccaaatggtttccattcaacttttcaatttgccaagctctttcttaccctgtagcctctgcgtgtgccactccctttgcccagaacttcttgttgttcttcacttgacaggttatttctgtttttatttaaaattctttttatttataacaatgagaacacatggacacaggaaggggaacatcacactctggggactgttgtgggtggggggatgggggagggatagcattaggagatatagctaatgctagatgacgagttatggatgcagcacaccagcatggcacatgtatacatatgtaactaacctgcacattgtgacatgtaccctaaaacttaaagtataataataataaaattaaaaaaaaatttatttttttgtgggtacatagtaggtgtatatatttatggggtacatgagatgttttaatacaggcagcaatgtgaaataatcacatcatggaaaatgaggtctccatccccttgagcatttatccttgtgttacaaacgatccaattatatattttttgttatttaaaaatgttcaattattgatatagtcaccctgttgtgctatttattaaatggtaggtcttattcattcttcctatttttttttttttgtaatctgattatttcttgttctttggatttcagcctaccttcatggtgtaacgtacttggttataatgcattgccttttgttacatttttctatttgatctgctcatatttgtggggcacttttgcatgtatgtttgcgaggaaggttggtctagagtttccttatatggcttcctctggttttggaatcagggtaatactatcctcataacatgaattgggaagtttgccttctgaacactagtttctgaaataatttgtgtaggactcttttttttttttcctaaatgttttatagagtgcagcagagaagacatctgggcctgaagtttactttgtgggaggttttaaactatgggttcaatttctttaattgatacagggttggtgaaggtttctattttttttgaaaaagctttggtaatttgtatctttccaggaatttgtccatttcatctaggtgtcaaatttataggcataagggttttttaatccttttaatatctgaaagtctgtagtaagcaccagactttatttctgatagtctcttttcttcttgatcagtctacctaggtttatcattttgtttttttttttttttttaaagagaatcagctttgggtttcattagttttctctttatttcttaattagcttctcagcctaaatgttttctcagaaaggatgtttcctgaccatctacctaaggtggcttcacctttctcttgccttctcctctgattatttgttttctacccaggtctatgtgtaattattttatgtgttatgtgctttttttgcttctatgttacttgcgatattgcagaatagtaataagtctgcctaacatggtaatgtgcttggtgaatttccaaaacatatatggtggtttccaagtatgctagcacagcagtatctatagtggttaagagacagggtctagagttggctcatctcagctttaaccccggctacatcgtacactaagtgtgtaccctgaacacgtgtaaccgtgaacacaaattctgattccttctgagatgagggttgtgaacatggcagctgtgatcaggaggcctggggtttgagttctggctctgttacctgtcagtgtgtgattcttgaggcaattacttctctgagacccaatgatatggtttggctgtgtcccactcaaatctcatcttgaattttaactcccacaattcccacatgttgtgggagggaccagtgggaggtaactgaatcatgggggtggatctttcttatgctgttctcacaatagtgataaggtctcatgagatccaatggtttcaaaaagaggaattctcctgcacaagctctctgctttgcctgctgccatccatgtaagacttgacttgcaccttcttgctttccaccatgatgtgaggccttcccagccatgtggaactgtaagtccattaaacctctttttcttcccagttcagttatgtctttatcagcagcatgaaaatggactaatacactcaattttctcttcttaaaatgatttgatgcaaggagtacctaatcttgggattattgggaggaactggatgagaatacatgagtaggatctagcccagggttggccttttgcatatgaggcattccctcaaacgtactttcccagaacttcagctctccccaccagagggtaagcatcactgtagcaggcacttgcacgttttgtgcacctctgtaccctcactgccttgatcagtgtggtcagacaggcatgaaaaatgcctgtgaaatggattcttctttttgttgcttatgaaatctgcaactgtgattgagtgtcctgaagctcagcagggcaacgatggcttcaacaatctggcccttgcttgttcaggtgagctgctcctttccctttcaggaatcttctaaactgctgggattcccaggggaggacgggacctttagggatcttgcaaaccccagcagaatatcagttttcttcacagaacgtgtctaacttccttcagccctggtctgcaaattccagacatgaaactgtgctatttgtagcttggcctggcaggtatttattcaaaggctgcaggactccatgatagagagtagcacagagccagcaggatcctgtaagtactcctcatgcaactacctgcagtggatttaaagtagctcagggcagtttcaacaccagagttggaggaaagaggttgtgtgtacattgtcctcggggactgctgctgtttatgccttgtggtttcctttgggggagacagatccaccctgcttcctcatccatcttcctacatggatatatcttgttatctagtgctgaaatggcatggaccaggggctgggactagtgctgagatcttccgcttagctcttccaaatacagaaagaactccctgtgtatggttaggattgaagtacatgtgcttggttcaacattccttcaatcagcagaaatccagtcatcatcctagccctccatttcattctttgtcttgcttcatgatgtccctaggggtaaagatttctgaattcaaagccagctgagctgggttcaaatctccacatgtcatttatgagatgaacatcatgtcttctgtctgattcatttgtcttagtttcttcctctgaaatggaggtaatggcaatgtctattctggcatgttctcgggaggctgaaataacacccggcttgctgcttattgcacagcccagcttccctgccttccttctctcccttcatgaatcctccatgtcctgctctacctgttgcctttctgttcataagagtattttgaattcctgcctattctccttttttctctagaagtgaaggagccaacttccccaaagtccgtggaatgccttttactttgttaggaaaaaaatcactttttcttatgtgcattctcatctatccattcacagacgtcatcggagtgccttctgggggtcaggccacttccaggtaccagggattcagaacaaactagtcacgctccctatcttcaagggacttagaatcatccccagagaaggatgcgtgaacaacctcacgtgtgatggtgtggccactttggttgtactagagtggtgggatttggagttttttcttatttttatttatttattgtaaatttttttaaattaaaacaattttaatagagacagggtctcaatatattgcccaggttggtctcgaattcctggtctcaagcagcctccctctcagtctcccaaagtgctaggattacagatgtgagccactgtgccagaccatttttcttatgtgtaaattaaaaaagaatttgaacaggaatgaaagataaaaagaaaaaaaaaacacttccccaaacaaaaaaaaaaaactctttcacttataagaatggtcatcatctggctatttcagatggggaagtacgcatgcctcattttatccaagtttctcacagttcttaagtcttttttcacacacagttccatacacaaaaggtggctttgcaaaaaacttctttaacatagctggcaggctatactgtacatatatctatacacatgtatgcatgtatgtgcaatacatatacctttgcatatatatgtttatgcatacattttattttgctttatttagaatattatttttggagatagagtcttgccttgtcaccgaggctggcgtgcagtggcacgatttagctgtctgcaacccccacctcctgggttcaagccattctcctgcctcagcctcccagtagctgggattacgtgtgcgcaccaccatgcccagctaatttttgtatttttagcagaatggggtttcaccgtgttggccaggctgatctcaaactcctaacctcaggagatctgccacctcaactcagcctccttaagcgctggaattacaagcatgaaccaccatgcccagcctatttagaatttcatagggaattcttatgttattaaaactaagggttataagggcttccaatcgctgtcatatggctggtctcaaatgcatttaaacaccccctcccccattgatttttttttttacatggttttcttatgtttgaaaatttgtagtttctctattaaacattgggtcgctgattctactgcccaggagacccaggcaacacctcaaaagtccacaactctcttggcagatgtgactgttctatttcccagctcatttttct

SEQ ID NO: 5109 - DNA, 12324 bp, Homo sapiens
ccagcctatggccaccggacataaaaagtggggagtgagcaagaatgtagtgagaagaaaaaatcaccccattaaaatagcgtccttcatagaagccaaccagaaaaagctggaatggttcagcaacagaataaatggaggtattaataaatcaaaaaaaaaaaaaaaaaggaaatactgtgaatctacgctaatataaagtaattgaatcagaaataaacgggggaggggccagggctgtagctcacacctgtaatcccagcacttttgggagtccgaggtgggaggatcaccaagaagaggagtttgagaccagcctggtcaaagtggtgaaaccccatctctactaaaaattaaaaattagctgggcatggtggcatggacctgtaatcccagctccttgggaggctgagcgggagaatcgcctgaacacgggaggcagaggttgcagggagccgatatcgcaccattaactccagcctgggcgacaagagtgaaactttgtctcaacaaaaagaaaagaaaagaaagaatgggggagaagggatagctctttcttcagaagaattccaattactgactataaaaaggtaagggaaatacatagtcaccactagccaagcatcatggtaaacactgctgcaggcaaatccaacaatagaaagtcagcatgtgaaagtttaaggaaaacggggctgccagcatcattcaaaacatctcccttcaaataattatgaatttcaaaggaaaaattaataacattacatggaaaaactcagcagacatcaccttaaccaagtgatcaaggttaacattaccagggatggacagatcaacattatgttctacctgagataatatactaagaaagataccacatcattttataatgttcttgccaaaaaatgcttacactcagctaatgatgagaaaatactggacaatcaaggtctcaagatcagaaagaaggaaataagtaagcaactatcaaagactgaatgctcaagccaggtgcagtggctcatgtctgtaatcccagcactttgggaagccgaggtaagcgatttcttgagcccaggagctcaaaaccagcctgtgcaacatgatgaaaccctgccttgtaaaacaaatgcaaaaattagccaggcatggtggtgcatgcgtatagtcccaggtactcggagactgaggtgggaggatcgcttgagcctaggaggtggaggttgcagtaacccatgatgtaccactgtgctccagcctgggtgacagagtgagaccgtgtctcaaaaaaaaaagtataaaggcaccaaggagatacaacaattaaatataatgtggcatcctggactagatcctgaataaaaagatgacactgctttagtggtgaaatttgagtaacaagtatagttaaatattctatttctgcaacttttttttttttttttttttttttgagacagagtctcactctgtcgccagactggagtgcagtggcactccgcttggctcactgcagcctccagctcccagcttcagtgattctcatgtctcagcctcccaagtatctgggattacaggtgtgcgctgccatgcaggctaatttttgtatttttagtagagacaggatttcactatttgaccaggctggtcttaactcctggcctcaagggatcagcccgcttcggcctcccaaagtgctgggattacaggctgagccactggtgcccagcctacttctccaacttctatgtgagtctaaaattagttcaaataaaaattgacagaacaccagtgaaatggctgtcccttagagcaggtggatgtcctcaaatatctggtgtcaaaacgcccttgcttttagaaagtaatattgattgttgatgggggacagtgttagtttttgttgatttttgtcgttgtttttaatgtgtttttcttttgggggaaatctttttgacaagcttaaattggtatcctcctttttgttttgtttttaaaaagtttgttcctgaaatccaaaattctgagaactgctaagctcatttaaaattattttctaatgattaatagtgaaggcaaatttgcaagatgagtgttgttccctccacagaaaactaacaatctccaagtcacaaaattcattcctcatgtttttgctgtgtcaaagcaaaattaagtccatatcacctctcccaggaagtcttccctgttcatcccagatgggaatggcatcatgccttgttgtttctcacaccgaattatgagcttctcaacatcagggcttctcatgcacatcacgtttctcgtaaaaggttgtgtttttgtggcagttgatttccacaatgaaaatttatttttttaatgttacggtatctctgtagcttttgaaatatttagtatgttaaatgtattttttaaacttgctttaactcataagctataagatgctgaaaaactcatattctaactcattttaagctttttatctttcagctctaagatagattaaaaaagaaaaggtgtttcaacgatttcttagtaccaactatcgatcctttatatgttttctaaatgtgctccttacagcaatttggggctctcatgattagtgtgttaataagaattaagcacagcagaaaaaaacttaatttgtattgctacattactaattagcctgagagctttagaggtttttatgtaaaatgctaaaacttttgttcaaaacttatttaaaactgaaaagaatattggaacaaattgccaagcaaacccagccttctttgtgttatcaaaggagataccagctcacctagcaagtaatacaactcactaaaaatgacaaatacatgatatggtgaaggtataggaaggtacagacactcagacactgcgcagaaagagtatatacagggaagaagctttctcaagaattatctatttgcatttaaactcttatttagccccaggtaaaccagcaacgttgctcatgactgaaaaaatggaaaacagatctgtgcccagcaataagggattaatttactaagttatgaagctataatgtcaagtcatacaactgtactgccaaacagtatgtattgacatagaaacatggccactatatgtttggtaaaaaaaaaaaaaaaaaaaaaaagaccacagtgtgatttcaactttatgaaatatattgaattttaaaaagtcaggaaaagctacacaaaattcacagtaattgttcctgacacaagaacaatttttccctcatttgtatatattcaactcatttgtatattttccctcatttgtaataattcatgtacatacacacacacacacatatattatttattttttgacacggagtctgctctgttgctcaggctggagtgcagtagaactatctcggctcactgcatactccacttccaggttcaagcgattctcagtcctcagcttcctgagtagctgggattacaggcatgtgcaccacacccagataatttttgtatttttagtagagacagggtttcaccatgttggccagctggtctcaaactcctgacctcaagtgatctgcccacctcagcctcccaaagtgccggattacaggtgtaagccactgcacttggctataattattatatttacaacattgactttatactgtgcaatcaaggaaagtaattcattagcagagttctaatttaatcaaatagatacttttgtatgtaagtgtataacatacatgaatgaatttactgatgacagcactttttcttttttttttgtaaatacaagaggttatccttcgatatgagaattgttgattaatgtgtgtgagaagatacttgacaattagatttctctgtgttattaaacattttacctggtgcatgagcttttacaataacaaagaactagttccaagtgtatgcagaaagatgaaaaagttctcggcatatggttcattatgtgtgttctacccagccctaatgcacagctccacatctccggcacaggtccccagttgtatcagtgacaaagaggaataactggccttctcctactcaatgctccaccgcttaggcaagaaaacaggcacagaagtcagcctaactgagtttgaatcccagtctgctaccggttagctatttggatgctgggtgattaattcaccaaactcccagggatcggtgaaatgggaataattacacatacccagcaagagtgcagcaagctataaattaggtataaatatgtagcacccagcactgtgcctggcatgtggaagtgatcaataatcacagctatattgataataaccatcctaacaatgataatcctatctccaacaccacaaagctgtgttaacattaatgatatggaaatgtttagcatagaatagcccacaaatgtgtcccagaccacttttctctgattatgcccaattctatccctcaaaaatcaaggttatgataacatcacaagacagtgttgcaggaaggttacagattgaagggaccaagtggttgattcaatcaatcatcattgattgaatgaaccaaaatacaaacaccactggaaagagaagtggctatgcagggaaagcaagatggcacagtgcaggttcctttgcattctggagtgtgtttgtgtggtgctgaaaagataagtacctatgctattcccaaagtcaggtctcaacagaacctagcatgttcttgtgctagtggctcccatgttggcatgacaccaccatccagagaacccagctagcaactctatgactcccttcataaggagtactgtcaaacatcaggaactttactgcagtgactcaagattcaaactaggggccacgaaggctctgagaaaggaaggtctatgcctggtgtctcctgccagcacccctgcctgggccttctagaaatccatccctgtatcttgataaatggatgtagcaaatgccagtagtactgaggcaaaggtatacatggccataaaaaggtaggcatcattaggaattggccatttaatccttgattgggtgaagatctcatataacatattgtgtattgaacttttttttgtttgttttttgagatggagtctcactctgtctgccaggctggagtgaatggtgccatctcagctcacttcaacctccacctcccaggttccagaaattctcctgctcagcctcccgagtcgctgggattacaggctcatgccactatgcccggctaattttttcatttttagtagagacggggtttcaccatgctggccaggctggtcttcaactgctgacctgtgatccactcgccttggcctcccaaagtgcttggattacaggcgtgagccaccgtgccagccggaacttttgtttccatgtgatagtctttcaaagtgcacctctctatcccactgcctgcacctacctctccacattcagagcactggagatgaggtctagggtaggcgacttacacaaactagagatgtgtcatatctccttccttcctgcctggggactgagattttcccacggtccacaaatccacaggaaagttaagcattttagaagaaggctttgaatctttactactaaataggttgtgctcttattttaaacaagttgagttattttgaatatgtgagacataatcaaggtacacacacactagaaaaagaaatgtgatatatatgtatatgatacatatatttatatatgtgtatatgattcacacaaatatacatatatgcatttttatttatttattttagacagagtctcgctctgttgcccaagctggagtgcagtggcatgaccttggctcactgtccacctcccgggttcaagcgattcttcttttttttttttttttttttttaggaaaaaaaatcttggtggtcatatttattggaagagcttgagaaaaacgaaaataccatttagcttagaagttgtgaattatctgcaaatcaactcatttcaggagtggaagaatccccagaatttttcttaatatccaaatgtatgcgggtttctcttttgaatatcttgcacctttagagagccactgtacaaagtctcctgttttccatacaggacaaattctttgtttcagccaactctagtggaggggcaaccaggaaaatgccatctccccggagaaagaacactggaatattctgtttgttgattcatatgtctcttcatatgtttcctcatcaatttctatagtagtcacagttcttccacgtctcccaagatcatatttaaatgttgatcataagtatgtaatctgcctcgagctctcggtcgtttctcattttcacacaaattcgctcctctgggctgagcctaagatcagggggtcctccacagtgttggtagtttgctgctggtctatgtcgtctgccatgtttcacaagtaattcttcggtctcagcctcccgagtagctgggactacaggtgcccgccaccacccaggctaattttttgtacttttagtagagacacggtttcaccgtgttagccaggatggctcgatctcctgacctcgtgattcgcccgcctcagcctcccaaagtgctgggattacagcgtgagccactgcgcccagcaccatacatgcatttttatctatacacatacatatacgttatgtatacatacttttttttatatacagacacacacacacaggagcaatgacttcagaaaaaaaaggggtttcctaatagttactatagagtgactggcagacaggaacctcattatctatcctctctacttttcttttcttttgagacagagtctccctctgtgacccaggctgggtgcagtggctccatctcagctcactgcaacctccacctcccaggttcaagcagttcgctgcctcagcctcccaagtagctgtgactacagacatgcaccaccactcccggctaattttgcatttttaggatagacagagcttcaccatgttgcccagtagtcttgaattcctgacccaggtggtctcctcaccttggcctccaaaagtgttgggattataggcatgcaccaccaccctggctgtcatctctatttttgatgatatatgaaaatttaatcaaaaatatcaagaaggttaaagacaggccatctagaaaaacccaaaaacatgaaaaatagaaaacaaaatttaaagaatgagagaacataatgacaaacaattaaaacagtttacctagtttaagaatattctacattgaaccaaaaaacaaaatccaactatttatcaggcaaaatataataaggaattcaaaagcttaagaataaaatgtgataaaaagcctttaaaagtggcttgctggatattcctagcatatgaaaaataagggtctcttctaaactagaaatgttttccagttgtaattgccagttatacaagttttcaatacatcatcaaaaaccagcatcaaaattaaactgcagtaatgacggattaacgggcttcattggcattaattaaataaagtgcctgagtccctctggaaagtatttgacaatatgtgcaaagtctatgggtttcagtcacatacctacacacctgaccaaaaaaaaaaaaagttaagcacatcagcagacactgtcttctccctatgccaagcaaaaagaattaatccctttatttctggcaggggtgggggggtgctggggtgggcaccagcaaacgttccaaacagatgtttacaaacagaaggtaactgataaaaaccaaaacacaaagctgcatgtctttcctgattcacagatgaacccactggaactactgcaaacagcctttctggaaaaatccagcaattaaaaggtgcaaacaagctgcctaatacccttgcgtagactgaattctttgaagaaaataaagtttattgtctggaaagagagaaagcatgaggaaagcactaaagcgtggaggtgaacaattagacagatgttcagttaaggaaataaagagaacagaagaagccacacccaggaattttacgagaatcctgacaactcggcaccacatcaagggcaagggtaaacgaacgccacccaagcccaggctgtgcaacttgacgctaactgctgaccttgcagatccgcctgcaggtgatgtggctctgagcaaaggcaggtgagcctgctcacttcaataagttctaagttcttctccaaggtgagccacagactgcagttcttcaggacagagttacatctctatcttcataatattactgcaggtaatggcaaagataatactaattatccccaagtctttcatattggtaaattccttggtgaataccaagaatatagctaaggattatttcagaaagttttggcttgctaatcctgtcccaactggctagaggagaagggacagaaaggtgctacgtttgaacatcttacagtggcactgctgctggatgatttctattaatcgatagatttggtgactgtctttctcttggcttacacccctggaaggctcacaggtaactcttcagcccagcttggcaactgttcatagcttctggccaatatttctgcacagtgctttacctctcgatttattgattttcccttaatcccaatagcctcatctgtgtctttttctcttgaggtattataccgggcccctacataaacaatctcaaatcctctttgcaaagcagcaatgaagagttgctagataggtgttatgatgaaaaggcagaaaaaggaatgcatagttagctggctggctggacacaaatagaaagatcaaaggaaaacagacagtattttatttattcctcatacaaaaatcgagttacaaactgccattattttacaaaagaagaaagacaaataaattacccattccagtaatttctaagactgcttttcaagtaagtgagagaaatatttttaaaaaatcattaaagataaaataaactataagctagtgctatgattgatcttttctctatactcctaaccagttctttgtacagccaatattcaatcaaccgccaatccagaaagatctatctaactctgctaacactccaaggacataaaataaagactcatgcattctttaagaagcatatacattatagtactgctgtatgtggaatgccctctaccccaagatgttcatgaactaatccctgatatcataaatatgttacatagcaaatggtaattaaggttgtagatggcattaagattgctaatggctgaccttcaaataggcagattatcccagattatcagggtagactccctgaagttacaggttccttaaaagcagaagcagaagagagagaaccaggaacagggcagtttgagaaggcttgagcagccatccctggctttgaagatagaggaaggggccatgagccaaaggatttggcagtccctggaagctggaaacagcaaggaagtgggttctcttctagaacctacagaaaaaatggtgtcctgctgacacatcgattttagcccactgagacctattttggaccactgactccaaaactgtaaagtgtaacttttgtgtggttctaagtcactaacattgagaaaattattacagcagagataggaaacaaaatacagttatgtaacatgtttaatttgtgagatttacattgcacatccaaacttctggctcctgtgaaaaatgaagacagagaagccaaggtctgcctgcatatgctcacattttcacaatcgcgtaggccgaggtgcagctgttccttgagaggggcactgaccctcttgtgcgccaccatctccaccactctctactgtctcgctgactcaaagctctggatcatcaactgctcccaccaaacatttgagtgtttgactcttgatctagtttgaagaaaaacaaacatactgctgggcgtggtggctcatgcctataatcccagcacttgggaggctgaggggcgcatatcacctaaggtcacgagtttgagaccagcctggccaactggtgaaactacgtctcgagtaaaaatataaaaattagctgggcctggtgatgcacgtcgtaatcccagagactcgggaggctgggagaggagaatcgcttgaacctgggaggcagggttgcagtgagccaacatcgtgccactgcattccagcctgggcaagagaccgagactctgctcaaaaactaacaaaaaacacatgcatagccaagcagggctgatattcaggagctatggcaatatagagccagcatctgctccgcttagtcaggatccatgccatccgtgaatgttaatatttagagtagaaacagaggcagcctgcttcctgaacattcctgcctgcacaggggcgaccacccctctgccccacctaaagcatatatgatatcccccctcaccccatccctggggccaggcaaggtttcatggccacagttctggctaaaccaatgcagtcgggcatcccagtttctacctgacacaactgctggacaatcagtacttttttctgcagaattattattctgaactcttgtagcacaaaaaagtaaagggatttaaaggaaaagtgatatggactataatttgcctctctatattgtaatcggggagcagtgtttgttggggatgtgaatctttcctctgaccagaaggatctctgtaagctcttggtatgtgcctaaaagcacacactgcactgtaagaaatgaggtgggcatgattacaggtgtgacctgataaccgctgaaaaaaatcatccatccataatcatatgaagagatgttcaatatcctaagccatcaagaaaatccaaatcaaaatccaatgcaataccgcttcatacccaataaaatgacaagactaaaaagaaaaatgacagcggtgctggtgaagatatggagaaatcggaaccttcctacactgctggttagaatgtagatggtgtggctgctgtggagaacaatctggtggctcctcaaaaggttaaacaaggagttcccgtgatccagaaattgcactcttaggagcataccccaaaaaaggaaaacctatatccaccaaaaatgtgtagacaagtgtacctggaagcattatgcacaatagccaaaatgtggaaaaacccacatgtccgtgaactgaatgcatagatgaaatgtggcatatccgtaaatggaatttactcagccctaaaaaaagaagtactgatacatgctacaacatgaatgacccttgaaacatgatgctaagtgtaaggatcgagacacaaagggccacacagtatctgatttatttattgaaaagtctagaataggcaaatctatatagagacagaaagtagatgagtggttacctgagctgggagagaggttgggagtggagagaaaaggaagtggggaaaaggatgccagtcaaggtttctttttgggaaaatgaaaatattctaaacttgactgtggtgacagctgcaaaacctctgaatatactgaaagcactgaattgtacattttgaatgggcaaagtttatgtatcttgttatatatcaataaagtagcttgagaaaatttacaaacttcagctcgctaagaattttagtaataaatcatttgaaacatacctcacaactgatggagacatatcaggcaactattggactctgatgagattgtggattgagaaaagtatggtaaacccatatgacagaatattgctagctgttggagatcacggtaagaaacttaagtgacatggtcaaatgtttgccatttacattaagttcaataaaaagcaggctactagagaataatacacagtacgatgttatttggttaagagtgtacaaatgcaggcatatgtatggtatgggcattagctaattcatagaagaaaaacacttccataacacaaaccgaaatgttaacagggattatttctggggaatgagacgagtcaaaagctgagcccagaaatacaaaatcaatatagcttaaagttgagtcattgtttccaatcactgggcttgctaaaattatttctacactgaatttgtcaccgcaaggcattgtgtttcatccatgacacctgcactccaagcataatttcaatcactgaaacaattgcaaattcacttggctgatgaaacgtctgggaaggatgaaggattgtcggaagggtgcaccattgggctcataccaatccatggataaatgggaaaaggtatggcaaggctgtgaaggtggccgcagcaccaggcaagacagtcagggccatgtaatctcacatcagctgactag

SEQ ID NO: 5110 - DNA, 12561 bp, Homo sapiens
ttctctacaaaaaaaaaatgcaaaaattagctgggtgtggtggtgagaccctgtctcttaaaaaaaaaaaaaaaaaaagagggactggcgcggtggctcacgcctgtaatcccagcacttagggggccgagacaggcggatcacgaggtcaggagatgagaccatcctggctaacacatgaaaccacgatgaaaccccgtctctactaaaaatacaaaacaattagccgggtgtggggcgggcacctgtagtcccagctactcaggaggcggaggcaggagaatagcatgaacccggaggcggagcttacagtgagctgagatctcgccactgcactccagcctgggcgacagacaagactccgtctcaaaaaaaaaaaaaaaaaaaaaaagaattttaataatatattttattaacccaatatatctacatatttcaacatgtaatcagtattttaaaattattaatgataattttacactcatactctttcaaacctagtgtgtaatttgcacttccatcacatctccactggatgctacattttcatgagaaatactcgatctgcatttacatcttgtaaaacttacgttgaaaaagtagactcacacccaaattgtcccaaatatgcttaaaagcttccaattattgttatattgacaagtacagttaagcaaaaggctgagtttaatcaggggtcgcacttgattaatctcagcttaaaaacagattcctcctcgggcgggggttgccccacccttggtctggttagaccacgttaaacagtgcacgcgcctctccccgcccatcgggtgatctggctttcactaacagaaacgtctggagcagtcgcaagagaatcctgtctcggaccagcctgcatcttacctaatctagtggttgcgtgattagccacccagattccctccaggactgcaggccgactccccacgcgctgctgtggacagcagacagtccgcagctgccgtcctctttgggagttcctcagctgaagagcatcatcttgacctcgggtcctgcctcctttctgggcagctgcatcagtgattggtcagtagggttttttaaaggtccagtcttttcacccaaacttgggacgagttgaggctctatcttcctctgcccaacattgctctttccctacccctacgagtcttcgttccaaaggtattgctcctggggtaccagtaaacttctgtgtggtcatctttatctcaggtctacttcctgtggggagctccagctatgatcgtgtgtgccgggagtgagctgcaaaagcggatgctgaggtgggattctggagctggactgctgactaccaggctggcagtgaggactcttcatggttggtagaggaagcgcagataggtcgggcacacggtagcaatgaggttggaaagcttccactgctgatgaaatgcaatggtattctggggaacactatccactagtggtgccctgtgtcaggagtttgaggtatgaggggagagaatacctatagaacgtagggccagagcagcggctcgcgcctgcaatcccagcactttgggaggctgaggtaagagaattgctgagcctaagagttcaagaccagcttgggcaacatagcaagacccacgtccccataaaaataaaaattagccaggtgtggtggtgtagtccctgctacttgggaggctgaggcagaaggtctcttgagcctgggaggtcgaggttgcagtgagctgtgatgatgccgctgcacttcagctgggtgacagagcaagaccctgtctcacaaacccaaaaaccacagttaaactaggtggtgctgctaaacacaaagactttgggaaatgacaaaagctgagaatgattaacaggcaataacagctaagggtgaaagccaccttaggaacacataaagaggtttttatctcttgcagcgcaaggtagagaaagctgaggactagacccaggatttagttgtaagatcagccaagctccaagaaggttaaatgctccacctagacaggctgctgtgccagatgcagggctctgatgctgagatgcagacatctgggttgatgtactcccaaaacctcaaatccccagagcccgtaacccggagtgcacagaagtggccccactcttcccaccggggcgagagtaccttcctcacagagacggaggcttccctcctgcaggacattaaccccagcatctctctcctttccagtccggccatgatggcaccaggcctggtaagagaggaaaaggaccttgtaccaagggagctgcgaatggagccaaaaagcgcttgcagggacggggcacacgtgatgagaactgggtgctgaagagctggaccaaggggaaagcccatgaagctggagaaaggtgggggtatcagttcgggggactctcctaggatacaggacttaatgccttgctcaggaccctaggggatgggccacctgctgccggatggctcctagaagcaggcagaaggcagagcacactaagcaaaggagagggctggcgctgctataagatggtggaaagaggcgttaaaaggctcagaggtgggcagttggtggacaagccctgtgaggcagaacgcccatgggaaggcccggaagattcattcgtctagaaagcaggaatgtgaccatgctggtgagagggcaggcacagctaagctcatggggtgccccctctagaagtcagggagaaggtgggagatgctgctatggaacaggctgctgggcaggagggtgctgggagcctgagatcataagaccaggcaatgccgacagctgggggcctgcctgtggccctatggagatgcctaagagttggtcacacaggcaaaaccaatggcattgctcaactgtgcaagcagagtcatgatgggtgacgggggctgggtggcctccatgaaaccatcggctttctgtggcaccggaagtttgtctcgggctgcttttcccttgacctgaggctggtctgcccctgtgtgctcccacagggcacctgagcttcctctgttggaaactaattactccagttggactcacctgttcacccgacagtcttcaagctcgatggtgggcttcgaggcagggctgtttctcagtgtctcgtgaagcaataagcttaatcgcccacagggcttctccgagtcgagcacctggggaaccttgttagcaatgcagattcccaggctccacgccagcgtacagttcagaaatggcatggacagggcccggcctttagtgtattataccttccaggtgattctatgcatgctcaagtgtaagaatctgatacacaggagttcagcagctgctgggagaatgatccccggggtagagggatgggaaggatatattaaaaaagagaggaggttaagagaaacgcacctcatttttgaccagtagtggggaagtattagctcagggaaggcagcacagctgtgagctgtgtcacatctgaagactgctccctggtaggagtcggaatgctgccatggaacatccagaaggtaggaaatacagtatccgttaaagaccttaggttttaggatctgcaactctggtccaaatcctttctctgccatggacctgtccccattctatccattcctgcttcgcagcccaccgaggtctgggctgtctttaccttgggcaaatctttcatttttttttccagagaagcgtcttgctctgttacccaggctggagtacagtggtgctatcatagctcactgcagctcaaactcctgggctcaagcaatcctcccatctcagcctcctgagtagttggaactccggcacacaccaccatgcctagctagtttttctgttaaactttttctgaagagatggggtcggcgatgttgcccaggctggactagaactcctggccccaagtaatcctggtgccccagctccaaaattgctgggattataggtatgacccactgtgcccagtccacctgtgtctttattttaaaatgactcttgtactacatataatttggctttgcctttgaatctttatccctttacaatttctgcgttttattatggttgttttaggtctaccattttactcttcactttgtttcccactccctcccctattttggctcctcttctttcttgccctcttttgtgttaaaaatcttttttttgagagaagtcttgctctgtcacccaggctggagtgtagtggcatgatcttgctcactgcaacctccgcctcctaggttcaagcaattctcctgcctcagccttctgagtgctgaaatgacaggcacccaccaccactcccagctaatttttgtatttttagtagagatgggtttcatgttggccaggctggtcttgaactcctgacctcaagtgatctgcctgcctgctcggcctcccgaagtgctgggattgcaggtgtgagccactgcactgggcctaaaaatgttgatttcagttttaatttatctactagtgttttggatatactgttgctttttttcttcgtggttgctctaatacagccttaacttctcgtattcttagtattgtagcacatcacgcacttgaaaattctttaacctctctgaacttcagttacttcatttataagacgagaatggtactttctctcatgggttatctgactgccgaatgagagaactcaagccgcgtacacggccagggcagaaaagcaatgcctgttgactgtcatggctgatcctagtcccgtcactactgtagaatgtggttccagtcatcagcactgggcctcctgagaccacacggagccaccactgacatccccagcggctgacccactgcagggggtcatttgtctacctgctgtgatcacccatctgctaaatggctgcccctcagagacactggtgtctcaccagggcacccctcagctgcctttccttgcccaggcctggccatcctgtgccccttctgcaggctgctcctgggccggtaacccaaaccacctgacgcagccaggccccacacgccatggcctgctcccagtcacagaaaagtctggcttgatttttaccactgcagtcctccctgtgcccttcagatgcctggactcgcctgtccaaacctccatctgctgcccattcttctcactcgcagtgatggctttagcaactgcagggacacaggcctccagggacactgtcttctcacactcagcatcagccccacaggtggaagtgccagccctcccgggggcggcctgtgcaaccactccaagtgggttttggggatgtgattctgggcctttcttttctttgtgtgtgtgtgtggtgttggttttttttttttttaaagacagagtctcacgttgtctcccaggctggtgtggagtggtaggaacatggttccgacctcctgggctcaagcaatcctcccaccgcagattcctgaatagctggaggccaagaggtgagtcccaacttcagacttagaaataaagacataacccaatacgcagttcagttagaaaaatatccatggaaatggaaaaagatctctaaaatatcaggataaaaatgggctgttggccaaatacagtgagcatggactcagagttgaacaggaagaagtctcaactggaaatcacctcatgagctgggttttgttcttggcattgctgctttcggctggctgcctcaccagaggataaaaaccactgcctcctaggcttgtgtgaggattaaatgaagtacagttacatctgagatacgcccagactgcaagaatttgtctttaagaggagcttcacttaaaagcactgggtttatgaggattacaaggcacttcaaaagagcgctgatcttccgtcgcagggtttcacatggcctggggccctaaggagcacttgaagcgtgctgcagtgccgaagcattggatgccgacaaactaaagggtatatttgcacctcgtccatcgacaggtccccacaagctgagggatgtcttccgctgatcgtcttcctcaggaatagactcaagtatgcattgaccggagatgcgtaaaggagatatgtatgcaatgcttcattaaaattgatggcaaggttcgagtggctacacataccctgctggattcacggatgtcatcggcatcaagacaggtgagcatttctgccggtctgtgacccaagggctgtgttgctgttgatcgcgttacagtcgaagaggcaaagtaaacctgtgcaaagtgaggaaggtgactatggggatgaagggaatccaacgcctggtgaccatgatactggaactatccactacccagatcctgtcatcaaggtgaacaatactgtgcaattgatttagggactggcaagataatcaactttatcaaattccacacaggcaatgcgtgatggtgattggcggagccagcctccgtcatgttggtgtgaccaacagggaaggacatccggttctttaaatgtggggcatgtgagggatgccaatggcaacagctttgccctgaggcttccaacatttttgtcactggcaatggcagtaaaccttggatttccctgcccagggaaaaggcacccgacttactattgctgaaaagagagagaagaggctggccaccaaacagcagtgctaaattgcagtagcagcgtatctctctctttttttttttttcctctcaaatagtgaatcttgtttctaaaaaaaaaaaaaaagttctgatttgaggctaggcgtggcggctcactccgtaaacccagcactttgggacacagaggtgggtggatcacttgagggtcaggaattagaaccagtctggccaacatggtgaaacctcgtctctactaaaaatagccaggtgcagtggtcgctcttgcaatcccagctactttgggggctgaggcaggagaatcttttgaacctgggaggggaggttgcagtgagctgagatcacgccactgcactccagcctgggcgacagagcgaactccatctccaaaaaaaaaaaagatgtgatctggatttttagagccttgggaacatgcgctaatgagagtaacccctgtggtcaccttcctagttgtagagtggggtgtgcgaactttcagcatttgtaacttgctaccttgtagggacaaccctggcactccttccattgtttccttgacttttctgcctctactactttacctttttgtataaaggcttctcttatgtgaaggtggatgtcaaatatgctttctttgatagtatagtctcaagggtacaatgcagctctgaagagctggagaagtgtagtgatatagttcgatgttcgtctctgtccaagtctcatgctgaatgccatccccaatgtcggagttgggggctggtgggaggtgtttgggtcatgagggaggcacctcatggcatggtgctgtcctcaagatacttcttgggagagctggttatttgaaaggtgtggcaccccctccccctgctcctaattttgtcatgtgatgtgcctgctcccccttcccttccgccataattgctagtttcccgaggcctcccgagaagctgagcaggtgtctgcaaaccatgagccgattaaatctcttttctcggccaggtgtggtggctctagcctgtattccagcagtttgggaggtcgaggcaggtggaccacctgacgtcaggaattcgagaccagccggccaacatggtgaaaccccttctctactaaaaatacaaaaattagctgggcatggtgggggtgcctgtaatcccagctactgaggaggctgaggcaggagaatcgctggaacccgggggtggagtttgcagtgagccaaaatcatgccactgcactccagcctgggtgacagagcagactccatcttaaaaaaaaaaacaaccaaaaaaaaaaaaaaactattttctttataaatacccaacctcaggtatttataacaatgcacaaacagcttaatgtatgcagacagccatttatagggtaattaagagaccttgcttgtgttgtgctgtgttagctgaggtcaattatcttgcccattttaatgggtttatggtgttttaggataaatgagtgtatttagggactaagggtgcatacagatttttccaccggaattaatggcaattatattctccacttaggagaattatcctaggaggggtttttaggtacaaattacccctttaaagcaggagaatgtaggtgaaaatacatcagaccgcacaacacaaagttttcttaaatgtttttatgttttgcttgttttgagacggggttctcactctgttacccaggctggagtgcagtggcgcagtctctgcctccgggctcaagtgatcgtcccacctcagcctcttgagtagctgtgactacaggcatgtgccccacatctggttaatttttatatattttgtaaagacgggggagtctcactatgttgctcggctggtcttgagctcctgggctccagcaatccacctgccttggtctcccaaagagccggattaccggtgtcagccaccatgccatcattaaatatttaataactggagatatatctaaaataatgtaaatgtatacaaatatacatactgtcttgggtgtgactggctggggccggatcacaagcaataaaggaattcaagatagttgcaggaatagaaaggcagatttattagaggagagtatgggctgggcacggtggctcataactgtaatcccagcacttcagaaggctgggcaggcagatcgcttgagctcaggagttcgagactagcctgggcaacatggcaaaaatctcctctaccaaaaattaaaaaattagccaggagtggtgcctcgtgcctgcagtcccagtacttgggaagctaaggtggggatcatttgaacctgggaggcagaggttgcagtgaggcaggtcgtgccactgcactccagcctggatgacagaaccagaccctttctcaaaagtaggagatacgttgcaagagtacaatgggcagcacagcagagatggggctgcttgcaaagaggaggggcttgagggacgtcttacaggctcatgccggagggggctgtgtgcggagcaaatggatgttgtgtccacaggttgtatgattagccttctcttggaacagttgctctccctcactgggaccccttccctgttgctgctggcacagcttatcaggactccacattccccctctactgaacaatgcccaagctctggcactggggtggcagtttcattttgcagctatttcctgtggcctggggcatagagttgaccctacctatgcctgttggtctgtcaggagaccctgtggtcactgtcccgggttgtgaggcctgggatgttggctcttggtggacaagggacttgttgaggaggggagcctatcaaggtgaaactgatgtccagctgcattcaggggagactagtaaggtagccagcatcctcggggataccgatattccatcctcagcatcatttgaaggtgaactgttgaattcgtcccagtgctgtttgggatcacctggcttaagatgtccagagcagggggctggctgtcttcacaggagaatttagcgtgagaaagagggggtccaggttccccaaatgtgtgtaggtttgccctggttgagcttctgctgccaatggcactacacgtagggtttgaacttttggccagaaaggataggaggggccttcctcccttcccagcaaggtagccaaactgtttactccttggcctccaggctacacaaaggagtggccctagccagtggcatgaatttcagagggatactagagtgtttccccgggaagacagaaaaggaaagctgtaaactgaaaggtgctgtaaacttttactgaatcaggcagcggtggtcggtggtcgggtggtcaggcattctccaccgggaccttctggtccactagggagtagacctggctggggaccttcagttgttccaggcttgggcgctgtccactgagaggctggagttggagaagaaagggagagaggagggaggactccctaagcagtccgcgagcacttcccatatgggccatcaaaatgtcacgggacaactggctacggctggtgtggcaggcggtaaaggaatttactaagacagtccatggggataaaaggcagacttattagagggaaagcacgaagatatgttgcaaaggtacaatgtgagcacagcagaggggctgtctgcaaacagacaggggctagagggaagtcttgggttgtgaggaacgacatgctgctgggctacgtggggagtgaggtattggggaacatgccagcaggtatctgtgatgagccatgtcttggaataattgttctcccccaaaggagaccccttcctcttgcttactttccatatacatgtgtggagtctttatctgaaaactgggctaatacggtaaatattttatactgatttatcttctaaatatttattagaaaatatatcaatgtagaagcaccattatagctctactctatttaaaaccataccagcttggtagtaaaggtccttatccagaggtaaacgctgttacagcttgctctaagtccttctaaagctaccttgcaaaaattagagtgagaaaatcgtgacaatgaaagggatctaacctaacgaactccatcttgctcctacctccaagctgcccttggtcattcctggacatgggctgaactagctttgggaggagttttttattttttatttttatttatttattttgagatggagtcttgctctgtcacccaggctgagtgcagtgacgtgatctcagctcactgctagctccgcctcctgggttcacgccattccctgcctcagcctcccaagtagctgggactacaggtgctcgccaccacacccggctaattttttgtatttttagtagagatggggtttcaccgtgttagccaggatggtctcaatctctgacctcatgatctgccccctttggcctcccaaagtactgggattacaggtgtgagccacgtacccggcctggaatttatagtttaactttggaacaaagacaacagcccttttgcaaacaaacccccttcttgcctggggactagacagcctttgtaagattaacaaattagccataggttagaaattgtggtttaggagtcttgtagccagaggccacaagattgcaaatctcccataacatcactattgtaaaatctaagattggtgctcacatatctttcagaccctgcatctgatgtaccagctagtgccacccagaatggtaatctggtcatgtcattcaataagttcgtgatcccaccaaggaacagaagatggcaagaacccactttgacctcttctttatttatttttgagatggagtttcacttttattgcccgggctggagtttcactcttattgcccaggtggagttcagtggcatgatcctggctcactgttccctccacctcctgggttcaggcgatctcgtgcctcagcctcctgagtagctgggattaaggtgcaagccaccacacccgggtaattttgtgtttttgtagagatagggttttaccatgttgaccaggctggtgtcaaactcctacctcaggtgatccacccgccttggcctcccaaagtgctgggattacaggcgtgagccacgcccccggctgaccccttatttcatctctagacccaaccaatcagcacaccccactcctgaccccctacccaccaaattatccttaaaaaacccgagtctccgaattttcagggagatgatttgagtaataaaactccggtcttggtcagccagttctgcatgaattaaactcttttctattacaattgccctgtcttgataaattggctctatctgggcagtgggcaaggagaaatgtcaggcagttatacttcctggtttttgtctaagtttataacatacttccatatgtaatacatattctataaaaaatgctatacataatatcttgtaacattctttcattcaaaatagaaaattagaattttgtatagaacagactgtataatgaacacccatacactcttcatcagattagccaattgtatgttgtcacatcttccttcctccatctcatttctccccctccggtgtatgtgtatttatgtgtatgtgtcccttgataatccatgaggaactggttccaggactcctgcagataccaaaatccaaaagctaaagtccctgatataaaatggtatagtattttgatctatgcacaccctctagtataccttaaatcatccctactgcttacaatacctaatcaatttaaatgctctatagtcattatatttagggaataatgacaaaaggtctatgtgtgtcaatacacatgcaaccatccatttttttctttgttccctgaatattcaacccaaggttgctgaatcctcagatgcagaatccatggatacagaaagccaactgtctgtgtg

SEQ ID NO: 5111 - DNA, 12514 bp, Homo sapiens
actgttgcagatacctaggtggtgagttagtggatccaggcaaaagtgacaagagcaaccaggtagttatcaccaaaagtgaggaaagaggaagggtatttgagaaaattacgacgagtcaccaatatgcgaacctgccaaggatgttttcctcccctgtgtctcctaagagactgtctctagcttggcttgacatgcagtgctacagatagatgctcagcaaaagcttctggaggcatagttataatcattattttcactagtatttactgagtacttattgaataccagggatatgctttgtgctttacataaattatttcttcttctcaatggaaatagtattatgatcacctttcacagatgaaaaaactcaagaaaagaaagactgagtgacccacctaaggacttgccccaatcatcatgcagcctgcctcctggtgtgcaggtcactgatgctggctttgtgcaccgggcatgggcaccggggtctcccacgtagggtaccagtgtatactcaaagccacaggaaaactcactgcatctccctagagcacccattttattcactgctaagcatcttaagacatatttttacatttacatgaacacagatattttgagtgaaatgtaaacttccataggagctttaggatacatcttggaggctggtcaggggctacttcaggggatatcaatcctccaggacctaaagatattctttgctgaaagcactagctaagacacagcttataaagggggaaatggggctggagggaaaacatgacctcgaaagtcacagagatggtgctcagacagccagggtttcagcccccaaattctgagtggttctcagctctgcaagcccctccaccagccaggctggatagctgcaagctctggagggctaggaacgcagtcccttcttctcttacagaattcaccccaaaacatcacattctgccctccccttccactagcactgtgattactgctgcatcatagtgccctttaaaagaacatggtttccaaatcctcctaaacatgtttgcaatgattgcttggcccttttgataaataaatgaagaagacgcacctgacctgatggctatagagggtaagatggggctgtaggagaaagaaaaggacactctgcaaacgacagaaatagtcatttacatggcaaggagggagggaacgctctgactcccagggggccctgagctgctcagatgttcctccaatacaagctgatgccgtcctgcttggccaaatcgacctgaacagcccagaaagctcacggccgtacctgtcagccccaatcggtgctgcagaaattttgttaggaaaatagaggactgagattcaatttttcgattgtctgaaggcttaatttagtgaccttggaaaatatctctagaggtgaaagaagatgctgggaatctgctgggaggaaggaggcttccctggtaatggtaatttgtttactctaattttgaggcctcttcaggcagccaagaaaatagtcagatagtactaccacttcttagaaaaagtgggggaggggagagccatagaaaccagtgagagaaaccccagccatacggcactactttctcaagagcaggtaggcattatgataatatgtacattatgttttatgtgtatatatatataaatatgcttattatgaaaattttaaacatacacaagggaggacaataaccccatataaatatcattcagatgcaaatattactagaatgttaaactgcttctttccttcatcctgtccctccttttctttcttctttcattgcggcagctctgctgctgctgttgcagaagtattttgtttattttttttcatgtaaattttttatagagagagggtctccctatgttactatgttacccaggctggtcttgaactcctgacctctagtgtcctaccacttcagactcccaaagcactgggcttacaggtgtgagccactgtgtctggcccaaagtattttaaagcaagccccagacctcacatcatttttcctctgctgaatgtatagtcagatggtatttagaagaggcggggttgctctggtgctcaacagcttttctcattaaaaaactactcaaagaaaaatgctagcaggagggaggagctctggaattaggagttccaatttggctacaatctgcaattcctgtaggatcttgggatactctgaacctctgggtctcatttccttaggttggggaggataatgactcctagacctgttaggggaactgaatgagacagactttctaaaatccttggcacagaacctagtacaggctaagggaaaggtgtgatgattactatatgtgccttggacacaggatgacaacaccaaaaataaaaagaaggcaaaaaaaaattgtaggtgtcaacttgactgggccacacagtgcccagatatctgactaaccattattctgagtgtgtgtctgtgagggtgattctacatgagactaacctttgaatcagtagactggtaaaactgattgccctgccctgtaggggtggatctcatctaatctgttgaaggcccgataaaacaaaagtctgagtaagaaataattttctctctttgcctgactgtcttcaacctggatgcttgtcttctgcctttggatgaggtttctaccatgggcccttctggatctccagatgctggctacacttcttgggacttctgggcttccataattgtgtgagccaattcgccagtcctaaaaatctctatctgtccatctgtctagctatctgtctgcctatctgtctctctcctctccatccatccatccatccatccatccatccatccatcttccagatggaccctgactatgatggttctgcttatgatgtttagaatttatgatggggtggaatggcaaggagaagagtccaagggtttaaatcctagctttgccattcatggctgtgtcgctttggcaagtcccttaacctctataagttttgattaccttatctctaaaagggggaaaactacatctacatttaggattacatacaagaatgcaatgcagaaaatgctgctcaaaagacagtggcctgagatctccattacatagtttccaatccagctgaggctaaatggcaattgcaatagagaaatataattgtgcccactttatagggttggaggactagagacgatattgctaactacgattaaacagttccctgcacataattggcacacacataattaataaaggtcagagtgtgaagtttgtaaataatgatagattatatcacgtttattattaggacatgtgtccaatagaatttggatatagtaggaccttaataaatgatatagttataaattaaattattattatatataatttatactaatgataatttaaaaatgcccagtgcagtgctgaactttagatggtagacacccataggcagatggcagggaacagtaacactgatggtgacgatggtggtagaatcctgtaacggtcatattgcctaaatgttggtcctaaccgtatccgttcttctcactcacctccagccaacctcctattctgcatcccccagtttttgcctggcccctggtttaacacccaggtcatcgaaggctcttctctctggaggctgtgcttttattgtcattgtctttgccactgtgaagggagcagaagccaggtcttgaagtcctcagcccccaactcctgtggggcgtacagatagattagctggcctctctcattcctactgtcacttgctgcctcctgtaatgttggcagggtgtcattaaggcctcacagcctgaggagctaatagacacaccagggctcccagttgccatgcctgcagcaatgtgcacctcttgacacccagcagctaatttcccttcataacctgaaatttcaacagcaactctgtccccagtcatgtcaaccagcttagcccccttactctgaccctaatgaggaggtgcagtgcctggttcccatcctgaaataacaacactggctgctggcatatgttttgttgttgttgtttttctctgaaatggtgtcttgcttgccgcccaggctaggtgcagtggcgccatctcggctcactgcaaccgctgcctcccaggttcaagtgattctctgccttagcctcccaagtagctgggataacagacatgcaccaccatgcctggctaattttttttttttttatttttagtagagatgcggtttcaccatgttggccaggctggtctcgagtcctgacctcaggtgacccacccaccttggcctcccaaagtgctgggattacaggcatagctaccacacccagcccctttttctcttagacctcactcttccagctcctttcagtccggggtctccctgccagaaaatggggctggaaatgtgttaaggagaaacttgcagaacagaaacagccttcgagactacacacctgaccctggagccacagagactccagctccacttctctgtgagttgatgacaccgagccttaccttcctcatctgtaaaatggtcaagatcatctgcttcccccacacatggtgctttgatgtcatctgcgtgaagctcttatcacagagcccgcacttggacagtgagcaattaacatctgctctcactgtcttagaggatcagccattcagttttcatgcatttaccctttcacttgatgcctatgtactttgcagttgggggaacagcaaatttgatttagcccccacagaaaggcagcctggagttctggagaggagagcaggttttgaccagagaaaccagggatcaaagctctctggttcccttgcaccatctttaacatgtggggcaggaaagcgacacggggaggaaataatctaaacccggctggttagtcctcaagagcaaagaagaaacatattcaaaaaatgtaatagcttggtgtccggcatgtagtgtgtgataatgaataccacttccacttacagagaaagggagatggaggcagaggacagctaaggaatccagaattgtcacacagctggtgagaggggtggctgtgactgtgacctcataccaccctcaaacctcaccactgtgctcttattgtgggttgaatggtggcctccaaaaaggcagttcatatccaaatccctgcaacttgtgaaggcaagcttattgggaatcaggtctttgcagagtaattaagttacggatcttgacatgagatcagccaggaagaccctaaatccaaaaacagtgtcttcatagcagaaaggtagagggagatttgaggcagacaggaaaggaacacaggaaagaggagaaggccatgtggctgcagaggcagggattggagtgatatggtcacagcccaaatcacgagcagccaccagaaacgaaagatgcaaggaacagattcttagctagagcctcaaagtaagtatagccctgccttgattctgaatgtctggcctccagaactgtgagagaatcatttctgttgctgttgttttgagactgagttttactctttttgcccaggctggagtgcatggcacgatcttggctcactgcaacctccacctcccgggttcaagcgattcacctgcccagcctcccaagtagctgtgattacagggcacgccaggctaatctttgtatttttagtaagacagggtttcaccatgttggccagactggtcttgaactcttgacctcaagtgatcggctgtcttgactcccacagtgctgggattacaggcattcccggttgtctttgtacaatatttattaaatgtctttacaaagcaacatccagactccgaatacaactgccaaggacagccgttatgctatggggactggctggggcatagcaggtggctctggcttcccacccttctgtctgagatgggagtggtgggcactacctcatctttgggttccatgatgctcacgtggtcagcagaggcttcttagggccagtcttaccagcggggtcccagggcagcatgaccttcacctgatgcccagaaaaccctatctgagcagcacatggcacacaacagcatcaatgtactagtaacgtggtctccgctggggatcatcaggccatccacaaactcatggatttgaccctcttcctcagagtctcctagaaaccacagcttggcagcctatggcccccctattcatgatgaccacagcccaccatcgcaggccctccgcacagtaagccctcctaggagtttgtactgcaactcgacctgggcaatggcacacagacctctggggccaccttttcagcataaagctctaaatgccctgtgggaagccaaatctcttctgaactacagcagtcaattccagaatccctgctgttctcaccaggaacattttttgttctgttggctaagatatttgttactgtcgtgatggtgtaacttgaacctgagcttcagagaagcgtctttagccagctccggagtaagaaacgattccgttcggctttgaagatgccatcagcgaccaacatcctcttcttggaaattcgccggccatcatgctgctgcacaccatcaaaaggaaagcagattgtgcctctcttatatctactagagcaagtcaggacagtgcagtaagaagacgctgcccatggaacacacctgggtggagtcagccctgccacttggttgctctatgaccttatgaaactcacttgacctccccgatgccggcatcctcatttatgaagtggagttgttcatgagtattaccattttcccctagcttgtagggtttaggggatggtgagagagaaaccacagagcactttgtttatggctataagctgccattttctactgttactattactaccaggaatgaaaacaacaaataaaaacaaagcaacccaaaaattgctcccaaaggaaaggtgtgtcgcttcctctctgttctgttctcaacaaagttgcctaggaccctgatatgctttgggtgtgtctccacccaaatctcaacttgattatatctcccagaattcccacatgttgtgggagggacccagggcgaggtaactcaatatgtgggccggtctttcctgcgctatcctcgtgatagtgaataagtgtcacaagatctgtgggtttaccaggggttctcacgttcgcttcttcctcattttctcttgccgctgccgtgaagaagtgcctttcacctcctgccatgattctgaggcctccccagccgtgcagaactgtagtccaattaaacctctttttcttcccagtctcgggtgtgtctttatcagcagcgtgaaaacaaactaatacaggccctgaagtactttgcttgtttctccccagcacctaggaaagttctgacatgtaccaagtgagcaatacatattgattagaggaatgaatgaatgaggaaaaagagttgtagagtcaatgagctaacctttgggaggagcttggactgaatacagtaaatcaccaatcacacatttgagtcaataaaaatttcatcatcattggtcagtttattgttagaaaactttctacaggcaaaatgaagcatctaaatgtgtctacatgtaggagtggactgttataaaaagcaaaatgagagttatttttaaccttcatatatttctaaagatcgtttaaaacaaatagatttttaaaaactttatttcaaggtttcaatcaataaaaagtaaaataaaataagtactagaaaaataaaatttggattcagaggctagaaacctacaatgaacacgtctacaaggcaggaggattgctttgaggccagaagtttgagaccaggctgggcaacataggaaaccccatctcaataaaaaacaaaaattagcccagtatggtggctctcgcctgtagtcctgctacttgggaggctgaggtggcaggatcacttaaacccaggcattggaggttgtagtggctatgatcataccattgtactctagctcggagacagaacaagattctgtcttaaaaaaaaaaaaataacaagtctagaaagctcagggtagccaatccttccatccccttagagaaaagcaaagttaagacatgcatatcagctcaggctcggcgggccttaaatgcacacatttgacagatacgtgtatacttttatataaactccctgacaccagtgactgggtctgttttataaacaatgtccattaaacttcagatgaagcctttattaaacatttgctgaatgaatggacatctttagaatgctatatgcgattacacagacaggtgacctctctcgttttgcagcatctgagatgtgggtcaccatggtgaacattcaggtgatgataagcgatgatgacttccctacatttttctgctttaggaagcacctacctcttattgaacctggaatgatgggatgggggggagtctgtccttccttattcacacaggcggctgacacaataatgtgatcatcaactctctcttcctgcagcccccaacccgccagccgccccagctgcagaatgcaaacatctgccgcatcattaaggcatttctatacagcaccatccaaggcctgaccctgtgaccgtttccacattagatttgaatgacctcagcagcagggctgaaaggctggagtattaattcacagaacacaagctcaatttaagatttaatttgagataacgaagagctactgaaagtgtattcaacttcaaagcatgcaataaaaggcctttccctgttttccaagttgaatatgaatccaatattctttaacagatttattcacaaatttacaaacaacacgaagcctcttttctctgtttcaattcctttttttttttcttttagttttttggctttatcaagcccctttatgatgtttctgctaggaatcttttttagctcttcctccctaatttacaaatgactcttgtttaggaatacctttcaatttgatagcattcttgaagagaaagtagacttccttaagaatctcccctactttagttcccttgcattccaacctaaatatgctaagcgtctgtttattcaacaatgatatgttgcataaaaagctttcacccatcaatgtaactctcatcatggaaagattcaaaatatattccacccattaggaacacgtgaccactgggttctagtgaatatctaggctctgaaactttatttataaaatatttagaattctaggtggggatgggaatttttattggttcaagagatttttgtttgtttttgtttttgtttttctttgagacagagtctcgctctgtctctcggctggagtacactggcgcagtctcagctgactgcaacccctgcctcctgggttcaagcattctcctgcctcagcctcttgagtagctaagattacaggcacatgccaccacacctggtaatttttgtgtttttagtagagatggcgtttcgtcatgtcagccaggctgggcttgaatcctgacctcagatgacccacccaccttggcctcctaaagtgctgtgattacaggggtagccaccacacctggcctcacgtagattttttgacactaaagagtttatttaaggctgggatggtggctcacacctgtaatcccagcactttgggaggccaaggcaagaggatcacttgagccaggagtttaggtcagtctggccaatgcactgagaccccatctctacaggaaatttaaaaatagctgggcatggtggtgcatgcctatagtcctacctactcaggagactgaggcgaaggatcgcttgagcctggtaggtcgaggctgctgtgagctaagatgccacagcactcagcctgagcaacacagtgagattctgtctcttaaaaaaaaagtttattttaatatttgagatgggaattggagatgagaattgttagctttggactcagaagcctgaatctacgatggatttgctgactattttgtgtctgacactatgctaggttactttgcattttctcaaagaccagtccagcctcagaaatagacttgggtttaaagctcagcaaccaactgagttccctgacctctgtctttgtcacctgtgaatgaccacatgcctcagtgcttcctgaaaacaactttaaagttataaacattgacacatatatgggtataaaaataccacaggtcatctgagcttgccctgggacactgttgggaatgggtgaacttcctaggaactgcaaacactctggtcacttgaagattacacaatggacaaaggccaggatcacaatattttgcaatcctgaaactcattactttattagccaccgggttttcaaaatgagaagccatgtggtgagcagggggaaagaggataaaccagaggccacatacacctgttgtggggtgggggctggggggcgcttggcttcgacccaccctccatcataactagctgtgtaacctggggcaagcctgtgcctcagtttctcacttttatcatccttctgctcttcaggtaacagacgatgctcaacatgcagggataatagatgggtgtgaagccacaattcccaacacagagaaggcaaataggagaaaggccaaggaaagcacacccatacgtttgatgcagtgcagtgggttcaatagtgtccccctagaaactgttcactcagaaccaacgaatgtgactttatttggaaacagggtctttgcaaatgtaataagataaggaatgagatgagatcatactcaattaggtgggtcctaagtccaatgactgtgtccttgtaagagacagaaaggacacaaagccagaggagaaggtgatgtaagggaggagtagagattagaatgtggtgtttccaagccaagggacatcaagaattgccagcagtcacagaaaccaggagacaggcatggcatggtttctccctcatagcttccagaaggaacgaacccacaaacgccttgattttggacttccggccaccaaaaccatgaaacaatgaatgattccaatctacccagtttgcgataatttgttatggcaggcccaggaaacacatacacgtggctggttggtattaaaatgcaaggcacttccctgaagataggccctgtggtcttgctttcacaaggttgtcattatatctcaaggaagggccacactaatcctaagttcatccactaatccaataaaaaccacctaaattttcttagtgggcaatggccaactctactcatggaaatgggcttacaagaagttctcagatcatcagtaagaaagatttttatttaaggatgggaaaataattaggaatactgagatgtctccaaacaatactcccagatcttcgttgactccacgatatttctggcgtattcagggcaccacttccactgttggagggcatgcaacgtcttcagtaccaaaactttgggtcacacatggaaaggacattctggtactgcaaatttggctctttggatcaaaacttagcagtgtccatgactgttcttgctttcttacaacacccagatgtcagtgctgggggcttctcttatgtctccagcaagcagggacagggtcattgtgcatcctgagacctactagagtgccaggcccatgacaggtgctcacggttatcaaaggaatgataacgatacagtacagaggtaaatagtaagaacaatgccagagttattttattttcctccatatcacacattaccatccccattttacagatgttgatatcaaactaagagtataaattaatgaaagatgagtgaatacataaataagtaaataatgagtccatctaggaaggaggagactcagatcgagttcaagtctcactcaaagaagactgagtgcaagtctcactggcgcaaacacgtagctcttaaccatcagagatattgccaagctttgtttacggatgaaaatgctgtgagctgtggccttccactgtgctggtgatgcagggcaggcgaaccccagaactgcggcttaggcaacagggttcttggctttgcccaggaaagaattcaagggcaaggtggtggtgttagcaattttattgaagggacagtgtacaacaggagcagaggtgctgctccttgcaaaacagggcaccccacatgcagagtacccacagtggcaattccgaggcagttctgccatcacatttaccccatttttaattatatgcaaattaagtggtggattatgcagaaatttctagaaaaaggtggtaacttccaggttgttgggtcattgtcatggaaaggggcagtaacttctaggtgttccatggaaattgtaaactgacatgacacactggcggacacagctcatggaaaggtgcaccaccctatccctgttttagctagtcctcaatttggtccggtgtgtaagccctgtctatgagttga

SEQ ID NO: 5112 - DNA, 12063 bp, Homo sapiens
  misc_feature 3642, 3643, 3644, 3645, 3646, 3647, 3648, 3649, 3650, 3651,3652, 3653, 3654, 3655, 3656, 3657, 3658, 3659, 3660: n = A,T,C or G
ggcggcagcatttgcctagttaagaaggcctgggcttacaaatcaccgtaaaggactaaactgtttaaagggaaaccaaatgccaaatttagtccaagtgcttgattgaggtgtatatgaaggtgatttggataatactgaagtattttaattttctggactgcaaaacagtggcagaggaagtgactcaagtggctacaccacggttataaataggtgggaataacctttactgggcttacgaggaaagaaaaaagtcaatctgaagggaggggcgcgacgcgaacggcaagctgcagagaaccatccgagccggcgtccgccatggtgggcgggggacggctgcggccggaagcagacatgcgcttccggggtggggcctgccgcccgcaagcacgctcacctccgttgcgctgcgccgtggcctctccggattctgttaacggtagtggtggcttgttgggatccgttggtgatgggagagtgtgctctttaacttcggagagagatgcgctctcgtgtagccgtcaggcctgccataaggtctgcaggtgcctgttgtctgggtttgggggtcgagtagatgcgggcagccggagctgttgacggaaaggagtagccccaaaggagggcatgtgaagtcgcacgcgagctcgaggggaacggcgagcacccagaagcccccgggtctggagagggaagcgaggcctgttagagatctgtcagagaaggcatttcctaagtggaagcaagcagcagcttagccggattctcttctgagtgggtgccaccccggcttcggacccttgggcgtagagttgcggaaaacctggccgcagaatggtggacctcggtggtggtgttcagggagcaggtattcccggtgacgccctccaccacaaaccaggccctttgctacccggggacagtgccttcaggttagttctgcagaaactctacgcgaaatcttgcaagacaaagagctgagtaaggaacagctagtgcatttcttgagaacgtattaaaaacttctgggaaactacgggagaaccttcttcacggatgcttcacgatttcatgcttcaaaacaggtgtcgggtggaaaggcgaggcagtcttgcggatcttggggattgcaactggccctgtattcccatgcaaggaagttagttagttctcactttttgaagtagtcggatatattaacagtgctctaccctggagaaaactggtccatggatcattgctgttccttaaacaatctgtccgaaggacctgggaacgctctcaatttcacgggcaacttctgaacacagtgctgtcatttagtgcaatgtagtctaagtgcataaggaacacacagacattttgaacttttcttagatttattctaagtaaaaatgttgaaattataatctgaaactatttcatgtatatcataggataaatcaaggccaggcgcagtggctcacgccgtaatcccagcattttgcaaggcagaggcgggtggatcacctgaggtcaggagttcgagctagcctggccaacatggtgaaaccccgtctctactaaaaagacaaaaattagccggcctgacggcgagcgcctgtaatcccagctacttgggaggctgaggcaggagaatcgcttgacccaggaggcagaggttgcagtgagccgagatcacgccactgcactccagcttgggtgaaagagcaaaactccgtcttaaaaaaaaaaaattcaaatagttgggttagttgttattagaaccaagatattcattgtaaaagaagagataatatgtaaaagaaggtacgtataaactatgttaaatatggattggtaaattaaatatgaattggtaaattaaaattgaatatgggtccactctgtcacccagactcgagtgcagtggtgtgatcatggctcactgcagcctcgacccgggctcaagtgaacctcccacctcagcctcccaagtagctggactacaggcacatgccccacacccagctaatttttgtgttttttgtagagatgaggttttgccatgttgtccaggtggtcttgaactcctgagcttaagcaatccgcccatcttggccccccaaagtgctgggatacaggtgtgagccacagtgcccagcctcatgatttttaaaaatatatttcctaactttttcgtttaaagttcctagaagcaatgaccctcagtagcaatgagcacacctagtgcccaatcctggttcctttttttttttttttttgagacagagtctcgctctgccgcccaggctgagtgcagtggcacaatctcggctcactgcaagctccatctcccaggttcacgccattctctgcctcagcctcccgagtagctgggactagactacaggcacttgccaccacgcctggcaattttttgtatttttagtagagacggggtttcaccttgttagccaggatggtctctattcctgaccttgtgatccgcccgcctcggcctcccaaagtgctgggattacaggcgtgagcactgcgcccggcctccagatcttggtttctaagatgaaccagtactgggagaaatggcgattccgggtctggggttagggaaagtacaaggtgagtttgaaacactttatggtgctaaaagcaaagaattgcttgaagactaatgggtcatataaaaaggtcacagatgctggcttaggagggttgtcactggccacatctaggacaaattgaacattaagatacatattaatggaatggatcataacacattgactaaaatctaagagtcaatagtattaatcaaaaacaaatattgaccctagaggtcgggggcggggggaagaggtagagaaagcttatgtttttacagagctatggaataaatgtagaaggaaagatacattagaaaattcaccatttcatgatattgaaaccccgatatcattgattcaagcaacagtcatcaatggattctaaaatactgggtgaatactgttggggagcaggatattattggggagtggatatttactaccttaaccaagtaacaaatttggtgtcttcagtagtggaataatttgataacatgttcctcatgttatgatgcataagatacacacatctactatgtagtattttgctaaaaatgattagccgaaattaaatataaggaaacaatcagacaaatcccaaatgtgagacaatctatgactaacctggactcaatcaaaagtcagtgtcattaatagcaaaattaagggggaaaggaggcaagggaaatgtttagattcaaatggatgaaagaaacctactcagaatgcagtacatgaatcttaactggaagagaacagtaaaagatatttggggtgaaaattggaacaactaaaatatcaccatatgttgattatattgtggtattatggttaactttttatggtgttataatggtatataggaaatattttatttttagaagatgtatgcggcagtatttgggagtgaacaagaaaaaaatgtggcaaatgttgataattgatgaatctaggtaaagggtatacaagtgttcattgtatatggattttattattttttcaactttcttatagatttgaaaatctttgnnnnnnnnnnnnnnnnnnngcaaatgataccactctcttcttcagataacatgttattctccataagtttcttcctttgaccttttgatgcaaaccaggcttcccatagctgtcttaggcagcaactagttggctatttaatacttcctgacagttcatgtaaacaacaggtccagttgtctcagacaaattaacaaataagattcaacagtaatatttttaattaagttatggtgttgaggcaatcagaccctacaatctttaaagtgtctttttttgttcaattttaaaactatgaggccgggtgcagtgctcactcctgtaatcccagcactttgggaggccgagttgggcggatcacgaggtcaggaatcgcgaccaacctggctaacacggtgaaaccccgtctctactaaaaatacagaaaaaatagccgggcgtggtggcgggcgcctgtagtcccagctactcgggagggtgaggcaggagatggcatgaacccgggaggcggaggttgcaatgagccgagaccctgccactgcactccacctgggcgacagagcgagactccatctcaaaaaaaaaagaaaatcttcaaactaaaaaccagggtgaaactacctagaattaagtggtgatctgtctttttttgtttttttttaagacgggtttcactctgttgcccaggctggagcacagtggcaccatcccagctcactgcaacctggcctcccagactaaagtgatccacctcccagctttccaagtagctgggactacaaggacacaccaccatgcctggcttatttttgtatatttttagagatggggttttgctgtgttcccagtctggtctcagaactcctgagctcaagcaatctgcccacctcgacctcccaaaggctgggattataggcgtgagccaccaagcttagccaacatctgtctttatgctgtgttacgttattactactattaatgtgtctattgacaaaaatgatttgggtttgtggactagattatacaatgattgatttatcttttgacaggtgccttggaacactatgttaattgcctggtctggtaaacaagaggctaccttatggccttgctcagattggagtgtgttttcatcctgttttgacactaagcagatacgaaatggtgttaaaaggtataaaaagtggcaaataacttgccttgtatttaaatagtcaaaaaccagtcatttccacttgggataaattatataatttcagataagctaacttcctgatacgttttatatctaaagtattggtgagaagactgaagctcgttagtatggtttactcctccgagaacttcaaaccagtggcttgatttctggttacgcatcgactccagtggtggagaaaggtactgcaataattacctttaatttaatagttaatcataaattgtcttaatgtgtcagtggtaattcttctgacatacaagaaattatatttgagtatgtagctattaatatattatacaaatacaaaaactctttgtaacaattttcattgtctagattacaaagttactttggtaaaaacatttgttgggctcagatgtgtttgttaattgcctttctgtgtaaggtaaaattcaaagccctcacctagcattcctggctgatgtagagttgacccttgaccattgtcacagcttcagcttttgctacctacctccatgaactttccaattagtcaaaatggctctgtaattgatgatcaagttttagtactcactgaaaaaaaaaggttgaagtaagcatttttgtcttgccatgtgttatgttaccatttcccgactcaaacatcccaaatacccatttaaactgtatgaaataatcacgagtcatcaagaacttcgcagaaggtaagaatgaggactatgtgatactttcttctttatcccactttagtcatggttaacttccctcttcattggccataaaagtctggataacatcaacagttttttctctgtagttcttcctactaaaaaacaatatgttaagcaatatactcagtattttcactttttattttatttatttttgttgtctgtttttggttttttttttgttttttttttttcacaagtaccagtcacttttatttggaggttaattcccattaggatatgaaaggattcagcaacaatcgagatttgttgcttatggaggggttgcagccaagaaggttgctgggggagtgcagagcatgtcttttcagtggtacttgcatagccgctcgtgcttgagctccttgtaggaaaggcagtagatgagagcatgtaccctgccagcaccatggtaaaccccgagatgctccccttcttcacgttgtgtacttgttgtagtaccagtagtaacctctttgaaacgctccatcaaggccactagggtgaagtcccacatcaagatccagcttggcagctcccctagtttgacctccagaagtttctgtccttcactggtacaactgactccatcttggtttttttagagacatagtctcactctttgcccgggctggactgccgttgcacaatcacagctcactgcaacttcttttattattttagagatgaagtcttgctctgttacccaggctggtctcgaagtcctaagctcaagtgatcccctgcctcagcctcccaaagagctggcataacaggcgtgagccactgtgcctggccatattttcactttttaaaaattaaatttcagcaacctgtggtcccagctactctgaatccgaggcaggaggattgcttgaggccagcagtaggaggcagcagtgagctatgattgtaccgtgactagccactgcactctaacctgggcaacagaatgagacacatctcaaaaaaaaattaaattagaataaactttaaaatttgtattcgggacttgactagtttcgcacatttgctaataaaaagtatcggacaatttaaattcttacagataattatgggagttaaattagtgttatttaaatatgttaagacaaacttaaattttcttttccagtttgccatgagtccatctacttcagcagcagtgactgtcaggatgaagaaggccggaaaggaaacaaactttactacattttccctggggaaaggagttaatagaaaccctgtggaacctaggagatcacgaactttacacatgtatcctggcaatgtgtctaaattacatgtatgttttacctggagctcctattattttttacccagattctctataatcatttccgaaccatttgagaataaggtgcaaactggtgtcttaacacttcattgtgtatttttcagatgcagagacactcacctacataactcaatccagtcatcaaaatcaggaaattaacagtaatccactattgccacagagccctacaattgaactgattatctcaataatggcatttataggtccaagatcttgtctttcatgtattgtcatatgcctttacactccttcaaatgaacaattcctcttgtcttgcgtgaccttgcatttttgaagagtacagtctagttaatctgtagaatatgccttggctgggatctgtctctgtttccacgtgatttatgtatttttgtcgggagtactacagaagtggtagtactgagagctctcttctcagtgtgtcatatgaggagtgttactggtgatgttaacttttatcattagttaagatggtttctactagatttctccagtgtaaagctaataaatagtttgtatttataattaacggccaggcgcagtggctcacgcctgtaatcccagcactttgtgaggccgaatgggaggatcatgaggtcaagagattgagaccatcctggccaatgtggtgaaaccccattctactaaaaatacaaaaattagctggatgtggtggcttgcccttatagtctcagctactgggaggctgaggcaggagaatcgcttgaacccgggaggtggaggttgcgatgagccaaatcgtgccactgcactgcagcctggcgacagaacgagactctgtctcaaaaaaaaaaaaaaaaaaattaactagtaattaataagtgttgtgggcagatactttaagatgatgcagacatttctttgtcaccaaattttgccttactggttgcagcatccattgatgattcttgcccgatcagttactaatgtgaggtttgccaaatggtgatttttttttttctttatttgagacggatctcactctatcactcaggctgaaacacagtggtatggtgatagctcactgcaacccaaactcttgagctcaagcaatcctgcctcagcctcccaagtagctaggactacaagcagtatcaccatgcccgactgatggtttaatatttgtagagacggggtctagctttgttgccgggctggtctcgaactcctgggatgaaacaatccccctgcctcagcctcccaaaatgctggattataagaatgagtcaccatgtttggccatgtcaccaaattttgccttactggttcagcatcccttgatgattcttgctcaaatcagttactacgatgaggtttgccaatggtgttttttccccttcccttttttttttttttaaaaaaaaacaaattccatcattccttctaatttactggtcagcaatatactgtagagcttttccttctcctccattttttttttaaatggtatttcacagattactttctcagggggttacagtgtgttactgtcattatttattttatggtcaaattgtcctagacttggccagtgtccttttgacatatttccatcattgtcttacgagcacttccttaccttttgtagcaatatattgttccaggatcatcagtgagccaagctgtgctgctgcactccagcctgtgcaacaggatgagaccatgtctcaaaaaaaaaaaaaagaaaaagaaaaaatatatagcaaaaacataggagtttatatataatgagtagaaagtgattaatttttatttttttattttttgagacagcatctcactctgttgcccaggctggatgcagtgtcgcgattcccaggttcaagcagttcttctgcctcagcctcctgagtagctagactataggtgtgcgccaccacgcccggttaatttttgtatttttagtagagacagggttcaccatattgaccaggctggaatttttaaatatgaataactaatgaaaaactagaaggttattaactggtgaacattttcctttaactccaccaccatcacacttcattttggggtatcagctctcaaatgaaacttattggttattatcatagttaacgaacagctcaaccttgtactagggatttaaagatgatttttgtattgtggctattagtgtcttattttgttctttttttcttttgtatgaagaatggggtctcgctatgttgcccagtctggtcttgaattcctggctcaagctgttctcctgcctctgcctttctgagtgctaagattacaggtgtgaactacatgcccagattattttgttcttttattggtatcattttcactaatgaagagttttcctatgcagaaatttttctcttccatgacattgttccttttctgtttccagagttcacaaaatatttatcattagttgaacatgttataaaatattaagtagaatttctgtcatttagtatgtttcttgaaatgtttctgaggccatttctttctttttttaaaattatttaatagagatgggtctcgctgtgttgctcaggctggtcttgaactcctgggctcaagcaatcctcctgcctagcctcccaaagtgctgggattataggcgtaaaccactgcacccagcctcttaggccatttgtatctgtttttagttgattttatggttaatgtccaaatatattttttagagaacatgaagcagaccaataaaggctgaagaacagttaggatagaaaagaatttattctggatatgtgagaaatcagatattgttggaagagttgccaccagatatcctgacattgttggataccaattttcaaaaaattagaaaacaataaacaatcttttttgtttgttttaaatagggagggatcttgccatgttgcccaggctagtctcaaactcctgggctcaagtgatcctcctgcctggcctcccaaagtgctaggattacaggagtgagtcactgtgcccagcctaaagcatcttcataaagattcagatttagattttgtttgattcaaagcgcaccacagaatctttcatacttgagtttgtctttttttttttttttttttttttgagatggtgtctcactctgtcaccaggctggagtatagtggcacaatgtctgctcactgcagcctccacctcctgggttcagtgattctcatgcctcagcctgctgagtagctgggattacaagcatgcaccaccatgccagctaatttttgtctttttagtagaggtggggttttaccatgttggccaggctggtctcaactcctgaactcaagtgattcgtccaccatggcctcccgatgtgctgggattacaggctgagccactgctcccagcccagtttatcttattaactatcagttcgacgataactgtgtaaatacaactggtagaatagagtcccaggtatcagaaagtttactgcctttgagggcaattcttgtgaatctttaaagtatcatatgcaattcaaataggtttaaaatgtcagtacattatgtattaatgaagactgtggttgatcatgaataattaacagaagctgaggatttaaattgtggggttttctctcttttttttttgttctgtgactctagctaaaggtggttatttagtatttttaaaaattacatgaatatccaggtgaacaatgatttacaaaaaaagaaagataaagtggaactgtttttatccaaaacttaagaaatttctaggattgaaatttttaagaatttgaaatgattcctcttcagtttagagaagaagtaagtctgtttatcaatacttaattatatcatgtactatgtgtagtttgttttcataattatggctttaatgcaaaaagtaagttttgaaagatttcttttttatgaaaataactttacgtttcagaaaattatactccaaaccctttccctaaagcacaccatttttttccctaaggcctcttttgaataatcagcaaacatttttacttaaaagtgttacctttcgaggtagggcgcagtggctcacgcctgtaatcccgcactttgggaggctgaggtgggctgatcacctgaggtgaggagtttgagaacaacctgccaacatggtgaaaccccgtccctactaaaaatagaaaaaaattagccagacatggtgggtgtgcctgtagtcctagctactcaggagactgaggcaagagaatcacttgaacccgggggcagaggttggcaatgaggtgagatcatgccattgcactccagcctgggtgacagagcagactctgtctgtattaaaaaaaaaaaaagtgttacctttctgaatactaactctgagccggaagcattaaagaaatagtctgtagggctattgaaaaaattgatgcctaagtccctcccagttgagttcgttcagaatctctgggatagagcccaaccaagcaccatagttttaaattcacatttgggcctcgctgatgaaacactgagctcagtgagagcagagaatgcatcttatcgtcttcgtgggcccagtgcctaccacaggcctggtacagagtgggtgctttgtaaatgaaactttacttttgtattctgattgtgtaagtctaaaatatgtactcaggaggctgagcaggagaatcacttgaacctgggaggcagaggttgcagggagctgagatcatgccactcactccagcctggccaggtgacagagtgagactccgtctcaaaaacaaacaaacaaaaaagttctgtgaaatgattatttttcttctgtttttctgtgaagggccgagatggacgaaaaatgtggttccttgtgttctctctgtaaatggggacctagaccgaggcatgctggcctactctatgattctttccagctgacagagaactcctttacaagaaagaaaaatcttcatagaaggtgctgttgatatttcagagatagacttgggaaactaaaaatatgggtttgtttgtcttaatgttagtgtgctcggtttctaacataaactctaaataataaatttagtgcatgtgtctaagtatttttcagtttttttagaatctggccacaggaataagaatcaggttctcaagaatagaacaaggcatccctaataag

SEQ ID NO: 5113 - DNA, 13554 bp, Homo sapiens
tgacaagaaactgagactggcctccagtcaacagccagcaagaaaatgaggcctttaattggctgtctgcaaggaaatgaattttgctaataacctgagctaagaattgaatccttcccagtcgagtctcagataagactgcagcttcagctgacactttgatttcaggctttcagaagcccagctaagctgtatccaggctcctggcccgcagaaactgtgacatagtaagtaaggtgtgctgtgttaaaacatggagtttgtgataatattgttacacagcagcaacagaagaaggtcaagtcagtgagcaagaatgaatgttcaacaaatgatccgaacaactgggtagccctgaaaaaaaaaaataaagctggatccctcactctcacatgatataaccataaattccagtagaggaaagatttaaatagaaaaatacatcaaaagagaaaacatgcttttaatgtgtattttggagtgaggaaggccttcctaagtgaaagtccaaaaactatgaaagaaaagactataaatctgattaagagagaaaatatatctgcaacttgtatcacagagggctaatttcttaatatgtaagtagttcctacaaatcaataagaaaaagattaattactcaatagggaaaaaaagcaaaggctataaacagtttatagaaatgaaactacacatggttcttacacttatgaaagatgtttcctcattataagagtgagaaacacaatgagacactgactaggatcaaatgtgtgataacacacttgattgaaaagcaatgggaaaaatggcaccctcatttagtgctgtggggagtatactggtgcagcctctctagaggacatcaaggcagtaactatcaaaactcaaatgtgattgggcacggtgactcacgcctgtaatcccagcattctgggaagctgagggggcatatcacctaaggtcaggagttggagaccagcctgggcaacatggcgaaacctcattctactaaaaaaaaaaatacaaaaattagccaggcgtggtggcgtgcacctgtagtccagctattcgggaggctaaggcagaagaatagcttgaacccaggaggctgaggttgcagtagcagagatcacgccacacaccactgcactcccgcctgggagacagagtaagactacactcaaaaaaaacaaaacaaacaaacaaaacacctacaaacacccttgactcttcaactcacaattccatttctacaggtatttagaatgacatatgcataaggctatccaatgtaacatgtttgtcacagcaaagatgtgaatcaacctgtctaccaataggagcttagagtgaaatatttatagtgcatatataacagaataccatgaaccatacacacagaataaggaatctttcattctgaaagagagatctctgaaatatatttagtaagtaaacaacgacaacaataatcaaaaaaacaaaacaaaacaaaacaaaacaaaactgaggtgcctccagggaggagaccaggcagctggggtcaggtcaaaaggacagctttcattatgtgctcccttttttttttttttttttttgagatggagtctcgctctgttgcccaggctggagtgcaatggtgcaatctaggccactgcaacctctgcctcccgggttcaagtgattctcctgtctcagcctcccaagtagcgggattaaaggcacacaccaccatgcctggctaatttttttgtattttcagtagagacgggtttcactgtgttccccaggctggtcccaaactcctgagctcaggaagtccatccaccgggtctcccaaagtggtaggattacaggcgtgagccaccgcgcctgacctcttttatacttttaaatgttgaaccatacgattgcatttctttttcaaacaataaaattcatatcaataatacatataatttgtagaataggatgcatggtatgctacagtttctgcaaagaaattaattcagactatctatctgctcagacatacctacctacatacattcttgcacgtaaacagtacctctgaagtagcacacaagaatctgagggctggtttcctctgggctggagaatgggaaccagtaaactgtgcagtgaagcagcagggatgagaaattctctttccaattttatacattatatctattaccaatttgaaaacaaacgattaaaaaaaaaaaagtttaagctgttgggtttctctggtcctctgctcttccccctttaagattctcactgatgaatcgccctaactctccatgctgataactcctaaatcctggcccgtgtcttgaactgtcatcctgaaacagctttccctcagtttctcagcacagtggtctggtgattccccttcttattctcctacggtgtgccttcccttaagatctggtttctgtgaaactctggggtttcacagagttttgtgctaacaagttttcgtctcctcctcctcattggtacccacagctgagtggtcatctagatgcagtactttccaaatccccatccctgcccagatctcttgtctgagctccagatacaaaaacagttgccagagaacatcttactgacaactgggactcctcccccacaccggcagctcctcagtgttcccataaaccagtgaatggagccaccatccattcagatagaatactgggatctcctggattctttccccactccttccccatcccaataatcagttttaaggctcctacacgttctgtaatctgtcctcttcctcccacctctgtagatctccctggtccacaccaccttctctttcctgtgagttcccggctgttctgaatacccacaatattgctcccctatccatttccgccctgaggctcaattcatctttttggttctatattcgtaccctgggactgccatccaaaatgccactgaccgaggggcttgaatgacagacatagttctggaggctggaagtccagttcaaggagtcagcaggtttggcttctcaagaattctccttggcttgcagatgaccacttctcactgtgtctgcacatggtccttcctctgtgtatgtgcatgcctggtgtttctcgtgtatctaaaactcctcctcttacaaggacataggtcaaactgggctacagcctatccaacagcctaacaggtaacttaattatctctttaaaggccctatctccaaatacagtcacttctgaggtactgagggttagggctcaacatatgagttttggggatgcaaatcagcccacacagtgtccaacaggtcatgtcactcccctcaataaaatctttcactggggtcccaaccccttgaaataatatcctttccaaaacatgacccctgcctactattctctctcccagatgaagggtagtgtaggcaggggtgggagttcagatgggggtaagggtacaggcagaattaagagatcaggaagaaatggcaccctttcattatctcccttccagtcatgcttcttccaatacagatagactttgggcaagctgtctaaactctctgcagaatgggctgggtccttgatacccacaggcctggctgagcaccagggagagatggcatactccaccccatgcttagatccctggacagaaaataccaggcctgtatcctctctataaaggtaaaggttcccccagagtaatcaaggaatcttctggccaaatccaggattagaagcagatctaaactgcaactgggcatctccctttgagactaaactgctcattaagatgtcctagatacccagcattagaaagtaccaccttgctggctccatcatgaaaatgaatgcatggacttggcagcggcattatgcagacctgatttgtctgtctccacttatgaactgagtgacctggggcaagatgcttaacactctcagccttgatgtactcatctataaaatggggttaatattcttctaagtagttctaatatactaattccaagggctgctgtaattaattgccacgaactgagtggcttaaaacaacaaaatatgttctttcacaattctagaggctagaagttcaaggtgtcggcagggccatgctcctctgaaaactccagggcagaatccttccttgcctggcttctggaggttgctggcaaccttggcattccttgccctgcacctacatgctccagtgtctgcctctgtcttcacaaggcatcttccctctgtgagtgtctgtgtaccccctcttattacaaagacaccagtcatgggattagggcccactccagtccaacagaactgtgtcttaacgaattacatatgtcaagacccatttgcaaattggtttgcattcacaagtaccaggttttagggcttcagtgtatcttttaggggacacaatttaacctgtgacacctacttgaatgattgtgagaggattaaataatgcctaaaagcactaaggacagtacccggagcacacagtaagcactccacacagaacagtttcctcttccagtgtgtggctaacatacagcaggctactttcccagaagatcaggcctagttctttgctcctcataaaaacaaaaaccacaagcaagaaaccaaaagcaaataagccggatcctcatggctaatgctgtattaagacttttaaaataaacaaagcaggacttggtacctgtcactgaagtaaatattttatcagtgggtctctgaaaaaaactccacgcatgcacgtggccccacatgcctcctccctggaggagctggttctgccaataaggggcctcaagggctcttgaaagcagagaggagtttactcaaggtgtgcacctctggttccaacatctggctgcttccagctcagcaaagccttccagaaacaaggcaacacggggcctatggacacctaaagccatgctgaggctgaaccctgagcaacctcaacactggtgcttcccaggagagccaggcagaaagctcagccaaggaagtgattaataaatcatgggcaaagctttttcccattctctctcggtggaaaccaaaacgcctatcacaatgatcaaagctgctgcctgcaacttcagatgactttgactgagctcattaagtcataagcttctgcagagtggattttctccatggatatgcttgaaaattaggaagttaagtggcttgggagaacctgggacccattaaccaactagcagtcagagcttccattaaaagaggaaaatggctgaaaatctgaaatctgttcttgggcgctgttcaaagattctattatgagttttcaggggaagccccttggggttcacaccagcggagcagagaagcctccatggacatgaagtgagaaggacctcgaccgagaagacagaggctgggttgaaatcctggctgcatctggaatattagggatttctttcctctctctgagcttggtgtcctgagggggaagtgccccccagtctgaggcatgtggattccacggctggaaccgtgtataaaatcgtgactctgagccggggacttggtacgcacaccatatgcacttaggaagggctgttcgtaaacagatctgtagacgacagagtcccatctgccagttaccaaatgagaggccacacgtgaggaatttaaccatctgaaacagctagatgttagctggtagagggaaggcaggctagagttgtgaaacctgccaggttaaataattttctcctctttctgcagaacacggtgttctcttgcaatagatcttgcctatgttgtaaagctctttggctgagatggagacagaaatattaacaaaaaactgaggcattaaacataaattaaattaaaacattaaaatgagaaattaagcttttcctgtttggaagaagagactcagaatgtagggcaaaagaaagacagggaagcagggaggcccagagccagatcccagagaagagtgaagtgcagaattcagggcaatgcttacattgcccaggactcctctcagtaacgtgcatgaactcaacacacctcggaaaaagaaaaagaagatccagatcagattttgaggactccagtgtcacaccttctcaatatcctgagacaccaggccaaccaggcaacaggaacaagcagccacatggtgccagccctctactcccaaaagcccgctgagccagacgttatttctccaacagcaaagcctccttcagaggctctaagcatttgatgctcacatccactcctcccaaggatgagatgacctcactgctctggtcaatactaatcccttcaccccaaagtcctatagaaaattattccttcaatcagtgtcaagaggaaaattcgagatgatcttgaggaagctggtccagaggaaggcaaggagaacaagggctgcctgctgagacatgtgttctatgagaaaccaacatggcttcctactaaaaaaagaatgctcggaggtagaaaaaattggggttggtgaatttggtacagtctacaatgcattaaaagcctggatagaagtgtttatgcaataaagcactatatgaaaactttttcggatttcacctgagaatttggctttgcgtgaagtttatgctcatacagtgtttggacataccccacctggtacattactaccccttacaggcagaagataaccatatgatcattcagatggatactgcaatggcaggagcttgcaggctgctatatctgaaaacactaagtctactatcacttccaagagccaaaactcaaggacatccttctacagatttcccttgaacttaaatcagccacaactctggcatggtgcacccggacatgaaaccttgtaaaaccttcctttgtccaagatgcaaagtgactcctctggagtcacagaagttgaaaatgaagctgattagtttcctctgcccatgtgatatataaaattggtgacctaggccatgtgacatcaataagcaaaccaaagtggaaaaagcagatagttgctgcctagcaaatgagattttgcaagaggattattgtaccttcccaaagcagacctatttgccttgggattaatcactgcaatggctgaaggagaaggacattacccatcaacagtgctgcaaggcaccataaccatgagagtaacttcccagcattcctcaggagctctcagaagacttttacagtctgctcaagcacatgatccaccctgtccaggagagagaccttctgcagcagctctggtcagaaattggccctggccctccctgggaaagcagaagagctctagcagcagctgaatttggaaaagtccaagacagctgcactggaagggaactaagggaagcccagcaggcccagtccctgcagggagacttccatcatggtgccctcgggtctttgggaccacacgggatcagaaaacaccaaatgcctggtaggaggaaaagtgcaaggtcttcaagctttacctcaggacagcatgagcctctgaactaaaggaagaaacaggaaacagcccttgcttggccttatggattaggaggttgccctaccaaggatcccaggattcgctgtacatagaaaggaatagaatttggttttgaattcaagtaacagtttacagaaaatgtgcctggatttccacagtacttcccaggttatatgatgctatttctgaaaaaagttcccaacccctttgtggaagtgggtctcctaatatatataccctttctgatattgttttactaaataaatggcttcaccattacatgaggtgggtaaaagtaagactgtatataattggacatctctgagctggttgtttaattgcagaacaaaaacgctggatggagaaggttaaggaaaacttgacatggctgttctccatctacttgccctgtccctcttgtggccacgtctgactggtttgatgttccaagcctcaccaatttccctttattttatcagaatttggcctgtttcctattatttcatcatactttatccaaatcctttttatgtacacatttttaaagaaaagaatactgcatttttgctttttgttttttgggacggagtctcactctgtcacccagctggagtgcagtggtgcgatctcagctcactgcaacctccgcctcccgggttcaagagttcttctgcctcagtctcccgaggagctgggactacaggtgcataccaccacgtctggcaacttttatatttttagtagagatggggtttcaccatattggccaggctggtctcaaaccctgacctctgatccacccacctcggcctcccaaagtgctgggactacaggtgtcagccctgcgcccagcctgcatttttaaataaagcattttatcttgtcgaaagacaaattacagtagagtactcttctttgtcataccgtcactaacaaagaatgaaaaatttacgttagagacattttacgtgataaaagggtaagagaattcagtaggtcagtagtaacatgccttggcatagggcccagattcacagatccaaaagttaataacagtcaggatctgctataaaataatttggtcataaaggtatttgataaattgtttgtgtcatcttaatgaatgcaacctgttaagattaatggctttttttactgttggattttcttcttttcctgattttaaaaagcgaatttttaaattgaataaaccctcacactattctttaaaaaaaatagtgtgtctctgaccccaagactatttaagagcattaaatgagacagacctctctcctaacatacgcctggcagatgtaaataaatcttattcccccatctctctttggtttcctccctcctctctccagaatttttacccattcctatcttcacaaaggcctccccagtttctcggcacatagtgaggacttccgctttagaaaactcttcctgaaaccctaaatacccacatacctgaaaacaaattacctaaccctcccatggcccccagccacagccttggagcctcctctcttccagtcaagcctctgacagaatagtctctaccagcagttcccaaatgtgtgttacaagaacaccctggtccgtgaaaagggttcacaggttagcaacaaaagtagaaaatgaaggcacaattgcagcaagctctcttagaattaaacttattccacttacaggaccatccttcattctgatgagccattacacatttttgtattaaaacataatttattttagaaaataatgattggataattagagagtgtttggttttcattattctcatctgatcaaataaaagcgggtgactcaacatcaagagccaagcttttgtttttttcttttttttcattactttactggtccataatatccaagcctggaattgtgtttattatactaatcagtttcagttggctgcctccacttccgccccagctcactcttctcaacactattttttttttttttggagacagtcttgctctgttgcccaggctgagtgtggtggcataatcacagctcactgcagcctcaaacttcctgggttcaagttatctcctacctcaagcttctgagtagcaggcactacaggtgtgcaccagcatgtccaacctaattttgtattttttgtatagacagggtttcaccatgttgcccaagctggtcttgaacgccgggctcaagtgatcctcccacctcagcctccccaagtgctaggattacaggcatgagccccacacccaggctcaaccctaatttacaaacccagcttctactctcaccattcaagtgaaccattccctcaatggtgtccaaatctgggccttcttccctctagcctgcatctgacagctagaccaggccctggttacactcagacagacgacagcctccaaagtagaggctaactcaggctttccaaacagagccctgagcaagggaaagccttcccagtgcctatgtcccaaagccaaaccccaagttctaagctgggtctctgtggcctcatcactaccccatctaccaaagaagactgtggggctggaaaagcccaggactcacacaacctcgctctcacccaagtcccacaagttgttcaatttctctgaaactcagtctcctactgggtcaaatcacgatcatgacatcttgacctcatagggatcttgaggggattcaaaaaaatccagtgggtaaagcactttcccagagcctgggacacagtaagcaccaaataattgggaacatggttagtagtaggagtgtcctagtagacaatgccctctttctagttttatcttccattgctcaagactccagcaaattgtaatacttatggcttcccaaatacactgcatagtttctctcctctgggacccagccacgccatcctggaattccatcacatcaaggactgccttcccaatccttgtttattcatctggccggaagaaatggggacctcctctaactccagcaacattaggtctatatcactctttgccactcaccacattactatacaacaccttactcagagacccacgtgcacgttttccccttttcataaattcttcattacttaaggtcaggggaaagttctgcatatccaaccatactactatattgatttacaagtaagcgaacaataagcaattgttttaaaaagccagtgacataataccaaacaggtcatttaaaaatagatggtaagcacatacagagtggagacttctttggccaatgttgaatttcttcccaggacgaagaacagtagtgtttacatgtgggtatattgttacagaaataccacaagttgggtctacatcctgctgttttccgcaaagaaagccaaggctgagatgatgattattgccaaggaagaaggctttaatcgggtggcaaagccgaggaactcagtcttaaatcagtctccctgaataactaaaactagaggttttagggaagaaatgaacaacgtgttaaaaaaaaaaaaacacacacacacacagaactgggagaggcaaggaaaaattgtaatgaatgaggggttctgacatctaactgtcagaatgtggtgatctggtgagttcagttctttgatattttttttaagaggcctgaagatcatttcctaaggaaggaacacaattaaaaaaatgtaagtttcaagctttaagaccagaagggtcaatttctatgtttacccaaaaaactatctatgggaccgttggttggtttcatacatgcacagacacaaatatgttctcccaaaatctcaggcaatgcaagtggacagtaattaaaattttaataaaatggcatttaatccatcgtccttgtggcctggccttcctccctccacagttgtgactgactgtcaccaataactctactttgttctcccattaacatctacatctctgtagttctgatctctgtgttttttgattatgtcttcttctggtatatctacttctggtttagtctttaccacattatttcatatcttcactcagatcaccacttccaagtgacactgttatttattttgcaaagccagctttttaccctctgtttcgttccccacccacgttgagttctgaatccactaaatgtcctttcatggtgtcctatgtatgcaaatagctcaagtctacagagattttaatttcttttcatctactttcctcttccatctcgcaaacaaatataacatatttaaacaggaaagggaacatcagtgtgtcctcccctaaatatgcttagagaaagggcatttctatttcataatctttgggctctttagtccactgtatgaactcattaaactggaggtggtccagagagcccaggaacttaatgagcctcccagacgcaagctgttcatacccttttgaagtcagtgtggaaccaaatatggaaaatgatcatcagccacttagtcctgatgacggccccagagggtgggtatacctcttccacccaaaattcaggaagaaaaaggtactttctgtagaggcaaaacgagactggatgagccgtttgaaccagcagcaaaactaaaatatacctggaattctgaagactctgctccagaatctcacttagcactgaccctgcactatgtcctaggtcatgaaagagaataccctagaacttggagacaagctcaagttcaaactccaaaaacgtgaggattttagaatcaaaaaaaaggaaaaaggctatttaaatgtatttcaaaaagaccaagaagacagagggaagacatttcaaggagggggaaaaaatgcaaataataaattttttaagtgaaaatgtgaaaataggagtcaccaaagtctaatttctagttcatgattagtgaccagaaatttcaggactgaattttcaggaggatcaagagtcctcatctcggttttaagaccacaaacaggatcacagtatccctggcttaaaatatcctcattgtacattttaaaataactaaaagagtataattggtcgtttgtaacacaaaggataaatgcttgagggaatggataccccattctccatgatgtattatgaaacactgcatgcctgtatcaaaacatctcatgtaccccgtaaatatgcacctctctgtacacacaaaaattttaaattttaaaaaaattttaatattctcattgttgttaggtaaaatgcaaaagctttacatagcctgctgtacaaaccaaagcacaactgagaagtcataagtagaaactcattcatttattcaacaagctaggcactgggggtttgagataaatgaactcccagccctcaaccctagtctcggcatggattggtaagcatgtggtgagtgctcctaaatgccagcatgggctaagcaacctgcattcatgatcttgtctactctccccaagaatctgtgaggctgctattaaccttatcctccttttacaggtaaagaacacactgaggcagacagctctgtaactggcctaagtaaggtcacgcagccaggatctgacctcagactgtttgttcaagagcctgccttctgaaccatcactctcccacacctccagtggaagcggagcctaaaaagggctcaccactgctttgcttatcttcttgcagcagtgcaccctggatgaatggtccagcatcacagaatgagacaccctccagggaggaggagcacatggctgacgctcactgcttctatacgctgagccacgggggcaccagaatccacacaattgggaaacattctgatcccagcagaatgagaccttatcacccagtcctacggtccagagctggggcctggacgttctgccatgccaacagtagaacaaccgcctcttaactgcctgtcatgaatggccttggggtccccatccattatccacctcagcgggagatgagggaacaggcctggccacagcccaccatcccctgaccagtcatcaggggcaggcaaattaaaaccaaagc

SEQ ID NO: 5114 - DNA, 33639 bp, Homo sapiens
agtgcaataaacataaaaatattatcaagaacatctctcaaaactgcataaatacatggaattaaacaacttactcctgaataactcctgggtgaatatcaaatttaaggcataaatcaaaaattctttgaaattattgaaaatagggatgcaacttaccaaaatctctgggatgcactaaagcagtgttaagaggaaagtttagagcatgaaatgccttcatcaagaagttagaagatctcaaattaacaatgtaagtttgcacctaaaggaactagaaaaagagaacaaaccaccccaaagctagcaaaagaaaactaaaattagagaagaatttgacactgagttgcaaaatccatacaaatgatcaataaaactacaagttggttattagtaaaaataaaccagatcaaaggcccctaactagattaacaaaatcaaagaagatccaaataagcacaatcagaaatgaaaaaatgatgttacacctgatcccacagaaatataaaagatcctcagataatattatgataactctatgtgcacaaattagaaaatctggagaaaataaataaattcctggaaataattcctaagattgaatcaggaagagattgaaatcctgaagagactaatatggaactctgaattgaatcagttacaacaacaacaaaaaaaccctaccaatcaaaaaaagtcctggatcagttaattcacagccaaattctaccacatgtacaaagaagaactgagaccaattctactgaactattccaagaaaatccaagaggagggactcctctctaactcattctatgaagccagctcagcctaatgccaaaatctggaagagtcacaatgaaaaaaaaaaacttctggctaataccctgatgaacatagacacaaaaatcctcaacaaaataccaggaaaccaaatgcagcggacatcaaaatgttaataaacgatgatcaagtaggcttcatccctgagatgcaataattgttcaacaagtacaaatcaataaatgtgattcaccacataaacagaatttaaagcaaaaaaatatgttcatctcaatagacaaagaaagaatttcttataaaatctgacatcctttcatttaaaaaccctcaacagactcagcattaaaggagcacatctcaaaacaataaaagccattatgacaaacccacagccaacatcatactgaatgggcaaatctggaagcattccccttggatatggaacaagacataaatgccaactctcaccactcctattaaacatagccctggaatcctaactagagcaatcaggcaagaaaaagaaataaaaggcatctaaacaggaaaagaaaagtcaaactatcttcactgacaatataattctatacttagagaaccctaaagaatccacaaaaggctactagaactgacaaattattttagtaaggtttcaggatacaaagtcaatgacaaaaattactagcatttctatacatcaataacactcaggctgagagtcaaatcaagacacaatcccatttgcaacaaccacaaataaatgaaatacctaggaatacagctgaccaagaagtgaaagatctctgcaaggagaactacaaaactgctcaaacaaatcagagatgacaaaataaatggaaaaacattcaatgctcatggataggaaaaatcaatttcattaaaatggcatgcttcctaaagcaatttacagattcaatgctatttccatcaaactacctgcaccaatcttcacagagttagaaaaaacaattctaaaattcatatccaaccaaaagagccagaatatcatagcaatcctaagcaaaaagaacaaagctggaggcatcacattacccaacttcagctatactataaggctatagtaaccaaaatagcatggtactggtacaaaaatggactcatgaccaatggaacagaagagaaaactcagaaataaagccacaaacctaaaaccatctgatttcgacaaggtcaacaaaaacaagcaatggggaaaggactccctattcagtaaatggtgtgggataactggccagccatatgcagaagaatgaaacaattgaaacacagccatgcccattggataggtatcgtccatggctgtctttactatcacagcagttgccaaagagaacatgcctgcaaagtccaaaatatttactatctggcactttatagaaaaagtttgctgatactcaatttggatcactgagtgaccacatggaagacaaccacattgttgacctgaacaacaacctctacttctttacataaatgaaaaataagccattgaaattctgggcctaattgctacctagtttatcctggtctcactaataattcttcctcagcagtcacagggtgattgactgataatgtacatggcccaatcatcagttgtttgagccattgaggtggactagttatgcccatggagtacagctctctcctctacgacccaccacgagcccaaaatttcctccagatactctaccagtcagtcctaggacctgattgaccccagggagtctgaccccctaagtataacacacatcatgggcagcatcatgggcctgggaaggtgtaaacataatccaatttctgcccattaactgaatgttaacaggaagacgttccctgaagcagaaggaaatgaccttgatgacgatacccttgccaaaggtaggtacccttgccttgtcacctacctggtggtcatgacggtgataaggctggccctgctttcatgtaactaactggccttcaatggttcacttttcccattgatgacttttttcagttatacacttttgtaaactagaagtgtttttactggcatttctttagtacttttttatttttaccatcattttaatttaaaaaatgcagtcacacattttccatgatacctctaatttatggcaggttatagaggtcttgcatttatggcaatggtataaagtccctttttgagtgagcatgttgaagtaaaaagagtgacttcatttaaagaaaactgctcaggaagtacagatgatatgctgataaggcaaaaaaccatgatattagtatgagactaactaggttccagaaacactgcgtatgcccaggctgcagtggagaatgtcatagaatcctggatcatagagtgtggagccatggtgaagggtgcgtgagagggtccctcccccagagccacacctgtctttccacaaggaattcccaaatgtcacccagtggattcagacttctgtctcccgttcagtgttctccaccacaaaatctacacctgatcaatcccatagttcagagacaaagtgagtgaggggcccagaaagacatgtgtttgctgtgcccaatgcctgctctaacatgtgtttccacatatctgctgagcaaactgatggaggtggagaagcttgggagagttcatttgaggccccagatatgcccactctcccaagtcctacccaacctcctatgtaagccaggggtgctttggcatgtgtccatggggatgttcgcctcaaagtgatgcaggaaggagtcaaggcgtcccctgatgggctgatcctttgctctggaatccttaagatcattgtagatccttaagacattccagaactctcacagcattctggagtccattatttaacacatgtttattgagcactactgtgggccaggcatgttcttgggtccttggggtccattagtgaacaaagcaaaggccctagattcacggagcgtgcattctagcagggggagacagataagaagaacatgcaaatactccatggatcatgtgatatgttagaacgggataagtgccttggaaacaaagaagcattaagcagatgagggagatcagaaggaaggatcccatgaattccgctgtcttgaattttacatagtaggggagaggagtgggccaggaggtgtgtgagtggcaagtgtactgaggtgtcagtcggcaagtgctcaactctcaggtgtgcccagctccctaatgctgaggagaaaaatgcaggtgtgtccattcaccctggccaagctgggaagaaaagcccaaaggttctaattggctcaccacctctccccagggtacaaaggaccctacaggcatcagagaagaccccattcactcagcagccaggcatttggagggtttccagcagcccacctctagctgccttcttttcttccttttttaaaaaataatatttactgtttttattttctgactgcaaatgtaatgcatattattacaaaaaaggtaaagtattatgatttaaattttgtttgtattccagtttttctgctgttgctatactttcttcctttaaaatggaatgttaagttcagataatttggatgcttctttgctcattaagtatatcatgagcatcattctatgccattaaatagcatagcctgatttagcagctgcatcacatttggtattgcaccacaattaatttccccaagcttttatctgggtcattaggttacatatgaagtttttgataatatagagagcactgtggtgaatatttttagtgaaacctttatgcccattcataattattttaggataagttcccagaaatgacattctgagtcgaaaagtgtatatcttttgttaaaattccttgccaaaatattccaactacactctcccattgaaggatgaaaatctccattcatcagattttttgctgtgcttggggttataaaattgtttttggttatcggataggcaaaatgataataataatagcaatattattttctatttagtttgcatttatctgaagaccagtgaagttgagttctttttccctttcttcacttggaatgttgtttttattattattattataataattattattattgttatgccacttgacttggtgatctgcaggaaaacctcccaagatggaaagcatgaaattgtctttgctggcctgattcttgacagctgtgtcatcccagagcctgagtgcctcagtttcctcatgtacctgtgggggccatgaggcctgccttctggtactttgaggtctgggactgttgcttataataacttgtgtataagcaccacatggcatggatctacctggctatgtaaacttgggcaggtttctaacctctctgggcttcagttttctcatttgtaaaatggaaataatggaacctatgtatcagagtaatctgaggcttaaatgagttaatacataaagggtacttgaaacagtgcctgaacactgggaggacgcaataactattaccaatgttcatctatgttgtatccttgagattttcatcagggcaaccaacagcacttgcctgggataggcagatggtagaatcttggcattcagggctgcaagactcatgcagaaatcaatcctctcacatagacctggcagattgggaccagaatgtgaaaggaattcacccaaggtcaccctgtaaatgtgtgggagagacaaaacagagcacagttctgacgttgtcccacaaagattttacccctaagatattgttggaaatgcacctccaagggaggatcagtgtattggtggtctcccctcctcaatgctgggagttccaagtttccgggaagaaaagagctgtgaagcccttctcactctgcttggtcttaggagacctagtgagtcccagcgtccccacctgaagcccctgatagcctcctacccactacaatgtctgagtctgtaaatatcaagtccattttcaggcttaaacctcccagtccaaggcgctgcctagaagacacctcgcttagatctggctgaacttcaggggttcttctttccccctccgcagtgcacccaagatcccaaggtagggcagtttctctcagaactattgaccaaccgaaagggaacattcctttcaagctttctgaagactgtctttacctcaatatttacactcctgctgcttgaccaagaaaaacaggctgctggtaagttgtgggatcccctggtcaagacgtgtcatgccagtaccccagatattctagtgtagatcggaaggggatgaaggcagcttggggaggagctgcacaggccaggattgtttcaggaccccagggcctctacaggaaacacaggttttcacacgtcagtttcccctcgtgacatagggactctgggggagtttgctgtgcctctttatgaacatcttaattgttccaagttccctcatgataatagaaggatgagaatgattaccttagttactagattaaaaatctgatacccagattggtatcagagtgggtaagacatgatttcaataatgttagcggtcgaaggaacttagagaaaagccaacacctcaactcttcctttcagatagagaaaccgaggcccagacagggaaggggaggtcacccagtaggatagttttgctcaagtcttctgatcttcaaactagtgcttttgacacagagtagggcattgagattgttgtggcctttctccagcacaccaacatccatctggggtaactttcactgtccgggtatggtgttgggggcagagcctgggacaatcccagaagctcttccttttgcctttggccaaattctgggatttttttgtacctaatttccctccctaattgtgttggcaaagggtgatgaccaatgtgtcagcatttgccaaataaacaaacggcaggagatggggctggctgccagctgcgggttgggagtgtctgctggcaaagaaggccaccccaaggtgaaagaggaaggggtgtcggtccagtcagtctcccaggggcaccgtagcatggtgcctaggagtggcggagcaggtcgcgaacatgggactagaagttggccctacatgtgcttcgtgagacacaggaagtgggagaaggtttactcattaattcattcattcttctattgtgtactcagggccccatatacacattagacctggggcttcacggaaaggaggaacatgaacgcactccacactgcccctgcctcaaggatcttgccttttgtggggtagaggcatatcctcctttcagcatgttattgcaggcagcactcgggctcagtcttcacacaaagatgaatgcacactcaatccctccacaggagcaggcagggattagaggtgtgggagaaacaggagctctgggaacctgaaggcaggaaaactccaggaatggccacaggttctagaactacacgtgcttagaacagcacttcgtacatatttatgttatgagttcttttatatttcatgaataatattattacaatactattattttaccactctcacttcttccccactatgtggacttttaaaatgcaagaaccttgagttaggattgtacctactctcatcctcgggtattagcagagtccctggcacatagtaagttctcagcagtgttagtccattgattgaaggcatcctgaagagggtgggttttaggctgggctctgagggtggataggatttggggatgcagaggcataaaggaggcatttgaggaagagacacctcacaggcatgtgtgcttctcgagacaatcattcatgcacagagaagtttacttcaccagaaagagttaactgagatgaagctgagatacaagggctgccccatgggtacgcggagtgttgaacagtccaggcttgagggtgatgggagtgaggtggagaacatgaatccttagcgttgctatgcccatgatgatgttctcagcgtgaagagccttgcgaggaggaggcactggagctgggtagaaaggaaggggcagccagggtatgtgcagtggggtggtggcttgggccccattgggagaattatggaggagagagactgccttttgcaaccttgctgggcacttgtgaaattgggtaacaacctccctcagttgtgaccaacaggcaggtcaccaaacaagatgccctcgagtgctccctggccttgtgtcctgtaacgagtatgttgcttcccccctgcccaggtgaggtgtggatccacagaggggggctgatggtgggcaccgcatcaacctctgatgggcgggactcgcagcccatgaaaacgtggtggtggtgaccattcagcactgcctgggcatctgggattcttcaggtaagaaattagactctcctcactgcacctttggcccccaacatgaggctctaggaccagctctggtcatgtcagccctcaggagaccttaactgggttcctcattgtacagacaagcaccttcataattggacactacctaccctctcactccccagccacactagtcactagcctctgagcttttgtatgtggtgttccctctgcctggaatgcttagtctacctaagaattcctcttcatcctgcaagacccagcccccagttagctccactgaaagactcattccttttcatctgtgctgctcccacacattgcatttctctgtcatggcagctagcatgcgcccagctgttgaaggttgacacatctgacttctcatggaaaggagggaaggggcagagcatacagggagttcagggcatattgtgggtgaaggaatgggcgctgcagaaggtggggttgggagcatctgaccccttcctggaggagtgttgggacccactcaccccattttctgctgaaatctggcaagtgtgggaagcaaagatggagtcctcctcatcaggtctccatggggaagaagtccccatggcgtggaggaatttggtagctttgagagcttgtttggggaaagcatcaaacttaaagggctggtacattggaggagagaaaatggggatgccaagaatttttagatttttgagaatgtttttagaattcattggttataagcaacagtttcccagtgaccagattaagtcaagacggacgattggctaggtgtggtggctcatgcctgtaatttctgagagtgtgtggccctcactcctgctctggtggagaagggtgacgtcaagcccctggctgaggtagtctcccgctggatgcccccaaccccttggctctgtgcttctgaattctcagaggttattttgccatgggttctagctgatgttctcctagaatcactgaagcgattgggaggtagaggggaagccttgcttgagcccaggagttagagaccagccagggcaacaaagtgagatcctgctctacaaaaagcaaaaaattaagctgggcatggtggtgcaagactgtgggcccatctaatgggaggctgaagtgggaggatcacctgagcccaggaggtctatgctgcagtgagctggtttgcaccactgcactccagcttgggaacaaagcaagaccttgtcccaaaatcttctctgaaaaggagaatttatttttcaaggaaatagagatctgggaggatgggctttgtgcaaaacaggaagcagaaattacaaaatgatgggaatcctagactctgttactcttgttctcttctgtctctttctctctgtctgtctgtctttctctctctctctcaccctctacttctcctgtccctgtttatttatttgagaaacactctgggcattgattctgtccgagatcctgcaggggctctgggggcatgtgcgcttgccctgactccccgactgtggagcctgcctgctctcctctgtgcccttctttctggctgcactttgcttccaatctgcatgagcaccctatctgccctgagcttaaggactctccttggttccagaaagtagtcaggctgtctttcctgttgtaaaaatgagtgttttttacattagcagctctccaccccaattccaggtcacttaagagaaggctcactgtcccgtctttgcttcgatgtccctgaactcttagaaaagtaggaaaccaagtatgctgggcaaactgaccccaatgcctaggtcaggcagaagggaccctgtccctcggagggctttttaaatttttatattttttacatttttttaaagatgaaaagaggttcttgtgtattaattattgttactttgtggcttgactcaggacaaaggtgcagagaccatcgccatggccaaatctggatctatgcctgcatggcccttgagctaaggatgactttttttaatatatgaaattcaaatttcattgtccataaaggaagttttcctcgaacacagtgacacccttcatttaccttgtgtctctggctgtgtttcatgccaacagcagtcttgaagttgcagcgagaccacatggcccacaaagcctcaaatatttactatttggtctttgatgggcacattctgacctgtggcctaaagagtcatgtttgattactgcttgggactctagtacacaaatggcaggtggaaactcctggctgtgccacagatgcctcactcagctgagaaaccccatctagtcttgcaagggacgagaccctgtttttctttagaactcaccattaaagcacatttgctctttctgaagtggtcctgtgtgaatcatcttatctaggcctcctgcaattctgcacatcttattgtgtggaagacatggcactctcccacatgtattaactcatgaggtaggtgcagtattattaccatccatgagtggagaaaccaaggcccaaacaaatcaggtggactgcctgtgcctaatggctggtaagtggagcagccaggatttggaagcagacaagtaaattcaagatccatcatctcaaccccagctccacctcacctttcttgacacattcagcttgagatgatttgtccattttaatagagataaggtagcagagataagagactgggtaattggctcatactcaattgtgattagtaacagaggcaatgctctgcggaatccagaacccacacatgtgggttagagtttcttctgctgccccctgccacttgtacaagtcaggcttagttaggatagaactctttttccatattgatggagggaagggacttcgctcttgaactctgttgttgcttgtgtctttgcagcaaattgctaacactgttgggtgtgaaaccaccaactcagctgtcatggccactgtctgcggcagaagatggaagaggagctcttggagacgacattgaaaatggtaggtgcctgttcccgtagcccaaaccctgtaaacttggtcccagacttcttcatttcagctgcctcttgccctgggacagttacctggggcaatttctcaagtctcaggagtctcagtatcgaatggggaatctaatttgtccttttttttattgaaaaatgacacaaatgtaaaaacaagtccaaaaataacatgataaaaaaactgaccaaatttactatttgaccaaattttaatatttgccattcttgttttcagatgtatttttgagaaactaaacattacatattcccagggacaccatcattctgaattttggggatggagttattaagctcaaagattttcagaaagattcacaagttatcttggttgacttagaaactgtctgtattagacctggtagtggtccagtttctagattttctgagactctgactcagttgtcattctaggatagtcgttcgtccactcatcattaatccatctactatgatcttcttatgcatctatgtgttcactaattcatcccatcattgatatatttttatcaatctaatatcaacctgttcataactttttatttttctatttcaatctatccactgttcatgcatcatccagccaccatatatcttaactctatcacccattcctccaaaaccaacaatccagttatcacctatctgttagttttcacccactattcagtatccatccaattcaactgtactccagctattggtgaagccatccatccctccatttaccacccatccatccatgctaagtatgtaggggtgggtgttagaggtagtgaaacagacagaagtggacatagtccctgctcacatatacttttcaggttgagtatggtggcagcacagggggaagcattcattgtagtcatcaggggtgcttcacagagaaggtggacgagccgaattgagaccagacagcggaattcgggaattcatgcccttaaccctgactccaccttatcttcttgagaaattcagcattgagatcattgtgcccattttaatagaggtaacagagacagaaaattttgtaattggctcatgtcacagttccagttagtcagaggcaacacagttccagtaggacccagaacccacacctgtgggtctagaatatcttctgccattcctgctgtcctcaatattaggacttggggacctttatgattgacggacagctgtggcagtctctcaacacaggaagcccagcaggacaaacacccagatgacacagcacccagggccattgggaactattcctttgagggagaagggtgtgaattccaagctcatgagtagcctgatctctggaatccctcttggacctgaggctactcctgggtcccaggtccggctgctaccactggactctgcttggtttacatgggttgagtccaatgtggtcttggagcttaggtcttggttcaagctctaaagaccaaagtgttcaaggaattaaaacacaactgctttctaatgcctggaaggaggcaaaattccagcaattctgcatgtggcatcagaggacccagcttaaaaggaaaaacttggtaatttgggaaaatccagccctaagatcctgggacatccttctgagattttctgagatcttggggagcgcctccatgattacccactgcctccagtacacacacatgcagacacacagagaacacacacacatagacacacacacacagagaaacacacacacagacacacagagacacaacaaacacacacacagacacacacacagagaaacacacagacacagacagagacacacaaaacacacacacagacaaacacacacacaaacacacacacacacacacagacactcctgctagtgggactacaatccttaatggagagacctgcactggttacttcctgcgaacaggcagacacgtgagctacagtgcagcgatacaatcactgcaatcttcatgaacacacaccaagagaagcatggggtagggtaagtttcagtgagttgtatgagtcagagctgtgtaatggggatgagaaaactcccccaaggtgccttgaatggaaaaaggaatgtgttggaataacatcttgtgttaactgaaaaactcaggagttgacagtttcaggcatggctggatccagatgccattgaatgttattgagaatctaccattctctatccttcagctttggacaactctgtgttacttcactcttcagcagatacatcttctgggaaggttaaagacaacagcactctagagtatatcctatctgcttcgaaaccctctgtccaaacaattcctacaaaagttctggggtaactctattggattgacatggatgtatacctatccctgaactaatacccgcaatcagggaatggagcgccccaggtcacatatagatgcctgaattcatggagtgatagggaaagaaagaatccctgaaaaagaatgggggtattcttccctggggaacaggaaggggagagggatggggacagggaaggctccaaaagcaggtgtcctatccagagctgtagcaatgctggctcagattcctggcccatccttcccgtgccagtgcccactctttcgttctatgccttcaccctgtctcaggcccagcagagccagagtccggcccacttcctctgggcccagccagctcggcacaggagggagaacctgacacctctgctgccccactcacccagctcagtgttctcctgggagcctcttacccacatcctctgcttttgtcttcacagaatttctgaactctagacttacaggagaccccagagaggtaaggacattttgtttctcgattgcgggttttgagtcttagcactttaagctccaattaactataagtgaaagaatcctctctcgggtaattataggaactctgtgtgcttgatgctgaggcccagagaggggcagtcactcacctgggtaacacagccagaagactagtggctggcctggaacccattttcctgactcccagtccagtgctcccaggcacacctctgtatgccctgggctctgcccactcccctgcttttttacattttctgctccccaaatggcactatgggaggaggttgaaccagaacattccattatcgggaggcagagataaagggatgattagccacggagaggggaagcctgaatctcagtccaaggacactcaactcccccagcacacaggagtctccaacaatatcctcctgatctcctcaccacccccacctcccatgggttgacagtttctggtgacatcacctctgacgaatcttacaatcctgtcctctctctgccttcctggaggtcacagcactctcctaaatggtcatgggcggagtacacgagattatccagcaaagacttaataaacacttcctatatgccaggacttgtttaggagctggtgaataggagtaaaacaagaaagactccctgccctcttgggaccttccattacagtgtaggggagtgcaataaaaaagcaaatctagtatgtattctgttggatggtgtgcagcattagggtagagtttgcaggtggtttcaatttaagtagcaggatcagggaatggctcaataagaagtggcatttgagccaagctctggaggaggcaggaagccagctgtcaggaaacctggggaacctattccaggcagagggaacagccactgcaaagaccccgatggaagtggcaggtccagtggagaggatggagtgtggggacagactggcttgaggctgaagaggtaatgggaagtggagagggatcatttaaagtagttgcatttggattctgagcaagatgggaagcctttggagttttgaacagaggagtcacatgatcttagatttcacaaaggtctctgcccctggtgatcaatagactgtaggaaacgggcagagtggatgcagctgaccagctggcgggccactgcatgccataatccaggcaatggctcctggctgcttaaggctgtagtagtggggatgggaggatggttggagtctggatatctttgaaggaatagctgagaggattcgctgatggacaggatctaggggtaagaaagggagaggagtggaggatgtcctgagttttcgggcagaagcaaagcatacccacacagggcagccacttgaaaactctaagtggacaacaatcacttgtcattgtgctgatggcagtcttcccacttggctgccacccaaccagggcaatcctgtctctctcccaacttttatccttttctacttcatatcctctacccaattccgtgtctcatggtgcagcagattggccttccttaacagagttagagtgcgtcacccccacttcttaaaagcctgacctccttatgagacaaattcccttccctccatggagttagtccttcaaaacacacctgcgtcgcactatgtgccagactatacagaaggtaggctctgcacctgtccctccctctaaaactgccccacgataattttccaagcccagaactcctgagtgtttctggaatttaccctgcaagtgatatctatgtccctttgctcacgtggttcccgttttttagaaattctcactccttcctcacttgtcaataccagtcactgcccagagcccactgcaggcaggcggcacctcctcacgtagcctgccctgcatcttccttgcagagaagctgctcctcttgctggcctcccacgcagccctgcctgaactgcacagcctctcaaggaggccggacttgcaccccaatcctgttcgtattgtcagccatattggattaggatctgcaccttgtccagctggttctggtccactcacagaacatttcccccaggcagcccgaactagctcgtcattcattggcttttgtagagagaacaaaggtcctggaagccatagggtctcaaaaaagctaggaattgtccagttgcattgatatctgggagggaaatacagcccatagggcatggagctgggaagatggcacagaggctggggtctatgagagggacccacagcaaccctgctaacaagtaatacctaacagttatcagcccttccagacaccaggtgctgcgctaagtattttgcatgtgttcagccatttaatcctcacaataactcacctcttagatgagaaaactgaggcccaaacaggtgaaactcccaccagtaagtagcagagccaggcttcagatccagttaatctggtttcaaagtccatactcgttttaactgtacccagaaccagctgccctgatggcaatgcgtgaatcaggctctcgctatctgtgaccatacaaaaattattcatcaaaggtaaaacctaaaattaggacatggatcatatactgtgagttcatcactgattcttttattcatgattttctctctaatagggaatccgtcctagtctaggctccttgagtgatgagggttccgtacctcctcaaagccacccatgatcaataacagctctcatttaaatagagatagatagcacaatctctcctcattaatcatgattctgcgtttataaattcacctgcttcctaaaatgtccttataacccccaaatcgatctggtggcactttcatggtcacacacaggcaggtacagagtaggggaatctggatttgctgatgggcacgttccatctgagatccggcaaggcaacctctgtcttcttgtttcatctccaagctaacaagtgtcctcttcgtggtcaatttagtgccatgtgttctgcatttttgtgtttttctggtgatgtcactgttcagagttgcccgcaagagtagcgctgctgtctagtgtcctgagctaagcaggctgtgctgtgccttaccgggaaggcgcctgtgtgagataagcttggcagtgctgctggccatgcgttcgttgttgaaaaatccacaaaactgcacatacaggaaaggaggaggaaattggccagttcatacatgaggctgtgatgggaagtgctaaagtaaccctactgtgtgtgatgcagctgtggaaagatggaaaagaaactgcattgggagattcatagatgatgaaggaatttttaaaaagcaggatggacagcactgttgtgaggttgaaaacagaaatttacactcatcttacccagggtcaaaaaatgggaagggcttttcagctggtgtttattaaaagtaatcctacttataattaactctttgtaagacttatgtattatataaagttctttcaacagaaacccacacataaaagaaggttgatgaaaatgttgtggccagaggttgcaagaacctaacccagtatttcccctttgagtgaagaccctgtattctctaattcagcctcgtgggagctttgtcggaagcaactgctgggactaccgaaaacaactgtggacacaggagggaaatgcatgtacttcaaattgaagtatatagacatgtaattttatatagataatcatgtatttcagtctgagtgaagatttcttcctctcctcgtcacctgaccagtgtcagctctgcctgaagttctgcccctgagtcacacatctatcctccttagttaggaccctgtgttgcatacccatggcccaaagtcacgccggtctagggtgctggtctcaccctcagacaggagagttggggacacggttgtgacctagggtgggaatcacaggcgctgtgttgctctctccccagagttacccccacacacccacggtgattgatggagtggtgctgccaaaaacacccaggagcttcaagctgaaaggaagttccacactgtcccctacattgtcggatttaacaggaggaatttggctggtttcttccaacagtgagaaggcgcaggcctcttggagggactcaccacccccatcagccctcccacctctgatcccaggagtgcttccctctccaagcactgcttgagtcctgggcagctgttcccttcagcaggagttaacatttccatggaaaccttctccggagggcacagttgtcaccgggatatcagggccctgggatcccctctccccagactctcgattgtcttcctattgaagaatcctgaagtgtctgtgctgggaggaccagtagataaaaaactgtgcagatgggaaaactgagggggcctaggaggggaaaggagttgaggagtccgggaggcagtcgggggcttcctggcttcccactttgggctgggtatgcatagttcccccataatcactcatgctcttcatcacctcattgaaaagatccaaaaaagtggcttcttttgattcccattgacttctagggaacagtagacaccagggtctacttgagggatgacggtcagagagggtgaggatggacaagttacctaatcgggtgctgtgctcaatacctggtgacaaaaaatccatacagcaaactccagagacacaatttacccatgtaacaaacctgcacctgtaccccaaccctaaaataaaaattgggaataaaaagtggaagaaagaaagattgacttctaaattgaaaaagcgttctccttccagtcgaggacacacaaagctgaccatgattaaagcagaggacagaatttattcagtaacacaactgcacagaggaaagaagagtccagtatggattgactcaaatccccaaaactaactcctggcactgttttaaaggctgagtgtgcaaaaggaaggcactgtgtgctgtggagagggacttggtccatgtgactagaccgcctggatgtcttatcctggctcacctggggcagaaacaaactcctcttatcgtcaggacaggaagccatgcttagactgcaggaagaacccactgaagtcaggctctactctttccacagggactgggaaatcaggagtcagctccctgaatgtttgcattgcaaagagaaggctctaaggccctcaagaaatggggttgggtggtaaattccatcccaaagggcagagaaagtgtttatcattgcagcttctaaactaactgctctagttgggttcaggggcctgtctgcttctctccaggttttgctggagcagagtaaattgttctggcagagttgagccttcccaggcaagcatgttaaggaactggagtcattctagggacacagccttaagctgctagaagcgatgctagagtttggtcagtctctgagtgcagaggtttgggcagagttgttttgtgtgaagagatatgaagttcgccctcagaaggatttcagaggttataccaaagaccaaagccatgaaggcaggctctaaggtttcagtgtcatctgtgacaggtgggggtactagggaggtctgcatcctcttccccagaccctctattccacactggcttggcagacaccttccctcaccatgtcactggccactgtagtatcccagcctgacacacacacaaaacacacacacacacacacacacactgcaaaacatgccacagcttctccacatttttttttttttttgtaatctttgcaatgcttgagtttctgatataagcccatttgattcattgattttgcccatttcagtaaaaacccatgcctttaaagcccaaaatattggaggactttcagtctgcattgatttggttggttcgtcagtttgttcttctcgttaattcccaatgattcataaatgcttaactttttttttttttttaacagttatgagctatctactctccgaagggaaactggaccagaagacagccatgtcactcttctgaagtcctatccctttgttgtaagagtctaggaatcacgggaattggctaggacccacaggcgacaaggattgcccaaattatagagcaattaaatggccgaatgaagactggggcctcgggtttctcccatctttccacctttcccacttcactttccaccctagcggggagttgcaagggcttgtgggattcaccattgaggcagcccttcctggtgggctggagaagctacatcctcaccagggggtggttgtcactttattgatctattttagcgcattcctaaggaattgatccagaagccattgagaagtacttaggaggaacagatgaccctgtcaagaagaaagaccgttcctggacttaatgggggacgtactgttcggtgtcccatctgtgactgtggcccggaccacagaggtgagtcctagaggtcgaacaggggagggatatggaccccaccagcttctgatctgactcacctacctcccagcatagacagatgtggaaacagccgagggtcaggcctcaaggctgattccatatggcatgggatgaggtgctgtcttattttggtttatgccagtagagcctgtgaaaaaaaaaaccagaggcaagcggtttttttaaggtggtgatcccagatatagcagtagggcggtggggaagtgagagaggaaagagatggaatccaatccaaggtgcctgacaagggagtatcctctgtggacaactggagctgggaaactcaaggaaacactgagaaacagcactcaggggcatcccatctgagcaccaagggagctggggtatttatccaccagccccacttgtcattgtttgaaggctcttgcaaggagttgtttattccctgtgactttgactgctgcacacaagggcagagtagtctcttgtgaccagacaaaggcctcaggccgggagcgcagatgctggaggtagaagtcaggctggcatgcccaggaagaggggatatgggtgagaactgacagcatctgctgcaagggctccatgcctggagttatcgtgggacatagggctgcgtaggacaaatattgaaagatgagtcttggaaggtttttaaggtccaagttggctgcaacaagcttgttaagcattggagctggaagaacaatgggagtcctgcacaggatccagaggttgtccaggaccaagaaggccaaaagtaagagctatggtgggtgtgggggaggtggtcgaagaatggcaatgtctgaggctggcttttgtctatctcggtgtgtgcaggaacatgcaacacagtgccaggacagggtctatgcaggaccttctaccactgacccaaggctgtgtgggggggcatgaggttagggatgcgtgggctcacctctagagaagtgtcttctcctgggtgcaactagaggaggctcacaggactcctctttttcttccagctctcattcgcctagtctgcagccaggaaatgtcctctctctaaccatgctggaagggtttttaaatttggaacttcatagctaaagctaaagctatagctaaagctgatgtcgcaggtgcccagacacacctttgcaaggaaggggcaggtgctcataactctcacttcttcacaaagtcctgataaaaccctataccaggaccactggagttgaatcatttctgtcttaaacttggctttgccccatgttctgctctgatctatatatagtgttcccatctccatcttccaatggtttgagcaatactgaaccctgtttttcatctgatttcccataactttgagttcagagttttttgttgttgttgttgtgttgtttgccaggactacacagatcttatcaactttcacttattgttgtgtctcactcttttgataaaaacaacatttctgaacataaagttaatatgttaaagttaatatgaagaaatttcaaaaatatggaaacacgtaaagaagaaactacatatcactcctaattcccccaccggaggcaagtggtataaatttttttgtactttcttctaaagatttttcatgtcctatatctttaaaaatcaattttatatttcgcttttgttcatagaacactatgttgtgaggatttctcaatattcatataaactcatcaaaacattccttattccatgaaatggctgtgttaaaagactttaatattcctatcctattagatgtttagcctggctgctcacattctgatactaaataacactgagttcagcctaatgtttataagtctctaaccacatgtctaataattttctgggattctttttagaagtgaataactaggctggaccaaagaaatatttttgaactcttgcaaataatgcaaatttgcattccagtgcataagaacgtggatttcttaatttactttccatttgggataccaaggttaaaagttaatgctgccaatttgccccaccaaaaagaagcaatcaccctgtattcttttgcatgtctttcatgacatgtctttcattgtctctgcttctctcttgtgcctatttgtcattgcccaaaactgtgccctactttcctctgaagacttgtgtgtgactgtaggaattctatgaatatcaatcactttagccaaaaaggtttgacaaagtacttttgggcagcatgctgcctataataatttctatcattcacaaaagctctttcctctatgttggctctgagttcctttggaaaatgtttgaatggcaaaggcaaggtcaaaccctcctttagcaagttttgcttgaccttgaagcagccatttaacaggtggattacagagccacagaggatggcatcttcccaagtgcgcttcctgctgagccaagggtgcagtgcaggaggctgcaaagatgagtgaatagattattcttcattcttacattgaaatgacatgtgcgggtgggcgtgaggttagggatgcgtgagctcctgttgttaaatccttttgtggctgaatatttaaaatgttaagaaatgatggctggaggtggtggctcatacctatactctcagccctttggggactgaagtgggaggattgtgagagcctaggatttcaagatcagcctgggcaacatagtagatcctgtctctacaacaaaattgttttcaaaaagtgatgatactatattacaaaatacatatataatatcatcccaagtttatatacataaaagagagatatgttaaaataaaaaaaagcattctctgtggtagagttaccagtgatgttttaaatttgatttttaaaatggttttcaaaatgatttttaaattatataggaggtggaaaattcaaagtgctgaggcacaggacaggtggcccatgatgtagcccagaaggggcagtgatttgtggctccaatgagccaatcatgggaaactggcatcttcttcgggctggaacaggagagctttgttggtgggagaggaggcagagcagaaggagagagggcggggagaggcaaggtcacccttgctcagccccttctttctctgccatgactttactgccttaacaccctaacactcccaggccaggcaggcagcaagcacatggagacagtgagatataaagcagtgagtgccgcagattcctgagacacaagaggagattgttccctctctgcatatgtttgtatttaagtagcctcatgttcagacaagcaactggatttgcttcagtcttctcaggatgggtgagaaaaacactggaagtgctcaaaatgaggagaacagaagacacctgtcagagtggagatggcgtccaagtgaacgaagtctgttataatgaattacatccagtgtaaccagatgtagagagattgtcttgtgtgagaatgtaccacaggcaaaggggtttacgaggcagagtcagtgtccctgcactggcagttattttgaatgattgacccagggtttccacattcattcattaaacatttgttcattgaacaaatatctggtctaattccagttccacctcaaccagctatgcagcccggagcatgtcgctgagctttccgtgactctgtttctctactgtgctgacagccagaggtttcctgcagagttggagaccttgtagcctccaggtgtgtgtctggcaacatgaactgtgcatgaatccttgtcttctcagagctggagcacccacctacatgtatgagtttcagtaccgtccaagcttctcatcagacataaacccaagacggtgataggagaccacggggatgagctcttctccgtccttggggcccctctttaaaaggtaatggctccttgctctccgtgagcttggagttaggagatctgggttctgtcttggtgtggtggctttcagcaagtttcttctctcctggtcttagtttactgattcctataacagggttgaatgtcactgggttgtcccccagcttcctcccactctaacatatggaggcgggatgtgtattcatgtgccctttgcacagccactcagaatcctgctctgtgactcaacaagacgggtgtgtgtgggggagtcttctgaaggattcactatacagggttgaattcattaggttgtcccccagcttcctcctgctctaatacacatgacgggggatgtgtatcatgtaccctctgcacagaaactcagaatcctggcctgtgacatcaacaagacaggcggggggtgtctcctgcaggattcagtatgacagagttgaatgtcatcgggttgtccccccactcctcccgctctaacatacctgagggaggatgtgtattcatgtgccctctgcacaggcgtcagaatcctgttctgtgacatcaacaagacaagtgtttggggggtctcctgcaggattactatgacagggttgaatgtcattgggttgtcccccagcttcctcctgctctaatacacttagggaggatgtgcatccatgtaccctctgccacagacactcagaatcctgggctatgcatcaacaagacaggtggtgggacacatgcaggggtgctctaggttgagaagccaccaacaatttccctctcccaggagcgctgagaatgtgagtgagggtgagattagagttggtgtaaccctgagtcaggtctaatgtgtgtcggtttgtctttctgtctgtctctaacaaaaaccataaacctttacatttattacatttaataattgttagtttagaaatcacaggattatgattacggtttatagtcagcaggattcactgtgacaggattgaatgtcattggcttgtccccagtttcctcctgctctaacacacatgagggaggatgtatatcatgtgccctctgccacgacactcagaatcctgggccgtgtcatcaacaagataggcggagggacacatgcagggcctgctctaggttgagaaaccaccaatcaatttccctctcccagaagtgctgagaatatagtgagggtgagattagaattggtgttaaccctgagtcaggtctaatgtgtgtcggttttgtttctgcctttatgtctctaacaaaacctcataaacctttaaatttaatataattaaaattgttaatttagaaatcacaggatgtatgaatttggaatgggagaggagactttattttgatgtggtttatagtcagcaaagttgctatccctcaagctgggaaggtgcctctggcaagcccagaaacaggctcatcgaacgaggaggggttgggtagaagctttatatgaacagttggctaaacatacatgttcaacacgttacagggggagcaatggatattcatgaagacatcctgacacatgtgtattaaacaaacatgcatgtaacattgcccatgttcacctggtgtggagacctaatatttaaatgtattacaattagggcttataaatccaagggtcttctcagacacaaagcccagcaagtgagcagcctctgtacaccggccaggtccagtccatggctgggatgttcttatctggagaaaataactgaaatcagtctcttatgcaatcaaagccgtagtaaggctggtgggcagggttctgttcttccgagtatccaagctgcagccattttaattgtttcattttgcttaactccaggccagtactggtttagctgtagacaaaaagaagcaccttcagcagggagaacagagtggattctttaagggtagagatgcaggcctgaacccttgcccgcatggccttcgatctttttttaatttggtgtcttattgccacaaggagtgtgttctgtagaatgatcacctttattttattgctgatactcgtccggtggtgtctaaaccacaaaaagggggagtatgatgaggcgtgtctgacctcctatctgtttccaggcaggaactcagtttgggtttttctggggtccccttagcccagagagggtctgttcagtgagttaggggtgttagattttatttttagtttacattatacaatatttttaaaaatcctttcatgatgtcttctagccttaactctcagctgttacagatcacatgggactcaccccatggctgctcaggatgaccatcgccactgggcatgtcccaattatgcacccttaggaggcttgagttctgttatattcagaatgtgaattgtgggtgtgtgcaagagagagcaaccctgggaggtggggcaagccatggaatgatgcatgcccattgctgagccctaggtcagccatgcttaaaggtaaagtaacacaaatccaccaggatcttctaaatgtgcagacctcagctcagtgggtgtggagcatcgccaagactatgtttctagcaggtttgcacgtgaagttgacaatgcaggtccgcggacacactttgagtaacaaaggctttttttcttcttccccacagagggtgcctcagaagagggatcagacttagcaagatggtgatgaaattctgggccaactttgctcgcaatgggtgagctcttggcaaagacacagcacagctggtgagggtggggggcggggcatgcctattgggaggggcagcttctaaggttctagcgatcaaacttctgaccctgtgaccatagcactctgaaatgagagctctctacaaatggagaggccgcccccggagatagtgaactccccgtctctgagatatacaagcctcttgacggagataacttgggcgtcctcacacatctctgaagattttggggacacacagcagctttggggcaattctatttgattttgtttccagaaaccccaaggagaagggctgccgcactggccagagtacaaccaggaggaagggtacctgcagattgggctaacacccaggcagcccagaagctgaaggacaaggaagtagctttctggaccaaactttcgccaagaaggcagtggagaagccaccccagatagaacacattgcgctgtgaacggaggtccatccagcctcgggaacctggaggagcaaagactggggtcttttgccaaagggatgcaggttcagaaggcatcttaccatggctggggaattgtctggtggtggggggtaggggcagaggtcatgaaggagcaagttttttatttgtgacctcagctttggcaataaaagatctttgaaagccaaatcactgcttgtgtcttgtattagagattaatccatcctcctcagagcagaacgatgatgaaagaggcaatgtgagaaggaagctggctttgctggggatggcctgcctcaggacgagtacagtccagagggctgggtcatggacagtgctcaggggagctctggcctactgcatgtttctgagcccccaagaatttccaacaataggatttaggattgccagatgcagcatccctatcctccatttggatctgcctatggaaatggaaatggcccaggctgaaatttgcctggatcagggaagagagagaggtgccgaggtgatcccgtggcactgttggaggcctttattgactcttgcacaggtctgccacaccttcctcagtatgtacactagcctctagacccctccctgaggctgtctctttcaacagctggtctaaactccctctgtaacctgaccacttctgttgcgggcactgaccaccttagagcaagtctccagagggtcatcctaatctgtgtctttcagaatctcaggggtgatttctggattctgctagaatgtggaaaactctaagagtgtcactcctgccttatcagcaagagaaaaagctggattgtcctcaaaatcatacttttcctattgcccaggagaaagattggggtagatagtcagactagagagggccaggctggtggctcaagcctgtaatccagcactttgggaggccgaggcaggcagatgataaggtagaagatcgagaccatcatggctaacacaatgaaaccccgtctctactaaaaatacaaaaattagctgggtgtggtggtgggcgcctgtagtcccagctactcgggaggctgaggcaaagaattgcatgaacccgggaggcagtgcttgcagtgagccgagatcatgccactgcactcagcctaggtgacagagcaagactccacctaaaaaaaaaaaaaaaattcgccctgggcaagctgcaggggagggtgggaagccgactcaggccctgcacctgggtagctgccccacctgtgctgccccaggtaacgcatgtacaggatgagcctcccttcccccagcagggacagatccactcagtcctgccccgcatgctctcctaaaagtttgtatcaagactgtgcctcattatccctgcgatgggaagggctggggagaaaaaaacctaccttaccacttgattgtgtcaaatacaagggaattcattgcaaagagcttgctgtgctccatgaacggggtggagctcaagctgaaattaaaggatgggtaggaagggggatggccagccacaacgtggtggaagtgtgacctgagcagtgggggcaagggggccagcccacgggcagcagggctggtgttggcaaggtgctggagcacaccgtgggtgcctggaggacagcttttctaccttgacatgtaggaaacaacttctctctttataggaagataatgccataaaatgtctgtctacctatctgtctatctttatctatctaccatctatcaattatctatctatcatctattacctatctaatctattttttcattaattacatttatttatgtaattgtatttcaagctctatttacctcctgaactttcatgtgagagactacattttattcaatatatgctttaggtaagtttcagttggattttcttagtacatatgacagagtcctgattaaaatcattgctgcatttgatcatttatatttatcctgtaactataatttatgtgatcaccagtaattttatctgtatcaatcttgtctctgtattagataacaggttcttaaggtctggtacaaacatttcagttttttattgaacatacatacatataagaaatatatatatatacacatacacacaaacacacacatgctatgtaatattatgacttgataacttcactaactgatcacactgtgtaattaggacccagatcaaacacaatattaccagcatcccagaagccacatggagctcaattccaggccctgctcactccccctccttgcctatctacccaaaatggtcaccacagtcctgatgtctagcagcaatattctttttccaggttttgtgctttatatgaacagaatcacatactcttgcatctggttttttccctcaatattatgtttatgagattcacgtgtattgttgtatatggctgtagtttgcatcattgctgtatagtcattcattgtatggatatgtcataatttactggtgtagggcattggagaatgtattagtctgctcgggcttctgtaacaaaataccacagactgggtggctaattaactgaaattcgcatttgcatagttctcaaggctagaagttccagaacaggacacatgagaaggcagcagtctgcaaacaaggaggagagccctcaccaggaaatcagtcagctaatcaactaaaatttgcatttgcatagttctctaggctataagttccagaacaggacacgtgagaaggcagcagtctgcaaacaaggaagagaggcctcaccaggaaatgagtcagctaatcaactgaaatttgcatttgcaaaaaaggaagagagccctcaccaggaaatgagtcacttaatcaactaaaatttgcgtttgcatagttctctagactagaagttccagaccaggaacagtgaggaggcagcagtctgcaaacaaggaagagaggcctcaccaggaaatgagtcacttaatcaactaaaatttgcgtttgcatagttctctaggctataagttccagaccaggaacagtgaggaggcagcagtctgcaaacaaggaagagaggcctcaccaggaaatgagtcacttaatcaactgaaatttgcatttgcatagttctctaggttagaagttccagaccaggaacagtgaggaggcagcagtctgcaaacaaggaagagagccctcaccaggaaatgagtcacttaatcaactgaaattcgcatttgcatagttctcgaggctagaagttccagaccaggaacagtgaggaggcagcagtctgcaaccaaggaagagagcccccaccaggaaatgagtcatttaatcaactaaaatttgcatttgcatagttctctaggctataagttccagaacaggaacagtgagaaggcagcagcctacaaacaaggaagagaaccctcaccaggaaatgagtcacttaatcaactgaaattcgcatttgcatagttctcgaggctagaagttccagaccaggaacagtgaggaggcagcagtctgcaaacaaggaagagagccctcaccaggaaatcagtcactgttctcatttaatgttctcactttagaagatcatgcaagggacaaaatctccagaattttcctgggcggggtcacagctggggtgggaaagttgtagcccctctgaaacttcccgctagctgtccttctatggaggccaggagcgcatcggggaaggtacagtccacagtcccccccatcccaccagtcaggctccaaggggtcttcacatccacaaaacaccattttcatagacaatagcacacacaccaagatgcgcaaattcaaaccagatacccaaatggcactcacttttgaatttgcaaggatttttaccactactcttttggtggtagtgcctagtggcaagaattagaaaaccaggaagtattcagcactgatgtgacagatcagtagctcctgggatttgggagaattttgtgcagtccagctttttggagaagcttatgtcatttacgcttgctgagtccgtgtaagccccaaagccaagctttcacaagctaggacttaggcagctttgaaaaggagagtttatcttctaccctctcaaagagggtgtaggaggttccccttgagagtaaccactggccctccagatggcttggctgcttctgccaggctctactttcagaaatgcccttcattgtcaattatcagaattaaagcctttcagtgtctcctcattgtccagggatgaagtctgttcccttggcttggcattgaagctctctgtcctccattcccccttccattgcaactggcctcccaagaagcccctgaatctgccttgttccaatgctaatttcttctctgcctctccaaatttgcccatctctcaatacctggtaccatcaagagtcatcacagctttgggcattaacattatgaatattgatagttctcagggcaagaaaacacacagaacatgcatctctatggaggcactctattcacctggatgcttataatgtaatctgtagtttgagtttccagggctctttcagattataattcaatcttcacttttctgtgtctaaatttttacattgctttctgaatctcttttttcccattttattcttaacaggctaaaggaaggcttaatagagtagccctaataataggatctgggtttataatcgggcttttgtgatttgaatcaaagaaatgcaaaaactagtgtttatcagagtgtgctgcacttattcctggagttatgcaagatcattttagatggacacaaactaaaaaccacttatagaatggctgtttatttattttgctgtgtattagggaaaaacccttactatcaagtccatggtttaatggatattacctgtgacaacgattgctggagtctgttaaaatctgtcccaccttccttggtacacagccagattacattttccagcctcattgcaattagattgaacacgtgaataagttctcaccaatgtcctctgagtgggagtgagagtgccacagccaggcctggcccatacaaatgctccatggtcacacttctgctcctgctcttccaggtgacaggcaattgacacctatggcaactttagaaaccatgagtgaaggaggcaaagccaccatagcctagatcaggactgagtaaactacagcctgagggccaaatctgcctactgtctttttaaaaataaagttttattgaagcacagtcatgcccattggcgtagtattgtttatgggccgccttactaccacagcagtcgccacagacagcccatggcctgcaagtccaaagtccttactctctggccctttatagagaaagtttgctgatatcctaattttatctctgaatgaccatatggacaacagccaccttgttgacctgaacaacgttctagtccttacctatgcgaaaaataagccgttgaaattctgggcctatttgctaccatagtttacctactctcactaataattcttgctcagcagtcacagggtgattgactgatgaatgtacatgcccgatttccggttgtttgcgccattgagggtgactagttatgcccatgggagtacagtctctcctctaagacccaccaccaggccaaaatttcttccagatgctctgaccagttagcctaggacctgattgaccccaggtagtctgaccccctaaatataacatagcatcatgggctgggaaggtgtaaacataatacaatttctgcccattgaactgaatgttaacaggaagaattccctgaagcagaagaaaatgaccttggtgatgatgacccttgccaaaggtaggtgaccttgccaaaggtagttaacccttgccttgtcacctacctggtggtcctgatggtgatcgttctttcatgtaactaactggccttcaatggttcacttttcccattgagtgactttttcaattatatgcttttgtaaattagaagtgtttttactggcatttctttatgcacgttttatttttaccatcattttaatttaaaaaatgcagttacacattttccatgcatacctctatttatggca

SEQ ID NO: 5115 - DNA, 11941 bp, Homo sapiens
tacttccctaactcctctctttacttctttggcccgttctttctgccacaacctaccacaaagatcctgcttagaatgaaccaaggtcccaggggattgttgcataggcataagggttttcttggaagcctctgggtttgttgatacagaggatccctatggctccttgatgataatcagttgtgaaggtatagtattgagaaactggtctaaagtttttatggtatatatattttaattttatttaataaatatataaaaagcactgttctatgtgttttaaaaatactaacacttgaatcttcttaagtactttgtggagtaggtaacgttattattccaatattacagatgggaaactaagaagttaagtaacttgcccagagggtataaagaggaagggacaaggtgatgttccatactttaaaggaaccagattatcatatttgtagaaagaaagactacattttgatctatcccaaagagtgttatttgaagtaattagactgtgtagctctgaaagaattggaaccgcaattcaaaacaatttaaactgttctggagacaaagctaactctctggtggggttttttcttctgatgataaatttgggggtcacttaatccaggacagttcctgcatttatggaaatgagcatatcgaggtaggattaaagaagtgaattcattcattaggctctatgccatctggttcatttttttctaaagctgagccaagaacatctgtaccccaattttttattttctggccaaaaggggacaaataacatctcacactaagaacattaaaatatttaccaaaggtctcttttagcaaagaatatttcttcattgcaatgcctctgaacatcttcctgaatcaattatattcatctaaacttttattttctatgactaagtaacagtaatattcataatagcaacgacattcagtgagctcttattctgtggtcactgtttcaggtgttttacctatattctatgtatgaaatagcacaacttactctgattaactcaattttattggatataacagttattttcaatttctattatgacaaaaaatgttttattaatcatatctatagctaaactatgtaaaatgtttgtaattatatccttagaatcaattttcagaagcagaattgccagtgtaagagatactttaagaaaaaaattcagcacattttaccagttttcctgccaagaatgttataccatctatattcccaccaacaatgtagcaagacttttgtgaaaagtttttttgtttttttgtttgagatggagtcttgctctgtcacccaggctggagtgcagtggtgtgatcttgcctcctgcaacctccacctcttgggttcaaacgattctcctgcctcagcctcccgagtagctggactataggcacgtgccaccacacctggctaattttttgtgtttttagtagagatggggttcaccatgttagccaggatggtctggatctcctgacctcgtgatctacctgactctgctcccaaagtgctgggattataggcgtgagccactgcgcccggtgtgaaaagtttttaaataatgaattgctagttagcaacctctgagttttttaaggtgttgtctagcagtctttataaaaaaaaaaaacagaggtccaatcacctatttccttagaagagggaatcaagggtatattcagtctgtctataatgcactgctatgtaattactagggaaacttctccaaaagtcacatgggtaaagtgttataaattctgagtcataagtaaagtttctactatgtgagagactccattccctgttgtcactgagatcattaaggtctcagttcacatgttacctttgagagaatttttcctattatcttatctaaaatagtcttcccaaggtctattccattactctgtcttttttcatagcacttactaattatctttgtttattactttattgcttgtctccccattatacgtatgcttctgggagtcaggagctctttcttataccagcgattttatcacaagacctaaagagtgcttggcacatgaaagatgtctatatatgatgaatcagtgaatgagtgatgatgaataaatattggtcctcttaaatcccaaagtcctctgtttactatttatgcacagctttagtctgtagtacaacactgttaagagacaaaatatgcatatggggcaaagcaatattgtaactctaaggtactcaaccttgtagatgaagataagtgaggaagaaccagttattaggtatcaatggcattggtcatttggttataagcgtaagtgaatttccccttgaatttacctgtgagttgctatttaatggtgttggacagttacagataagtttggtagaacttttctcttgtttccttaagggttttgcctttgggtaaccaccttaatttcttcagtccctgtcttcatggataaagtcttagcagagctattaaagatcctaatgtcaacttctcttaagattaattgtccattaatgggtgttctgagagatgttattttgagatcaagtgctaaagatttaaatacacactttaactgggagaatatgcttgtttcactaggacagatatgtttctctatgtatccccagcacttacagtaactggcacgtaggaagcattaagaaaatgttgaataaagaacaagataatcaaattctgtcttgtgaagaaacccatttgggatctattatatgttcgggtaattcctctgagcatcagcgaggatctgtgcaactaacactctggtttatatctatttgaactgctgattgtgggcagtagaaattatttcagtagaaacttagctggcttgaattatgagatattattagtctcattaagaaaaatgtctaccgacttctttaggaagctcagtcttcagaaagtttctttgagatttcatatagaattccttggttttaataaacgttccgacttctgcatatttgctattgatgcaacaatgatgcttggatcaaagttactttgtcatttctaattcatttattttagattactcagctagtagaaaacaatagagtcactttgttctgtaaagtctcttcgtagtatttggtgggattgtgctattcttcagtgggctggtaatcctataaagcttagagaaacacagggctctttaaacgatcctttttctcttttctgtttaaatttcatcacttggttatttttgccacctgcttggattgcctccttacccaaatctaaattcctacagtaaaataaatagaaaatgtggtcgctactctccttcaaaataatatttcatttctttggacaagtatgttaatttcttcatatgcagttgtcaatggtccaggtttcgaaccaaatagcctaaatttgtgtctggaccccactacctgctattattgactttgggcaactagttaacctttctgtgcctcagttttctcatctttaaaatggggctattaagagtcttctctgtattgtcattgtgaattatgaatcaatacataaaatgagtttagaagaatgctggcacttcacaagtgctcaatgttaaattgtttttattgggaagaaatgaaaatactccttgcttaatgttggagaaaagaatcactaacccatcgcatctctaagatgatgatgaaattgcagttgccatttattacatccctactgtgtactaggcactgaattcaatgcttttccaccttatgtaagtgaaatctcacagcacagtgaagtattattattattccatgttacaatgaggaaacaggagaccctaaaaactgagttctttctctaaggttaaacagctcatagggatggagttcagatgtgaatccagttctatctgattttaaatcctgttctcttaatgttatgtcatgtcatctctacagtcttcaataattgagacttaatgttctttgattactacatccagtggctattccaagggaattcaaaacccttgtcttcatgactttcaaaagcacccaagtcctgaaaacaacatttttgtgaagtatattagtgtaatccaaaacatgataacactttttaaagatatttgcagataagactcccctaccctcactgttacagtaacagtgaattttccctggtattgctctgaacattaaggaattaaaacacttgaggctggacttgtaagagacctatttttgttttgttatgttgtaatagctgttgtttctgatatttttcttttccttcattctgctttttctttctccaatcttggcttaaagggcaacttcctgtgcatgtcaggaatctgtggcaaagggaacaagtatgataatttgtctgctaccatttggatgttctattgtctcagcagccaggaaaacagacagagcccctgtgagcatcattgtgtttgggtgcggctttagttgccaaagtgcagtttttactgttggcatttccaccacctgctatggcaataaccatcgaaaggacaaatccccttgtctgtgatttttctttctaggcttctttgagaaagactgtgaaatgatttattcctctgtacatatgaagctatagtgtattctccacgcatagttttggcctctgatactctctgttcttaggttaatccattaacttgcctggggaaaagggacaggaaagatggatgaaggtgttatgaaaacagagatgagaaggatcttaaaaatcccaaccactgccttttcttccctgttcccatctgctcctgagaagtccttcagagatgccaggcctgttaatacctatactttatacctgttgttttaaatgaggcagttcttctcactatatggatataataaacagttaagctgtcttcctctatgcccctcaaaaggagcaaacacacaagccctacacaaatggtatcgtgcccaaatgagtgttggaaatgctggaaaaacaaaggtaagtaggtcttttcattgcaggccttctcagagccttaaaaaaaaatctcactcatattttgaatctctaggagagacatatagtatacaacattctccaaatttgttgaccttggaatgcttttttttttttagaagcaacttgagggacaaaagttctgtagaaacgctttggagagtattgggatagattactttcattgcatttttgcaatttggtttataacttaccttggagattgggcaaattggctggttagtttagatacaatatatttttttcggttgcaattgtatttttacagtagctagcagaagctgtggttctgaaaagatactataaaacattatcttgtgttctagaaaatagaaaatactctattttcttccccacctccattttcccctgtctttagaaaaattaaagtatacttaagaagaggaaacaaagtgagtggtaaggtgtatgcctctatagatggacaggtgtgttagttacattatatccaagtaatgtgtagtgggccttattaatgagatcctaagaaactataaaaaatgaacataccccagatttcttttgtgtacactttgaaagtgtttttccatttctattaaaaagtttaatttgtcatgctatgaaatcaacataaatttatggaggcagaacataatacagtaaaaagacaatgtgatcttttcatgtggcatttttaatacattgtatcacaaattacttcaaagaaacaattaaaaaacaaggaagaacttaggaggttcttaaaatagtatgtagcacattttagaactcaagtacagagctttcctgatgggcccaagtcctgtctcctctcaccctttttttttggggggggtggcgggaacaaaacaataaacacctttattacatgggtgaagacaaaacgaggattttttgcctttccgggccttgatcttcctaagatagaactccaactctttgccctctagcaatagccatctgctcggccacatccacacagttctctcactctttcaaaatgtcagcaccgtttcagaaggagggactggcccttgtgatggccataatgtaaagtgttcacacgaccagtagcatttccattcttagaaagctacgcttcttagaaagctacgctacttgattctaaaaatcagtcatacagacgtgtttttattcctttcagaggcaattcatttcatgaaaaaagctgaaatgaaaacactttatagttaagcttggtgtagtcataaccacacatagctgtgtctgtcataatttgtaaattgagctctgtcataatatctatttttcaggaggctctcagtaaattttcttaaaaagtctttctgattatgaaagtaatgcatgcattgccctgtggcaattacatattactctctcatagaatatatagagagaaggtggcagtgaggacaattctgggtcacctggaaggttttcctctggcacaggaaagacagctgtcctatttctagttgataagtgcctagactgtgcattagaggccaaacattgaaggaagtcaaattgcctttttgtgattctaaagtggtctttgtatcagaaagtagaatctgaagaaatatgctgcaagccagatgattatagttaacagtaatgtattatgtagtttcaaatagctagaaggaggatgttgatgttcccaacacaaagaaatgataaatatttgagatgatagataggccaattactctgtctggtcactctatattatatgtatcagaacatcactatgtgcctgatagattatgtatatcatttgtcaattaaaacaaattagaaaacaacttacttgtctttttgctaaatctggtgtggatccagctgaatataatttcttcctagttctatgaataggatataggtcttggttccatggtgttgtgtgacttatacttttgcttatctttgtcagtacttttgtgggaagagataggggctctatcagaggttgttagcttggtgatgttttcacccacaaattcttcattgttcttagaagttttctcatttctttgaactttccattaacattcaatctttcacttaatgaaaaatattttccttcctcctctttttcctcttccgtactttctccaaattcaggagcagataatggtaattgaaagttctagggacacactgtgagctcaaggtccagaaaggtagggaaagtctttattttgaactgtaggtatgttttaattccttctggagactagcactctcagggatgctgagactggcactggtgctaccagatattaaacagaatggatttaaagattctcctgtattaagaagattattttcaaaagaaagctctattttgtagttattgtcatttcctaaagatataactttcctggagctgtggatcgccacaatattgatggcccatccagcactatttaaaggcagggctttgtcatattttttataatatttgcagcttggtcaaaaatatttattaaatgattaaataaattcaacagcacttagaaacaatagaggcagaaaagaagttgtggagttggggtgtgtgtgtgtatatatatatagaattagtacattttcacatgctgatacaactgagactgggcaatttgcaaaagaaagaagtttaatgtactcacaattcatgtggctggggaagcctcacaatcatgatggagggtgaaaagcacgtctcacatggagcagacaagagaatgagagccaagcaaaagtggtctcctcttataaaaccatcagatccatgagacttattcactaccatgagaacagtatgggggaaactgcccccattattcagtatctcccactgagtccctcccgcaacatgagggaattatgggaactacaattcgagatggatttgggtggggacatagacaaaccatatcatacatatacataggtcagattggtaaagttatagaagcaaatgttagaaaactattttgtaaagttggaaagtagaaacaataaaaaacacaattcaaagagataagcattttcactggtgtttttttctggtgtgattcttccaagattattctggttatccattgctgtgtcacagaccactccaaatttagtggattaaaatgataaatattttatgatgtcatagattctgtgggccagaaatttggacagggcacagtaagatggtgagaacagtttgtctctgttccctgatgtctttgatctcaactgggaagaatgaggagctagaagtgactggcatggctgagacctagaattacctggaggcttctttatcacgtgtctgtgtctgagcctggaatgggatgatttgaaggctgaagttagctgagatgtgtggcttttccatgtggctcaggcttttcatgcatggtggctgcgcttctgagagagagtcctgagaggaagtatctggaaagggagccttccaagagaaccaggtggaagctgcatgccttttctgacctatcctctggaggcacacagttacatttccaccacatttcattggtacatgtgaatcagaccaaacagattcaaggggagaaagaatgagcctcacttctttgcgaggagagtcaaggtcacattgcaaaagagcgtgttggatggaagatgttacatctgatttgaaaaatatacttctctacaatattgtttggtcatcttataaaagtaaaaaatagtgtcctttataatatttcattgagaagtgtattaggcactttatcttgctaatgtaagatggtcactttaaagtgctctgtgtttgaaacattgtctttcttcacctttctaaagaacgcttaagatgatatatggcaaccaatcaatattacttttttcatttgtgtagcttatttaacacaactatttaataaatattatagggacattgtgttattccattttgtgaccctataaagaacacctgaggctcgataatttataaagaaaagaggtttaggccaggcacagtggctccgcctgtaatcccagcactttgggaggctgaggtgggtggatcacaaggtcagcagatcaggccagcctggctaacatggtgaaaccctgtctctactaaaagtacaaaaaaattagcaggcgtggtggcacatgcctgtagtcccagctacccgggaggctgaggctggaggatcgttgaaaccaggaggcagaggttgcagtgagctgagatcacaccactgcattccagtctggtgacagagcaagactctgtctcaaaaaaaagaaagaaagaaagaaagaaagaaaagagtttaatagccaaagttctataggctgtataggaagcatagtgttagcatctgcttagctctggtgaggtctcagggaggttttactcatggtggaaggcgaagcaggaacagcacatccatgacgagagcaggagcaagaggagtagtggggtgccacactctcaaacaaccagatccatgaatttgcagagagaactcactcattactaagagcagggcaccaagccattcatgaggatccatccccatgacccggacacctcccaccaggccccatctccaacataatggattcatttcaacatgagatttgaagggaacaaaacatccaaaccatatcaaatatcatagaaaaaaaataaacatatgggaacatataagtgagaaaataagtttgtgaattatcaaaaagggaaatagtaatatctaggaaggttagcatacataagtgatgttctagtggttctcaattttgtggcagaatataatcatctacagaattcaaatcaaaacaaaacaaaaaaaactctgtaccctgctccctcccccagaaacactgatttaactggtctaaggtatagaccaggcacaatatttaaaagttccctaggtgattgtaatgtgcagccaatcttgagaaccattgcttaaacagtttgtaaaatgtacgaaacagggaaagatgtttaattacaatgtttagttactgactgaaattttatcaataagatctaaattctaatctaaacagaaattcatttgcctctcattcttcaacagattagttcccagaggacactgttggattcatatctgacacgtaaaaaagcccacacaccaatatccaaagcagaaagctgaaagggacctgtttccttgataattcattgaaccattgaaatattgaccccataattgttccaattttgacttctaagaatgtgaatatttgtattttgtttcaactagatgttggaaaattctatagtttgcacccgaaaggtttgaaacattcctttgtataaacacattttcttgattgtgtggtcaatctgctggacgatccgctatgaattcagacagatctgggtttgaatcctggctctgctaccgtttaatgctttaacaatcttatttcatcatgcctccaaaaactgggagaaaatagaatacctgtttagaaaatgattataggaattaaaagcatccattcttttattcaggaaacctttgagcactgagtattccaagattgtattctgtacttggagtatataggaatgaacaagacagccaccttagcagaatgggagagggaggcaataagaaagttaaagaagagatgacaatgtcggttctgatagaagctgggataaaaaaaggaggtagcaaaaaagtgtgaataggacaagtctagactcaaatgataaaaggtagctctgcaaggaccagacaagcacatctaagtcagagattgttaatacaaaagagtcttatggcaaaaataagattggtttatttgagaacaacaacaaaaaggtcagagagcctggatctaatcagtaatgcagtggagagtgagaaaagtaagatggacgggtaaacagacgactgattaggtaagccaggaagaggagttgggatttattataatctcatgatcagcatttataaaactttaagcaaggtgctaaattatctaattttataataaaggggtaagagtgaagggggaaacctggttagcaaggtcttgtaatagtcccagtagatatgatggtgccttgttttagggtggtgctggtggaagtgaaaaaatatatgtttattttgctgtgaacccaaaactgctctaaaaaataaggtctattttttaaaagtatataatgttagtaaaacacatagatttacatggtgggcactcagtttattagagatagggtctcctctgtgccccacgctggaatgcagttggcatgatcatagctcactgtaatctcgaactctgcactcaaacaatcctcctgcctcagcctcctgaggagctaagactataggcatcaatgcccagctaattttatttattatttatttatttttttgtagagacagggtcttgctatttgcccaggctggtctcaactcctggcctcaagcagcccttcttccttggcctcccaaatgttgggattacaggtgtcaaccaccatgcctggccagtaaatgctattttattcataagttatcattaccattagtacaatgtggaagcaagatctggctctgtcattagcattgcttggtggaaagatttactaaataaagcagagagacttttccaaattgtatttattatcttaaaggctttcccctgaaggtacactgggatactaagaagacctgaatagcttaagatcttacaaaaggattccacataccggtttgggacttctaagggaaaatgcaaagattcacaattttaatagacagtgatttttgtttctatatctgacggtcatataattatattttagcacccaacacagttttgccataatg

SEQ ID NO: 5116 - DNA, 12632 bp, Homo sapiens
gtctactgctcattcctatgcggagcctctaggccaagacacactggagttctttaccgcctgttcataagtctgttcattgttgccacagatgtgactatgaacccctaagcctggtaagatattggatccaacaccaactttttagactatactcagaagccaagctgcaaagaaattagtttcagaaactcctccctacggcccactcctctctcctccctccttctttattccccagcctgagggatttagaactttggaacaggagtcgctaaggtttcttcctgcatctggttagggaattagccacatctccagaaataagatttattttaagcatcacataggggtgaaaagaaaatgtaggcaggatggcctttttgcagcagatttatttatttcttttattatatactttaagttttagggtacatgtgcacaacgtgcaggtttgttacatatgtatacagtgccatgttggtgtgctgcacccattaactcgtcacttagcattaggtatatctcctatgctatcccttccccccacccccaccccactacaggccctggtgtgtgatgttccccttctgtgtccatgtgttctcattgttcaattcccacctatgagtgagaacatgcagtgtttgtttttgtccttgtgatagtttgctgagaatgatggtttccagcttcatccatgtccctcaaaggacatgaactcttcattttttatggctgcatagtattccatggtgtatatgtgcacattttcttaatccagtctatcattgttggacatttgggttggctccaagtctttgctttgtgaatagtgccacaataaacatacatgtgcatgtgtctttatagcagcatgatttaaatcctttgagtatgtacccagtaatgggatggctgggtcaaatggtatttctagttctgatccctgaggaatcgctacactgacttcaacaatggttgaactagtttacagtctcacaacagtgtaaaagtgttcctacttctccacatcctctccagcacctgttgtttcctgacttttaatgattgccattctaactggtgtgagatggtatctcactgtggttttgatttgctttctctgatggccagtgatgatgagcattttttcatatgtctgttgactgcataaatgcttcttttgtgaagtgtctgttcatatcctttgcccactttttgatggggttgttttttcttgtaaatttgtttgagttcatcgtagcttctggatattagccctttgtcagatgagtgattgcaaaaattttctcccattctgtatgttgcctgtactctgatggtagtttcttttctgtgcagaagctctttagtttaattagatcccatttgtcaattttggcttttgttgccttgcttttggtgttttagacatgaagtccttgcccatgcctatgtcctgaatggtattgctaggttttcttccagagtttttatggttttaagtctaacatttaagtctgtaatccatttgaattaatttttgtataaggtgtaagaaagggatccagtttcagctttctgcatatgttagccagttttcccagcaccatttattaaatagggaatcctttccccatttgtttttttgtcaggttggtcaaagatcagatggttgtagacatgtggcattatttctgaggcctctttctgttccattgatctatatatctgttttggtaccagtaccatgctgttttggttacttaggcttgtagtatagtttgaagtcaggtagtgtgatgcctccagctttgttcttttggttaggattggcttgtcaatgtgggctcttttttggttccatatgaactttaaagtagtttttccaattctgtgaagaaagtctttggtagcttgatggggatggcattgaatctataattaccttgggcagtatggccattttcatgatattgattcttcctacccatgagcatggatgttcttccatttgtttgtatcttcttttatttcattgagcagtggtttgtagttctcctgaagaggtccttcacatcccttgtaagttggattcctaggtattttattctctttgaacaattgtgaatgggagttccctcatgatttggctctctgtttgtctgttattggtgtatagaatgcttgtgatttttgcacattgattttgtatcctgagactttgctgaagttgccttcagtttaaggagattttgggctgagacaatggggttttctagatatacaatcatgtctctgcaaacagggacaatttgacttcctcttttcctaattgaatacctttttttccttctctgcctaattgccctggccagaaattccaacactatgttgaataggagtagtgagagaggcatccctgtcttgtgccagttttcaaagggaatgcttccagtttttgtccattcagtagatattggctgtgggtttgtcatagatggctcttattattttgagatacgtcccatcaaacctaatttattgagagtttttagcatgaagggttgttgaattttgtcaaaggcctttttgcatctattgagataatcatgtggtttttgtctttggttctgtttatatgctggattaatttattgatttgcatatgttgaaccagccttgcatcccagggatgaagcccacttgatatggtggataagcttttggatgtgctgctggatttgctttgccagtattttattgaggtttttgcatcgatgtccatcagggatattggtctaaaattctctttttttgttgtgtctcgcccggctttggtatcaggatgatgctggcctcataaaatgagttagggaggattccctttttactattgattcgaatagtttcagagggaatggtaccagctcctccttgtacctctgtagaatttggctgtgactccatctggtcctggactgtttttggttggtaagctattaatattgcctcaatttcagatcctgttattggtctattcagagattcaacttcttcctggttagtcttgggagggtgtatgtgtcaaggaatttatccatttcttctagattttctagttatttgtgtagaggtgtttatagtattctctgatggtggtttgtatttctgtgggatcggggtgatataccctttatcattttttattgcgtctatttgattcttctctcttttcttcttattagtcttgctagcagtctatcaattttgttgatctttttgaaaaaccagcttctggttcattgattttttgaagggtttttttgtgtctctatttccttcagttctgctctgatttagttatttcttgccttctgctagcatttgaatgtgtttgctcttgcttctctagttctttaattgtgatgttagggtgtcaattttagatctttcctgctttctctactgggtgtttgtggtataaatttccctctacacactgctttgaatgtgtcccagagattctggtatgtttgtctttgttctctttggtttcaaagaacatttttatttctgccttcattttgttatgacccagtagtcattcaggagcagtttgttcagtttccatgtagttgagcggttttgattggtttcttaatcctgagttctagtttgattgcactgtggtctgagagacagtttgttatatttctgttcttttacatttgctgaggagtgctttacttccaactatgtggtcaattttgaataggtgtggtgtggtgctgaaaagaatgtatattctgttgatttggggtggagagtttgtagatgtctattaggtccgcttggtgcagagctgagttcaattcctggatatccttgtaactttctgtctcgttgatctgtctaatgttgatctgtctaatgttgacagtggggtgtaaagtctcccattgttattgtgtgagagtctaagtctctttgtaggtctctaaggactgctttatgaacctgggtgttcctgtattgggtgcatatatgtttaggatagttagctctcttgttgaattgatccctttaccattatgtaatggccttctttgtctcttttgatctttttggtttaaagcctgttttatcagagatgaggattgcaacccctgcctttttttgttttcattttcttggtagatcttcctccatccctttattttgagcctatgtgtgtgtgtgcactgagatgggtttcctgaatacagcacactgatgggtcttgactctttatctaatttgccgtctgtgtctttttactggagcatttagcccatttacattaaggttaatattgttatgttgaatttgatcctgtcattatgatgttagctggttattttgctcattagttgatgcagtttttcctagcctcaatggtctttacaatttggcatgtttttgcagtggctggtaccggtgtgcctttccatatttagtgcttccttcaggagctcttttaggtcaggcctggtgatgaaaaatctctcagcatttgcttgtctgtaaagtattttatttctccttcacttatgaagctagtttggctggatatgaaattctgggttgaaaattctttcctttaaggatgttgaatatggcccccactctcttctggcttgtagagtttctgctgagagatctgctgttattctgagggcttccctttgtgggtaacccgacctttctctctggctgcccttaacatttttccctcatttcaactttggtgaatctgacaattatgtgccttgtagttgctcttctcaaggagttctttgtggcgttctctgtatttcctgaatttgaatgttgacctgccttgctagattgggaagttctcctggataatatcctgcagagtgttttccaacttggttccattctgcccgtactttcaggtacaccaatcagatatagatttggtcttttcacatagtcccatatttcttgaggctttgttcatttctttttattcttttttctctaaacttctcttcttgcttcatttattcatttgatcttccatcactgataccctttcttccagttgatcgaatcagctactgatcttgtgcattcgtcatgtagttctcatgccttggttttcagctccatcaggtcctttaggacttctctgtattggttattctagttagccattagtctaatttattttcaaggttttaacttttttgccatgggttcgagcttcctcctttagctcggagtagtttgatcgtctgagccttcttctctcaaattgtcaaagtcattctctgtccagctttgtaccgttgctggtgggagctgcattcctttggaggaggagaggcactctgatttttagagtttccagtttttcgctctgtttttccccatctttgtggttttatctacctttggtctttgatgatggtgacgacagatgggtttttggtgtggatgtcctttctgtttgttagttttccttctaacaggacctcagcttgcagcagatttttaaaagaacttccaggaccttgtctgtatattgacgccttgtcactacaggaatcagagcagggcattacattgatcctttaagaaaattttgctacctataccccttgaccctactctttttttttttttaatttttaaaggtaattgttagaaattcccaaggtttatttgaaatgacacaccactgaaaacataacttttacagatgatttgtgatacagtacacatcacctatcttactttaggacagtctgtgaagatgatatttttcctctgcagttcctttgtcaagtgactttagacagatacaggactgcaagagtgactcaggtatgctggcataggagaagcaggtgctagtgtttcacttgaactagttgttgggctggggggaatgaaagctccctaggccatgaggacatctttgcaatgtggagaggacccaaatcatgggtgttgctctttgaatgttgaaggccttgtcagcatactggtcacccagtttcatctcacttcatactgtttgtaccaaagcaccacagtttccttatgaaacttagcttcaaggtggagatgtttttgaaagtattaatataaaatccaattcgtcttgactataataatggtacttttcttgtaagtcaccattaaactcttcaaactttctctatgctttctgaaattctcttctgccttagacagaggctcctatccttcctcctgaagctctgttgagcccgatggagtgggcaggcactgtcatagtccgtcagcttcctgctgcacttggtgatgtgattcttcagtcaggaaattggtccaggtagttttccggtgttagcaaggatgcatccatgagtttttgtggatatcctcccagagcacatcacctttctcaccaaccattttcacaccttcctgccagaccaatccagcgcacagacttcacacagtgactcagcttcgtcaaggtctcttgaagcctttgattgcttctaaacatcctcagagttctctcaggtctggtaccctctgcttctgtggcttgaagttctggacatattcttcaaactgtttgtcttttgtctcagcagctttcctggcttctggaggacgttttcctgtgagtggctgagtctcttccaggcattcttggcaagatgccctcttgatgttggccagggctgcaggtccaggacctgggaggagctgagcgccagtgtggctggtggcgtggaggggcgggaggaagtggggaggatcatgaggaggggtgggtcttcgaccctactgttgatatgttgttcagggaccatcgggagcccagagctctgcctgtttcacgggactccacaaagagaactgcaagtcccagtctttcacctctcttggacttttatcttgtctcttcatcacatctcttcagtataaggaagaacagaaagggaggagaaaactcagggttgtcagtcaaatgtgtccatttacagaatttataaaatgtattgttatctagttatctttatactagcctgctatggcaggtttcaggatcactggacctagagggtagtcaagaaagattttctttgatgtggcttagatccccctgaattcattcccaaaagccaagggaagaaagaacaggattaagtatacattgcccatatcttggaagacaatacagaggcagtaacagacagaagaactagcagacacacagaaagacatgggtcactttaaatttttttattcattttaatgaaaaattatattttgttaaaaatggtctatgtgagaagttctgaatacagtagggaataagaactatgttatatttaccatcctcgagcacacagtcaagaactacaaaagagaaaggcaaatttcacacacagccaagttgagtaaaacaaacaaaatctttggtctaatcagataaagatcatttactagcctggaaactattgtgaaggtattatttatttttgttttctctgtgttatttatacatcccaagaatcctaaaaaatccccaccttttgtgatgaagagtaggtgggcagccatagatcactgagtgtcagtatgacagaggccaggatgaggggcatccagctgactggtcactgggtggccccttgtgtagtccaagcacatctaccctgtattttggtcaaaagaatatctttcttttaaaattaatttaaaacttatcattgagtcatggatactggctcttcacctggccataggaccacaaaccccctcttctcatgctagactctgaaaagaatcaaaagtatttggagccagaaaaggccattttatcttctagtatgagcattgcctccatcctctcccttcctccccactctccacatatgaccaactgttgtttttcaactctgctattttgcacatgccagacacccctatctagtcttatctctgatttcccctaaaccagacctctcataccactttatgaaaatgcatctctctgttcagtagtactggaattaactatcaagacaatggtcatctgaattagaaattatatctctgttttcaattattatcaatattatttgataaatgttaaccaaagttttaactgaacacatttctcaagagatactttccctagactcatcattttgaattgagggaaatggtttaccctcattgagaaagtaattgagggaaatggcttactctcattgaagaaagtctcatttcttcacgtgcattttctagaaacagcagccagctccatatatgcaagagaactggatgtatgtctgaagcaaaaatgccttattcctatgtataacaggactaatatatgcaggccatatggagagcatgggcattgactgaaatgccggtgacccaaatcatagacccaagaattatatatataatggttcatatatatatattatttatataatatatataaacacacacagatacatacacacctattatatattaagtatatataatagtgtgtattatatatattaaatatatataataggtatgggtatgtatctgtgtgtgtatatgtatgtgtgtaagtatgtatgtatgtgtatgtgccagccataagctaatcaaacaatgtgagttaaattacctgagaaaacaatatcagtgagcactgagatatgtacttagtgttgtacatatatcttatacaaatcagcaatagacagcagggtaaaataatgttctaagtagcagagggattgactgatttccactgaaatgctcgggattgattagttctcattgaaatgactttccctagttacttatgctggcaacattgtatcctgtccaggtcccctgaattattcctcagagaccagtgaaacaatgtcatgctctaagtgaggcagagagaataaacgaagtatgccactctgaatctgcttagttttaatgctaagataaatgggttcataaaaggtgggaaaaggaagtggatgtagctcattgtgatgtgacgacatgaggaacatgctttccaaacctatgaataaatgtcagacaaactacagtgacaagaagaccaggatgcagcagatatgagagacacatgtgttgagggccttggccctttctctccagaaccaatgcccatgacagtcttgagaatcaaaatgtaggagaaaaagatgatggaaagtccaacaagaccattgcaaataaaactacaactggatagagacggttgaaggtgtgtcagcacaggctagcttgatgacatcttggtgtagacagaaagcatgggagagtacagggatcgacagtagggaaaccagtgtaggcgaacaactattggcataatggacagaccacccttgtcaatacccgcacaccaatcttcattacctgggtgttggtcaggatagaggtaatcttaaggggttgtggatggtaatgaaacagtcataagccatggcaagcaagacacctactccatgacagaaagagtatggataaaataggcctgagagaagcaggctccatggccatctccctgtgatctaaccacagaacacctagcactgtgggcattgtggtcaatgtcactcgaggtctgtagctgccaacatagctaagaaatagtacatgggctcatggaggttatgacattcctgatgagaaagagaagagtgccactgccaagaagtatggagatgtaggctgccataatgggatgaatatccagtgatgtgccttctccatgcctgggaagccagtaagctggaggtggaagcagacttattgagccccattgccagctttgcaaagaggcaaatatttactcaggtaaagcaatagtaatcagttgtataaaagttgctccttgagaactctacctgttctaagatgttcaccagtcctgactttcagtgacagcaaggatgataatttagtcattcctggagatcctaggtatgggaaaatagaatgtataaagaagatattatttagggtttactcatgtaagattattggatactacgttggggatacagctattcatgcagaataaacattgtgaattcattgtaaatcatataacccagaaaataaaaacaaaatgaaagaagaaatcacttatttgaatagtgctgtaatggcctgaaacttataggtcacttttcatggtgctcttcacctgactggtggtattatagggtggatgtaaaggtttcccaggctatgtgagacctaaagatcagtagaaaaatggttctaagcactattggaaaagcagatataaagattatatggaaaacaaatacacaagtaagaaatatatgagcaaatacaataaaatagtaaatttcagagttgacttttcttcaatattcctggagggaaaattcaattgatgaagctccagagactttgggtagttagaaaatgacgtaagagtgacttacctgtgtgtgtttccaaagcacatagactctatgttgcccagctttataaccctagttattgatacactgcttcaaagaattcaaatttcataatataaattgaagaataaacagtaaaatgtggatttgatgataagcttttgaggcactaattgataatagcaccaaactactgttgcatatcacctacttggtgatgcaaaataaaaattggtaatttaggcaagatcaaggagaattttttttttaaaactatggaatcgatgggatttgacaaaagtgagaaggctctgtgactcattagaattctaagatttcagcggtgcaggcagccaacctctgagaatacataaattgtgtgttggtggcatgagccagagaaataggcccaccttctcttatggttggtttggactatacatctcatatactattgaaaagcatattgatgtaaatttatgcacgatttacaagacctctttctgtccatgaaaagaagcatccaagattactggactttcattttcagaagaatttgttgaagtttcagctctgcttttctaacaataatgatcttgggaaagtaatttaatcttgagatttggttacataaccttaaagactactagtgatttctgtcttctcagtcattctcttgacacaaagtaaggggaatgttttgtaaagagtggataatttttttatttttgtgtttttgttattgtttcagagaatacctcctttctctttctctagtgagtacatgtcaggattattcacccagaggtgtgtcaatgatttcctttttttctgtggaagccttgggaacagatataagatgatgatggggttttaggagcctgtgtttgactttaaataaagatattaaactatagtttctctaatcagcaataaaatgtgatatgtctgggtgggaaagggaaaggagaaaagattgatgagccaatgtggaacttctgacatagctaaaagtaacgttgagcctggggcattgggactgagggaagtgaggggaaagcaactctgtcctcaaaaagtgagaaaaggaggtattattgctcaatctgctgccagtgagaggttcagacaatactcagcttatgcaggattaaagaagcagtatggcaataaaaattgtacataggtatataacttattgttttattataggtattcattgttaaagattaccataatcaaactaattaatatatctatcacctcacataataactttaattttttggtagtaaaaatatgtgaggtctgctttcttagcaaattttaaatatacctaaataaactgggagggaaaagataatacagaacattaatctagttaattgtgttatattactactaataaacatataattgataaattaaaaaaaaaacaggagtaggaataccagatagggaaataaagctgagaaacaaatgtatggaacaaataattgttgaatttctaccgtgtgtcaagattggactggggcattatatacacctcattttttgggaagaatccttaaaatagctgttgtcttgtctgttttcatattgaaaactgagtgctttcacttgattcactcagttgctttgtggtatatgagatgatctgtgagtttcagaggggataaaaatctaaaacctttgcctctccctgcagccattcaccctcttccagggtctctgtcatagaatagacttgagtttttataatgagaaactaattctcaaagtctcaaactctgccgcataaactgatggctctatgcgacacctcagcaggagcccattcagatgttaactttcatatattctctcaccttcccttggcttttttccttcacttttcctgacactcttttctgtctcaagcacttagtatctccacctttttttacccccttacctttggctattatcctttctgtgatggttaatattgagtgaaacttgattggattgaaggatgcaaagtattgttcctgggtgtgctgtaagggtgttgcaaaggagattaacatttgagtcagtagactgggagaggcagacccacccaccctccgttgggtg

SEQ ID NO: 5117 - DNA, 201 bp, Homo sapiens
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5118 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5119 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5120 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5121 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5122 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5123 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5124 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5125 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5126 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5127 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5128 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5129 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5130 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5131 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5132 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5133 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5134 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5135 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5136 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5137 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5138 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5139 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5140 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5141 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5142 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5143 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5144 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5145 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5146 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5147 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5148 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5149 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5150 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5151 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5152 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5153 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5154 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5155 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5156 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5157 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5158 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5159 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5160 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5161 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5162 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5163 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5164 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5165 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5166 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5167 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5168 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5169 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5170 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5171 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5172 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5173 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5174 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5175 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5176 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5177 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5178 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5179 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5180 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5181 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5182 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5183 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5184 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5185 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5186 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5187 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5188 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5189 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5190 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5191 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5192 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5193 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5194 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5195 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5196 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5197 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5198 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5199 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5200 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5201 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5202 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5203 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5204 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5205 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5206 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5207 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5208 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5209 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5210 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5211 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5212 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5213 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5214 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5215 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5216 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5217 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5218 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5219 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5220 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5221 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5222 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5223 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5224 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5225 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5226 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5227 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5228 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5229 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5230 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5231 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5232 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5233 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5234 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5235 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5236 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5237 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5238 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5239 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5240 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5241 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5242 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5243 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5244 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5245 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5246 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5247 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5248 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5249 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5250 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5251 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5252 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5253 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5254 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5255 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5256 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5257 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5258 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5259 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5260 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5261 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5262 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5263 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5264 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5265 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5266 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5267 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5268 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5269 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5270 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5271 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5272 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5273 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5274 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5275 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5276 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5277 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5278 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5279 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5280 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5281 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5282 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5283 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5284 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5285 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5286 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5287 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5288 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5289 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5290 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5291 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5292 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5293 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5294 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5295 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5296 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5297 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5298 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5299 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5300 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5301 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5302 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5303 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5304 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5305 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5306 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5307 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5308 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5309 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5310 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5311 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5312 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5313 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5314 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5315 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5316 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5317 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5318 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5319 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5320 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5321 - DNA, 201 bp, Homo sapiens; identical to SEQ ID NO: 5117
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60: n = A,T,C or G
  misc_feature 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114: n = A,T,C or G
  misc_feature 115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161: n = A,T,C or G
  misc_feature 162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201: n = A,T,C or G

SEQ ID NO: 5322 - DNA, 201 bp, Homo sapiens
gataaagacatacctgaactgggaagaaaaagaggtttaatggacttataattccatgtggctggggaggcctcacaatcatggtggaaggcaaggaggascaagtcatgtcttacatggaagggagcaggcaaaaagagtttgtgcagggaaactccacctttttaaaaccatcagatctcatgagacttattcactatc

SEQ ID NO: 5323 - DNA, 201 bp, Homo sapiens
cagaggcacgagctcatcatctattttcacaacactaatgcaagagacctccaacacaagcaaagcaaaggtaccgactgggtgcagccacatatcgtgastttccaggccattctgcctgagttgagatcattatgctgcttctttcattgcacaggaacgtgggggttttctctaaactatgactcatagcaaagcata

SEQ ID NO: 5324 - DNA, 201 bp, Homo sapiens
gtttggggaagtgtttttttttttctttttatctttcattcctgttcaaattcttttttaatttacacataagaaaaagtggtctggcacagtggctcacwtctgtaatcctagcactttgggagactgagagggaggactgcttgagaccaggaattcgagaccaacctgggcaatatattgagaccctgtctctattta

SEQ ID NO: 5325 - DNA, 201 bp, Homo sapiens
gcctgccagctatgttaaaagaagttttttgcaaagccaccttttgtgtatggaactgtgtgtgaaaaaagacttatagaactgtgagaaacttggataaratgaggcatgcgtacttccccatctgaaatagccaagatgatgaccattcttataagtgaaagagttttttttttttgtttggggaagtgtttttttttt

SEQ ID NO: 5326 - DNA, 201 bp, Homo sapiens
gtgtatagatatatgtacagtatagcctgccagctatgttaaaagaagttttttgcaaagccaccttttgtgtatggaactgtgtgtgaaaaaagacttayagaactgtgagaaacttggataaaatgaggcatgcgtacttccccatctgaaatagccaagatgatgaccattcttataagtgaaagagttttttttttt

SEQ ID NO: 5327 - DNA, 201 bp, Homo sapiens
tgcataaacatatatatgcaaaggtatatgtatatgcacatacatgcatacatgtgtatagatatatgtacagtatagcctgccagctatgttaaaagaarttttttgcaaagccaccttttgtgtatggaactgtgtgtgaaaaaagacttatagaactgtgagaaacttggataaaatgaggcatgcgtacttccccat

SEQ ID NO: 5328 - DNA, 201 bp, Homo sapiens
gccagcctcggtgacaaggcaagactctatctccaaaaataataattctaaataaagcaaaataaaatgtatgcataaacatatatatgcaaaggtatatrtatatgcacatacatgcatacatgtgtatagatatatgtacagtatagcctgccagctatgttaaaagaagttttttgcaaagccaccttttgtgtatgg

SEQ ID NO: 5329 - DNA, 201 bp, Homo sapiens
gctaggattacaggtgtgagccaccacgcctggccttagcaaattctaagcactcagaaaagttactttattattgctattatcagtatcatcatcatggrttctcacccttttggagacatcccataccttgttgaaagcttttgttgttgtttactcatgaaacctttggaccctctcccttgagaaacgcacatttgg

SEQ ID NO: 5330 - DNA, 201 bp, Homo sapiens
caggcatagtctctgccctttttcccactcagcactttaagcatggggctgagctcacagcctcatacagagcaaaccccttttcatgtcagtcttgcatrtaagtgagtcttctctccgaaaaactgctgctgggataaaagacttcctggaacctggggtccaacaccaaggccactaagaccaaaagacaaccccagt

SEQ ID NO: 5331 - DNA, 201 bp, Homo sapiens
cgtaagtgagtagtaataaaacattgggaagaaaaactccatgggtgcagggcattgccttttcacaggagtatccccagagccaagatcaatggctgacycatagtaggcacttaataaatatttgttgagtgaatgaatgagtagtaactcaaagtagtttttaaagtgctccaagtatacaaagctggaaggaattaa

SEQ ID NO: 5332 - DNA, 201 bp, Homo sapiens
acttgcttcatattccattaacatccagagatgctaaaaagtgaaaaaaaaaaaaaaaaaaagaagaagaagaagagaactaggctacaagaaattttaaraagagacactggcctaatgggtcacatgtacatccctggaccagcatggtgcagaagcgactgatgggggtgttgtgtgggggagaatctggtttccaag

SEQ ID NO: 5333 - DNA, 201 bp, Homo sapiens
ttcacactgcacgcctgtgtcaaaacatctcatgtaccccataaatatatatacctactatgtacccacaaaatttttttaaataaaagaaaattaactcstaaattcctaccattatgcagactggataactaaatcatgataccatgatatcatagtgaagaatgtgatgagggctatgaggttagacttatctgggtt

SEQ ID NO: 5334 - DNA, 201 bp, Homo sapiens
ctcatgtaccccataaatatatatacctactatgtacccacaaaatttttttaaataaaagaaaattaactcctaaattcctaccattatgcagactggayaactaaatcatgataccatgatatcatagtgaagaatgtgatgagggctatgaggttagacttatctgggttcaaatctttatgagttacaaaaaatata

SEQ ID NO: 5335 - DNA, 201 bp, Homo sapiens
agaatggaaggtcctaagcaggaaggacagtcttatttgtatctttaaaaaagcttactctgacaagtcattctacctctttgagcctctggtacatcctmtataagatacaagtagtattctttttttcacagggctcttaagaaagttaaattcgatcttggacagaaagtacatggcatacagtaggcactctatgaa

SEQ ID NO: 5336 - DNA, 201 bp, Homo sapiens
tatcccagcagctggtaagtgttggagccagaattctcacctcagcagtctaccgcagactccaagctcttcgccactcagtgaactgtgatacattcccmcagttaccaatggtagactttgaaaaaggaaataaaaaaggaagctgaaatccacattgacagcaaagataggcaggaggggattgacaggagcggaagc

SEQ ID NO: 5337 - DNA, 201 bp, Homo sapiens
accctttcttctctccttcctgtttcctggattttctggctgcttgcagaaaatcctaagttattagaagatggcagagccacaagatagtggagactgasttcttaaatccccacatgaagagaagctgcctgctgaccccaggaatacccaccatcggaccatcaggttagcaaaaagtaagctttattgttaagccag

SEQ ID NO: 5338 - DNA, 201 bp, Homo sapiens
aagttattagaagatggcagagccacaagatagtggagactgagttcttaaatccccacatgaagagaagctgcctgctgaccccaggaatacccaccatyggaccatcaggttagcaaaaagtaagctttattgttaagccagaggtcagcaaacttttctgtaaagagctagagagtaaatattttgagctttgcaggc

SEQ ID NO: 5339 - DNA, 201 bp, Homo sapiens
gtctctctcacaatggctcaactctgttatcatagcataaaagcttccttagatgatctgtaaacaaatgggtgtggctgtgttccaataaaactttattyacaaaaacaaacaagggcccaaattgggctggagaaccacagcttgtcaaatcttgtgctaaggcattaaaattttgcaggaattatttgttattatagc

SEQ ID NO: 5340 - DNA, 201 bp, Homo sapiens
accacaatgagataccatctcacaccagttagaatggcaatcattaaaaagtcaggaaacaacaggtgctgcagaggatgtggagaaataggaacacttayactgttggtgggactgtaaactagttcaaccattgtggaagtcagtgtggcgattcctcagggatctagaactagaaataccatttgagccagccatccc

SEQ ID NO: 5341 - DNA, 201 bp, Homo sapiens
gctcagcccctcccacaaaatgaaactgatcccttgtccctcctgaagatggatgacatcattaaagtatgggcttgatttagtggaatggaagatcacascttgggatcagaaattcagctacctagctacatcagccactatgtggtcttggcaaattcccttaactcccctatggctcagtcacttcatctgaaagtt

SEQ ID NO: 5342 - DNA, 201 bp, Homo sapiens
tggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctc

SEQ ID NO: 5343 - DNA, 201 bp, Homo sapiens
catggaaaagactaaagataggtctccccactctcccaggaactacctgatgcctctttagcaggagctgagtgggctccaccaacattccgatctgtgcrtctgcccttttcgagagctctcagtgtttaatgggaaggcccatcactcgcatccaaactctggagctgccaggttacaagagcaccaacttccacctcc

SEQ ID NO: 5344 - DNA, 201 bp, Homo sapiens
cccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagt

SEQ ID NO: 5345 - DNA, 201 bp, Homo sapiens
ctgtttgtgcagcagggcctcatccatcctagctgatccagctttcctgaaaccctatcttaaagggcatctcctgtcactttcagtctctttaccctgcyttgcctgtggcacttaatgcaatctaacattatatatttaccgtgtttatattttgtccccatcccctggaatataagtttgataagggcagggacattg

SEQ ID NO: 5346 - DNA, 201 bp, Homo sapiens
atccatcacttgccaggcagtatctaggtgctggggggactctatgaaggggatatgctcctgcccaggtggagtttagcagggaatctggacagtgatgragtcatttcaaatatgataaacccatcaggtatacacaaggagaaaagctaattttcatttttataggtattttataaacatttttctaaacactctact

SEQ ID NO: 5347 - DNA, 201 bp, Homo sapiens
ttactgaaactttaaattaaaatgatataagttctgagatttgcattaaaataatcagggggttggtaaggtattagggaggagggagtattaagaaaacmagattgggcagggtgcgatggctcatgcctttaatctcagcattttgggagaccaaggcaagtggatctcttgagcccaggagtttgagaccagcctggg

SEQ ID NO: 5348 - DNA, 201 bp, Homo sapiens
agatttcatggttggtatgcatgtcgctggtgtttgctccaggcactgactaactctgtctgggttgtgaaaacaaggacactgtaagacctttcataccwttcaaagaagaaagtggacaacgccttccgctaagggcctccttaacgtggtgtattccagtgtgtggtatactgatggtgtacaagatcattttagatg

SEQ ID NO: 5349 - DNA, 201 bp, Homo sapiens
atcagagaggtttaggaaacactgatttggtctgtatcaggtgcagcaaattcaaatatgtgcagaacccagagagatgagataaataattttttttttttgaagggagtctcactctatcccccaggctggagcacagtggcgcaatcttggctccctgcaacctccgcctcccaggttaaagtgatcctcatgcctcag

SEQ ID NO: 5350 - DNA, 201 bp, Homo sapiens
ctcccagaaagcccatcatcttctgctttggaaagccaatattgtaaatattggaagcataacttccagcacacacaaacacacacacacgcaatatcatsccacctcttcaacagatgaaggcgaaaacaactaaaatccaagagtaaatctccagctaaaaacaagctcaaatagcaacaagaacttcaaggaggagat

SEQ ID NO: 5351 - DNA, 201 bp, Homo sapiens
catagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctgga

SEQ ID NO: 5352 - DNA, 201 bp, Homo sapiens
tgcttactgaattttcattttgcttttcttaattataagaataatgcaaagtcccatcaacaacatttttgtgtgagttgatggatttctttatatatatwtattttttttttttgagataggatctcgctctgtcgcccaggctggaatgcagtggcacaatcagagctcactgcagcctcaaattcctaggctcaagtg

SEQ ID NO: 5353 - DNA, 201 bp, Homo sapiens
tttgcttactgaattttcattttgcttttcttaattataagaataatgcaaagtcccatcaacaacatttttgtgtgagttgatggatttctttatatatwtatattttttttttttgagataggatctcgctctgtcgcccaggctggaatgcagtggcacaatcagagctcactgcagcctcaaattcctaggctcaag

SEQ ID NO: 5354 - DNA, 201 bp, Homo sapiens
gttttgcttactgaattttcattttgcttttcttaattataagaataatgcaaagtcccatcaacaacatttttgtgtgagttgatggatttctttatatwtatatattttttttttttgagataggatctcgctctgtcgcccaggctggaatgcagtggcacaatcagagctcactgcagcctcaaattcctaggctca

SEQ ID NO: 5355 - DNA, 201 bp, Homo sapiens
acatcagcaggaagcaaacttctactatgttataccactgatatttgagggcttatttgttatagcatctaccattatcctttgaattacgaagctaaggraaaaaaagcccattggctttaaaacccagcagagttcagtaggaggaggaagatggagaaagttataaagtaatcaagttgggtgggaacctcaggttag

SEQ ID NO: 5356 - DNA, 201 bp, Homo sapiens
tacatcagcaggaagcaaacttctactatgttataccactgatatttgagggcttatttgttatagcatctaccattatcctttgaattacgaagctaagrgaaaaaaagcccattggctttaaaacccagcagagttcagtaggaggaggaagatggagaaagttataaagtaatcaagttgggtgggaacctcaggtta

SEQ ID NO: 5357 - DNA, 201 bp, Homo sapiens
accaccctcctcagtgaggtgatgacgccaaggatcaagctgatggtggctccagcaggcatgacattgaaacaggcaaatgagatccttcagcctagcargggaagctgcctatggtcaatgatcgccatgagctagtggccatcgtctcccacaccaacctgaagaagaatcgagactacattctggcctccaaggatt

SEQ ID NO: 5358 - DNA, 201 bp, Homo sapiens
acactcaactcacagttgcagatttcataagcaacaaaaagaagaatccatttcacaggcatttttcagtgcctgtctgaccacactgatcaaggcagtgrgggtacagaggtgcacaaaacgtgcaaagtgcctgctacagtgatgcttaccctctggtggggagagctgaagttctgggaaagtacagtttgagggaat

SEQ ID NO: 5359 - DNA, 201 bp, Homo sapiens
atgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataaaatgaggcatgcgtacttccccatctgaaatagccaagatgatgaccattcttataa

SEQ ID NO: 5360 - DNA, 201 bp, Homo sapiens
ggtgctaaatgttacgagagtgcagcagaggcataaaataaaagaagcctgaagcaaacttttaattcgttacacaaaaaagtctttagtcttctttgccragattaaagcagtgccactctgggtctggagccgaactggtagctggggtctagaagaattcagagttcatcccgagtcttctctagagatggaagccgg

SEQ ID NO: 5361 - DNA, 201 bp, Homo sapiens
aaataagacacctgaaactccacgatatgataaatgatatgacaacagggggaggtgctaaatgttacgagagtgcagcagaggcataaaataaaagaagmctgaagcaaacttttaattcgttacacaaaaaagtctttagtcttctttgccgagattaaagcagtgccactctgggtctggagccgaactggtagctgg

SEQ ID NO: 5362 - DNA, 201 bp, Homo sapiens
tactgagtcctgattccctaggcaaaaagtgcaaagcataccgaaaaataaatatccagccttaaaaaatcagtacaacaatcccttggctcccatcaacwtcgtagaccccactgtgtgcaggggccgcagtcgacggcagggtatgaggagaaacaggacaggtttccatgtcccttgtgagcgcagagtgtaggagga

SEQ ID NO: 5363 - DNA, 201 bp, Homo sapiens
tctgtactgagtcctgattccctaggcaaaaagtgcaaagcataccgaaaaataaatatccagccttaaaaaatcagtacaacaatcccttggctcccatsaacatcgtagaccccactgtgtgcaggggccgcagtcgacggcagggtatgaggagaaacaggacaggtttccatgtcccttgtgagcgcagagtgtagg

SEQ ID NO: 5364 - DNA, 201 bp, Homo sapiens
gtatttttattttttccaatgattggattctccagggtgcgcacatgacagagacaagtttctgtactgagtcctgattccctaggcaaaaagtgcaaagsataccgaaaaataaatatccagccttaaaaaatcagtacaacaatcccttggctcccatcaacatcgtagaccccactgtgtgcaggggccgcagtcgac

SEQ ID NO: 5365 - DNA, 201 bp, Homo sapiens
gcacgagcacaattttacgtggttatgggaaggaatggtgttctctatgtgtatttttattttttccaatgattggattctccagggtgcgcacatgacaragacaagtttctgtactgagtcctgattccctaggcaaaaagtgcaaagcataccgaaaaataaatatccagccttaaaaaatcagtacaacaatccctt

SEQ ID NO: 5366 - DNA, 201 bp, Homo sapiens
gtgacatgccctgtttcaaacatataaaatatattaactaatttaatgctcataacaactctatgaggtcagttctattttatcccttttaacaaataagyaaactagagcacagatgggttaagtgacttgtccaagatcacacagcaagctagtagagacgggattcaaactaaacggtaactcaagtcccttctctta

SEQ ID NO: 5367 - DNA, 201 bp, Homo sapiens
cttatagactccttactatgtgacatgccctgtttcaaacatataaaatatattaactaatttaatgctcataacaactctatgaggtcagttctattttrtcccttttaacaaataagtaaactagagcacagatgggttaagtgacttgtccaagatcacacagcaagctagtagagacgggattcaaactaaacggta

SEQ ID NO: 5368 - DNA, 201 bp, Homo sapiens
caagccctcataaatgatattcatgccctgataaaagaggctccagagagatcaacggccccttccattaccaatgaagaacaaaacaaaatgatgacagycatctatgaaaaaggaagcaggccctcaccagacatgaatcttctggtgccttgaccctggacttaagcagcctacagaactataagaaatagatgtttg

SEQ ID NO: 5369 - DNA, 201 bp, Homo sapiens
tttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccct

SEQ ID NO: 5370 - DNA, 201 bp, Homo sapiens
attgggaagaaaaactccatgggtgcagggcattgccttttcacaggagtatccccagagccaagatcaatggctgacccatagtaggcacttaataaatatttgttgagtgaatgaatgagtagtaactcaaagtagtttttaaagtgctccaagtatacaaagctggaaggaattaattctgccttgcatgtgtgtgtc

SEQ ID NO: 5371 - DNA, 201 bp, Homo sapiens
tttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacg

SEQ ID NO: 5372 - DNA, 201 bp, Homo sapiens
aatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagtt

SEQ ID NO: 5373 - DNA, 201 bp, Homo sapiens
ccgtttcacgtcatctgtgctatttttctcatgtcccgcctgctgcacccactcccgtttcctttctgccttccttagtcatctaagtttgcaacacctgkcttatgaatgcacaaaatctggatgctcttgtgacatgcccaagaaaggctggtaaggggaggaagtgcagaccccactgagacatcaagaacccaagcg

SEQ ID NO: 5374 - DNA, 201 bp, Homo sapiens
accagaaaaaaaagcatacatgttaatgagtttttttttaaaaaaataggaaatccatccctttccagttcctcacccacaaaaatgggtgctgatcaatyggttgtgtaggtaaagggatgagaagagggtatcttgattcaattccttttcttccaacagcctcccatgctttcgcacagtcacaaagtcatgggagac

SEQ ID NO: 5375 - DNA, 201 bp, Homo sapiens
aacactatctcaaactcatccagatttctctgcccaccatgtacctcagacctgcacggctgcttcctcttctcacaaaaacaccaatgccatccctttgraaatacaatgtgctgttgacgtcccccctccctttggaggtattttgttttgttttgttgagatggggtctcactacagtcgcccaggctggagtgcagt

SEQ ID NO: 5376 - DNA, 201 bp, Homo sapiens
cctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccct

SEQ ID NO: 5377 - DNA, 201 bp, Homo sapiens
ggttggtcaggctggtcttgaactcctggcctcaagtgatccacccacctcggcttcccaaagtgctgggattacaggtgctaattatgattagatccctrtcagtagtcctggatattgtttccaaatgttaaagttatttaacgaggctgaaatgatcactgtggaatgcagggatgaatgtctcaactctaaaatggg

SEQ ID NO: 5378 - DNA, 201 bp, Homo sapiens
cccaggtaccagggttgtgtttctcccactgggcaggaggacgttcagaggtcaggtctgagaactgtgggatgttgcctgtgatgaggacagagacaccrtctgacacactggggtccatgccacctttctgcctccactccctatagaagatgttggagaggagcgatccctcttctccaatgtctgcgacagaccaaa

SEQ ID NO: 5379 - DNA, 201 bp, Homo sapiens
atgtcttgcatagcgtagttaaattgtttccaacttttttggaaacatttttactggggtcaattcttttgtgtttaaattttataaatatttgcttcatygatcaggatttggaccacaacaaattttactaatttataacttctgccattttgagttttcttttgtggttattatttccaccaagtcaagtccatttct

SEQ ID NO: 5380 - DNA, 201 bp, Homo sapiens
aatcgcacaggggactggggatcctgagagctgaaaactgaggcttctaaggaaattgggacttttccataaatgtatacacccagacttgtacatgaaartcaattaaaagaaaaacacaaactatcccactgtgtcttgaaatattaggctcttcggagttctagggacgttgtttaatttaaatctggcatatgtgcg

SEQ ID NO: 5381 - DNA, 201 bp, Homo sapiens
ctccttacagtttggagaacagaggattattttctaattttttttccatccaatatggaggcatgtctgaaggtcatccaagtgactaaaacatggcaagyatttgatgatggaggaggtagagatgcaacacttggagataaaatttccagaaaaatgcagcaattaaccaagatattttttctttttttgtgaaccaaa

SEQ ID NO: 5382 - DNA, 201 bp, Homo sapiens
accacttcagaacgttcctcattgatggtgagcgagccaactgccatgactgcccgttgatagaccacctggatgcaaggcaaaaaaaaaaaaaaaaaaargagagagagaacaacagtactttacttttcctgctaacattcctgaggactgcaggccctttgtctgagtaagagcctaggggatgaaaagataacttac

SEQ ID NO: 5383 - DNA, 201 bp, Homo sapiens
ttctgggaagcagcctctaatcccataaaactgggcaggtagcctctcctttccctacctcactagctagtgtgagacctgcacactcatctgtctgcccyagtggactcattgagggtgggactgtgttctgtttgcctttatggccctcgtacccagcccagggctgcttacataatagatgcacaaatacctatgaaa

SEQ ID NO: 5384 - DNA, 201 bp, Homo sapiens
gtgggactgtgttctgtttgcctttatggccctcgtacccagcccagggctgcttacataatagatgcacaaatacctatgaaatgaacaagttagccagragcggtggctcacatctgcaatctcagcactttgaaggcaaggcaggaggatcacttgaggccaggagtttgagaccagcccgggcaacatggcaaaact

SEQ ID NO: 5385 - DNA, 201 bp, Homo sapiens
cctagaggcccctgcattccttatcatggagccccctcgatcctcaaatgtagaagtcagactaagcattctcacactccaaatttctttctgcaactatyaggcttgtgtgaaactaattgcagttttcgctgttttttttaaatggcaaaacccacgattacttttgccccaacctaatagctgcacaaaactttctac

SEQ ID NO: 5386 - DNA, 201 bp, Homo sapiens
tcagtacaaaatatctttctgcattcttttctaacctgtattgtttccgacgagaagtcggctgacatcttttttcactctgacagctttcaactgtggtrtatctttttagctgatatatctttaaaactgattttgagaaatttgattatgctatgtcttcatatttctcattctcaggatttaagttttttgaactga

SEQ ID NO: 5387 - DNA, 201 bp, Homo sapiens
aacttattttcctgctgtctgccaagaaaaggaaataatggaggtaactcagcaacgatccagagagactcctggggaatttgcattctcctgttgaggaytgcccttgtgagccctggtaagccctgatgtgctttctgttactctcatagtgtatcaactgagcatttcaacatattttatttcaatttccaggggtga

SEQ ID NO: 5388 - DNA, 201 bp, Homo sapiens
tttatttcaatttccaggggtgagaggaaaagtaaaaacatcaaataagcctggtaagcctgaggattcagatggatagcattctcacgtgcacataagcwgaattggtcacactggaaaacaactactccaccaccacccacctccctcccccttcctctgtcatcatcatcctccatcatcatcacatccatcctcctc

SEQ ID NO: 5389 - DNA, 201 bp, Homo sapiens
gaagcataaatatctggataagcataaaagactcttcttttaattaaaaaaatacatatgcatgtgactatttaaagcacaaatccttacattgcctcttrgggtattaatgtacagatgcaatgcatataacactaaagcatacaggatggtgagggtggaagaagagagacaggccctctcacattgttttatacggtt

SEQ ID NO: 5390 - DNA, 201 bp, Homo sapiens
ttttaattaaaaaaatacatatgcatgtgactatttaaagcacaaatccttacattgcctcttggggtattaatgtacagatgcaatgcatataacactawagcatacaggatggtgagggtggaagaagagagacaggccctctcacattgttttatacggttttatactcagaaaaagaaagagaagcgaaactaaagg

SEQ ID NO: 5391 - DNA, 201 bp, Homo sapiens
cgatatgacactccttcagctacaaacacacacataccagtatgttctccttctctcacagacacactcacatgtggacacacactcatgcatgcatgcgygcacacacacacacaccgagtaacttgattctccatgagactctgccagaaactaaactattgacaaaagtttcctgatgtgcccaactctctaggtgtg

SEQ ID NO: 5392 - DNA, 201 bp, Homo sapiens
tgacactccttcagctacaaacacacacataccagtatgttctccttctctcacagacacactcacatgtggacacacactcatgcatgcatgcgcgcacrcacacacacaccgagtaacttgattctccatgagactctgccagaaactaaactattgacaaaagtttcctgatgtgcccaactctctaggtgtgcttct

SEQ ID NO: 5393 - DNA, 201 bp, Homo sapiens
gtaacacatgttctcactaataagtaggaactaaaattgggtgctcatggacataaagatgggaacaatagacattggggatcccaaaagggaggagggarggagggggtcaagggttgaaaaactacctatcaggtagtgcattcactacactacttgggcaacaggaacattagaggctcaaacttcagcattacataa

SEQ ID NO: 5394 - DNA, 201 bp, Homo sapiens
atcagcacacagctcaaacaagatggggtcagatctccacttcatacacactggatttccacacatgcatgggaaagaaaagaaggactattgccccacarattcactgcatctagtattgctaaggggctgcagcctcttgccaaccacagacccatctcagtggacaatgcaaagggtagcattaaatcatgagctttg

SEQ ID NO: 5395 - DNA, 201 bp, Homo sapiens
ttgtcctcagagccagaattcgaatccaaagacatgttcttaagaaccatggcattcacctctccctaggacacacaagggctcaaatcgagcccatgagscttctatcagctatctaccagttcatttggatttttggctcattgcagactaatgatgcacaagtggtctcattaatggtatgcatgtttgtttgtttgt

SEQ ID NO: 5396 - DNA, 201 bp, Homo sapiens
agaggaatgagtaaagaagaaaattgaaagaggtggcagagagatgggaggggctaagaagactggagattactaatggtgcagctgaatcataaaactaycatgcttataggaaactcgtggctctggggtttaacgaaaggttttatatttttaatttgccagatcagggaagcagcagggtctttttttttttttttt

SEQ ID NO: 5397 - DNA, 201 bp, Homo sapiens
taatggtgcagctgaatcataaaactatcatgcttataggaaactcgtggctctggggtttaacgaaaggttttatatttttaatttgccagatcagggamgcagcagggtctttttttttttttttttttttttgagatggggtcttgttttgtcatccaggctggagtgcagtggtgtaattacaactcacagcagcct

SEQ ID NO: 5398 - DNA, 201 bp, Homo sapiens
tagtacttactttttttttttctttttttttttttttttttttttttttgagatggattctcactctgtcacccaggctggagtgcagtggcgcaatctcrgctcattgcaaacgccattctcctgcctcatcctctggagtagctgggactacaggcacccgccacaacgcccggctaattttttttttttgtattttta

SEQ ID NO: 5399 - DNA, 201 bp, Homo sapiens
aaactgggttgaggccagattcaatattcacgacccattttcataagacaagccaattgatatttttttctctctgattgaattggaaaaagagttctctytagctcactaaagagatacaagacttttttgtgtgaaaagaaacaatttctttccattttgatccatgaactcacttcctctaaccctttcttaacctcc

SEQ ID NO: 5400 - DNA, 201 bp, Homo sapiens
tctggttacaatttattttacttttaaaaatgcagcaggaaaagtgtggggaaagagaggttttgctaaatttagcaaaatacttgacatttttatggaartgttttacaaatgcaagcaagataaaaatctagagaaactgggttgaggccagattcaatattcacgacccattttcataagacaagccaattgatattt

SEQ ID NO: 5401 - DNA, 201 bp, Homo sapiens
cttccgttttgcttgtgaatagccacatcttccaggaaccccaagtgccccctgccactcagcccctcccttgggaaccccctacctccccataaccagcyactaaaggattaacacctcacataacaggtgctccagaattctacaaagtgagtgtctattctgattcagctgtgataatgctgtagtggttaaatattt

SEQ ID NO: 5402 - DNA, 201 bp, Homo sapiens
atgaagcaacgcatgactatacatatgcatgtatattcagaaggagagaatagaaagaatgatggaaagaaagaatccaacagatagcggctgagattttytccagaattaaagaaaatcttgaatcctctaagaaagtccacagagggcaaagcacaataagaaaaaccatatatactataaaatcctgagcatgcaact

SEQ ID NO: 5403 - DNA, 201 bp, Homo sapiens
ttcatgcaattctccctgcctcagcctcctgagtagctgggattacaggggcctgccaccacatccagctgatttttgtatttttgtagagatggggtttmagcatgttggccaggctggtcttgaactcctgacctcaggtgatccacccgccttggcctcccaaagtgctaggattacaggtgtgaaccacctcgctca

SEQ ID NO: 5404 - DNA, 201 bp, Homo sapiens
gttgccttctctcttttggatcactcactctgaggaagttggctgccatgacatgagggacttcaagcagccccacggagaggttctcaaaatcaataaaygaggccccctgccagcagcctcggaaacaagccatccatgccagccagtcctccagcctcagtccagcctttagatcactgcacctctggccaatgtact

SEQ ID NO: 5405 - DNA, 201 bp, Homo sapiens
agggacttcaagcagccccacggagaggttctcaaaatcaataaatgaggccccctgccagcagcctcggaaacaagccatccatgccagccagtcctccmgcctcagtccagcctttagatcactgcacctctggccaatgtactgaccacagcctcacaagagaccctaggcaagaatcccccaactaagttgctcccg

SEQ ID NO: 5406 - DNA, 201 bp, Homo sapiens
actcaacactaaggatggtagaacagacggaagggaagaaggtggattcttgttgataccactgggccactgaatccatcagtccccaactttgatctacktcagagtttctggtcatgtgaaataataagtttatacatcgtataatctactttgagtcaaggttctcataattacttgcagctaaacataccccaactc

SEQ ID NO: 5407 - DNA, 201 bp, Homo sapiens
tcttgttgataccactgggccactgaatccatcagtccccaactttgatctacgtcagagtttctggtcatgtgaaataataagtttatacatcgtataakctactttgagtcaaggttctcataattacttgcagctaaacataccccaactcattcaaggagctacttgtaatgggctctctgcattttacatttggta

SEQ ID NO: 5408 - DNA, 201 bp, Homo sapiens
atctactttgagtcaaggttctcataattacttgcagctaaacataccccaactcattcaaggagctacttgtaatgggctctctgcattttacatttggyagtatcttagacactttttacagattctttctaatctctctagtatcctacaatttagatattatcacccctactttacagatgaggaaactgaggcttg

SEQ ID NO: 5409 - DNA, 201 bp, Homo sapiens
acactttttacagattctttctaatctctctagtatcctacaatttagatattatcacccctactttacagatgaggaaactgaggcttgatgccgttaartaacttttcctaggtcacatagctagtgagaggcaccgctaggattcagtacaggcctttgaactcaaagttgacattcgttccaacccaccaggctgat

SEQ ID NO: 5410 - DNA, 201 bp, Homo sapiens
ctcattttgttcaagtgcttacttgcctacaggaggctcaggattaaatctcttttgccctatgccagggtttctcaacctctgcactactgaccagatcrtgtttctttgctgggtgggctgtcctgtacattgtaagatattttacagcatccctggtccctacatgctgatattagtagcatctcccgacaaacacct

SEQ ID NO: 5411 - DNA, 201 bp, Homo sapiens
gcatgggtctcagagtctgatggaaagggcagtcgtaagtgagtagtaataaaacattgggaagaaaaactccatgggtgcagggcattgccttttcacargagtatccccagagccaagatcaatggctgacccatagtaggcacttaataaatatttgttgagtgaatgaatgagtagtaactcaaagtagtttttaaa

SEQ ID NO: 5412 - DNA, 201 bp, Homo sapiens
ctgaggcatatttttctgccatcaggtttaaaatgttaaataaataataattgaaatatgaaatagtggtgtctatacatgtacatttttgtcactccctwaacagcaggaattatacccaacatttaagttctttctcagggtttcactaagcatactccaggctagagacagctccaggctggatattgcaccaaatga

SEQ ID NO: 5413 - DNA, 201 bp, Homo sapiens
ttttgtcactccctaaacagcaggaattatacccaacatttaagttctttctcagggtttcactaagcatactccaggctagagacagctccaggctggayattgcaccaaatgaattcacacatacactccctcacccactagaagttcatatccctggacagctggtagcagtcattccagttaacagcatttctgaat

SEQ ID NO: 5414 - DNA, 201 bp, Homo sapiens
tcagggtttcactaagcatactccaggctagagacagctccaggctggatattgcaccaaatgaattcacacatacactccctcacccactagaagttcayatccctggacagctggtagcagtcattccagttaacagcatttctgaatgcagagaaaaccaggcaacaaatacttaatgagcatttcctaaatgcagtg

SEQ ID NO: 5415 - DNA, 201 bp, Homo sapiens
ttaataatataattgattcacccatacatatatccaagcaaccaaccattcatccctccacccatttaccctttcactcatccacctttccacccttgatscattcaaccctacatctttccactcatccattcaaataatcattcacccttctctttatacaacaactcctttaccaatccatcctcttccccttccagc

SEQ ID NO: 5416 - DNA, 201 bp, Homo sapiens
gtgtgtctcactttgattgatggggtgccatcaaaagcaaaattttctcccttgttgcttctgaaaaagactcccaaacccacagtgaagtcagtctgggrcagagagaggtggtgtgatattatatatgtcattataaactctaagtgcctcttttccgaactcttagaaggttagtagtggcaaaggcaacaaaaaagt

SEQ ID NO: 5417 - DNA, 201 bp, Homo sapiens
aacccacagtgaagtcagtctggggcagagagaggtggtgtgatattatatatgtcattataaactctaagtgcctcttttccgaactcttagaaggttartagtggcaaaggcaacaaaaaagtcacagtgatgaatagaacatgttggaaagtggctcagagagtaggaattaaagaatgccagctccagtaaatgtca

SEQ ID NO: 5418 - DNA, 201 bp, Homo sapiens
tcacagaatatacccatgaaacaacccagcacatgtatccactggatctaaaataaaagttgaaattataatttaaaaatgggttagaatcatagcaaatmactgtgcatgagccccgcctagccatttctagtacataacctggtatttggcttctagtagatgcttatgacagcaaccataagcctcccacccaaaaat

SEQ ID NO: 5419 - DNA, 201 bp, Homo sapiens
acttttatcagtagataaaatcctcctaaaaacagtgtccataggagtcaaaataataaaaaagaacactaggtggtgaaaatattggaaacttctagacrtacagtagccttcatttcttgcaccgccaaaagccgggctgataatggagcaaataccctcttcccaggctcccctgaggaagctgccactttattcatg

SEQ ID NO: 5420 - DNA, 201 bp, Homo sapiens
tttcttgcaccgccaaaagccgggctgataatggagcaaataccctcttcccaggctcccctgaggaagctgccactttattcatgaccccacagtcaccktctcctggaagcctttcctaattagagcccttctagaattctgggattttatgtctcagcagtatggtgagaacaataggattgttctgttctgctttat

SEQ ID NO: 5421 - DNA, 201 bp, Homo sapiens
ctgttcatgcctctacattgatgtttctcaagcttttatgatccaggtctccttgataaacatttttaacctcacattttcctctaatgctatttgaaatkgcaagagaaattaatatggtgactaaaacatatcaagagatgtcatagttcaatagaccctgctactaacaaccccaggtgcaaatctttgcttcacatg

SEQ ID NO: 5422 - DNA, 201 bp, Homo sapiens
atctagcatagttcttgacttgtagcgtgtgctcagtagtgttaataattatggaagagctcattggccaccaagtgaatgctaagctggaagaggattgratacattatttactccaaccccatctcaagccaagactataaccctctcaatttcatgggaggttgaccctctgtcatgacattggacaaacattgggag

SEQ ID NO: 5423 - DNA, 201 bp, Homo sapiens
cagcccatcatagcagcattattcacaatagccaaaggtgggaacaacccaaatgtccattgacagaagaacaggtaaacaaaatgtaaatacatacaatkaaatattagccagcgttcaaaaagaaaggacattcggatacatgctacaccagcacactccctagctcacgatattttaagtggatgaataaatgaatga

SEQ ID NO: 5424 - DNA, 201 bp, Homo sapiens
acaatagccaaaggtgggaacaacccaaatgtccattgacagaagaacaggtaaacaaaatgtaaatacatacaatgaaatattagccagcgttcaaaaasaaaggacattcggatacatgctacaccagcacactccctagctcacgatattttaagtggatgaataaatgaatgagcaaaaaaagagcaccctacctct

SEQ ID NO: 5425 - DNA, 201 bp, Homo sapiens
tcatgctgaacaattagatgtgctatttaggcaaaataaaaaatatattgcacattttctagacagcctgttagcatccatgccaatgacacgaacatcakgacatggggctgatattaaagtaaccagaaacacaaatgtgtattgcaacactcggaacattgccatctgtgtgttgcatgcccggagggacacccaggg

SEQ ID NO: 5426 - DNA, 201 bp, Homo sapiens
aatgacacgaacatcaggacatggggctgatattaaagtaaccagaaacacaaatgtgtattgcaacactcggaacattgccatctgtgtgttgcatgccyggagggacacccagggaggactgcgtgaagacagggtgagaaagagtccaggagaaaaacagcagctgagaggagtggggtgggcagggattggagtaga

SEQ ID NO: 5427 - DNA, 201 bp, Homo sapiens
ttactaattcactcagttctttaaccaacatgtattgagtgtctactctgagcctggagctgggtgctggatattcaacaacagataagaaaggcagagaycctgtactagtctgttcttgcattgctataaagaaatacctcagactgggtaatttataaagaaaagacgtttaattggctcacagttctgcaggcttta

SEQ ID NO: 5428 - DNA, 201 bp, Homo sapiens
tgaaaacacgacacacagaaaatatttgcaaattatatatctcataaaagtctagtatccagggtacatagagaacactcacaactcaacaatagaaaggygactccgtttttaaaaaaggcaaagggtctcaatagacatttcttacaagatggcatacaaacagccactaagcacataaaaatatgctcaatacaaaca

SEQ ID NO: 5429 - DNA, 201 bp, Homo sapiens
aaaatcacaatcagatagcacttcacactcaccaggatggctaaattcagaagaatggaaataacaaatgttgaccaggatgtggagaaataagaaacccygtacactgattgtgagaatgtaaaatggtacagctgctatggaaaacagtacgacagttcttcaaaaagctacacatagaactcctatatgatccagcaa

SEQ ID NO: 5430 - DNA, 201 bp, Homo sapiens
tatacacccataaaaaggaatgaagtactgataccttctacaacatggatgggcattgaagacattatgctaagtgaaggaaaccagacgcaaaaggccaygtattatacaattccatttacatgaaatttccagaataggcaaatccatagagacaaaaagtagatccatggtttctagggctggggacaaagggagaca

SEQ ID NO: 5431 - DNA, 201 bp, Homo sapiens
aaatggattctcccctgcagcctccagaaagaacacagcactgcaccttgattttagcccagtgagatgtgggtgaccagtaggattataaattgatgtgytttaagccactgtgtgtaatttgttatagcagcaaagggaaaaaatactaataggatgtgtaacaggcatctcaagtctatcatccatctcagccacatt

SEQ ID NO: 5432 - DNA, 201 bp, Homo sapiens
gctggggagctgatgtcaccactaccccctccgaagcccatccatggggcacagtgcactccactggcagatcccggaaagggagcacgctgactgactgrctgactgactgcctgccacatcaccgtctctgcattgcaattgcaaacattgttgtgcattctgaatccccagtgtctttctgtttttcaccagccatga

SEQ ID NO: 5433 - DNA, 201 bp, Homo sapiens
acagtgcactccactggcagatcccggaaagggagcacgctgactgactggctgactgactgcctgccacatcaccgtctctgcattgcaattgcaaacaytgttgtgcattctgaatccccagtgtctttctgtttttcaccagccatgatcatgacagtgacaacaataacaatacagccttatgctcatagctccatt

SEQ ID NO: 5434 - DNA, 201 bp, Homo sapiens
ataccacactcactgaggactcactaggtgtcaggcaccatcttagcacaaataagatacacaaggcctgtgcctttgggagcttaatttctagtagggamtggaggagaggggcatatggacaataacaaccaaaaaaaatggtaatgtcacagtatgataaaggctgtgaaagaaataaagtgcaagctagagaataat

SEQ ID NO: 5435 - DNA, 201 bp, Homo sapiens
ggtcaaatgtcgttaatataaatatctaccatggggcaatttccgaggctcttacatgcttcgtcctgaggttagcatgaggcaactgcactcactgctaygccttcccacacttattctaagggacagccagctaggatggagtgggagctgatgccctggattaaggtgcctggttaattccacttgcctggtttcctt

SEQ ID NO: 5436 - DNA, 201 bp, Homo sapiens
taaaaacaaatagaacttctctctgcctagaggtttcctttcatgaagataaagtttctagctggaactggctgtttttgcagggaagcacacatgagacragctttttggagtctctccaatacctgcctgtttcataaatggcacagtctccaaatctgatgctcactggaccagggtcaggctatggaactgattaaa

SEQ ID NO: 5437 - DNA, 201 bp, Homo sapiens
ctgactccagaaacaagatggcactctgtctccagtggttccactttacctagatttggagcctccaaaacattgtatggccacactccatctctgcctamgatggaattatgagagagctttggaaaatggctgttccaaaagtgatagtcttaacacaaagatcaggaagaatatttgatttggattaccacccacagc

SEQ ID NO: 5438 - DNA, 201 bp, Homo sapiens
gagatggcctgtttctgtttaacccttaggaaagaaagccaaatgatggttagcaagggagaggatataatgtggtaagtctgagctcctgtctggttatrgctaggaactcagttttcaaggtttctctgggatccccctggccaagaaggggttccatttaattagttggggtggtttaggattttatttttatttcta

SEQ ID NO: 5439 - DNA, 201 bp, Homo sapiens
ccctcctctctacaggactcctccctactggacaattggaatcctcgccaatgttgggctgggagccagcggaatgtaagtgggagtgacagtgccacttscaggagaatctttaagatccatctcttcatctacatccttctcttttccctcttccatgagattagcaatgacctagaaaggagccctccgtcagtctga

SEQ ID NO: 5440 - DNA, 201 bp, Homo sapiens
cttttttatttatttttgggcagggttggggaacagggtcttactctgcgacccaggctggagtgcagtagcatgatctcagctcattgcagcctccatckgggctcaagtgatcctcccacctcagctttccaagtagctgggactataggcatgcaccaccatgcccagctaattttttttttttttttttttttgaga

SEQ ID NO: 5441 - DNA, 201 bp, Homo sapiens
ggctcaagtgatcctcccacctcagctttccaagtagctgggactataggcatgcaccaccatgcccagctaattttttttttttttttttttttgagacwgggtttcaccacgttgcccaggctggtctcgaactcctgggctcaagcaatctgcccacctcggcctcccaaagtgctaggattacaggtgtgagccacc

SEQ ID NO: 5442 - DNA, 201 bp, Homo sapiens
gatcagcgtctgatcctggggccgcgggctgtctggggaacatgcagttctttagtgtctggatatcattagctaatttgtgtgtccaatttcaaagaaawgtttcctccctagaggagtttctactcaaaggactggctatttttggctcccacccactcggctgtgttgtgcgaagccagcatttcctagactatccca

SEQ ID NO: 5443 - DNA, 201 bp, Homo sapiens
agccaaaaaaaaaatagacccaggcaaaataattttgaaatagaaaaacaatggtgaaggacttacattaccctcatttcaaacatattacaaagctacaraaatcaagagagtgtggtattaagggaaagagacaaatcactggaacaaaactgaacgtttagaaataagctctgacactgtcaattgatttttgacaaa

SEQ ID NO: 5444 - DNA, 201 bp, Homo sapiens
aattaactcaaaatagatcttagacctaaatataacaactaaaactataaggctccttgaaaaaaaaattagagaaaaccatcatgtccttgggttaagcrgaaagctcttagacacaaaaccattcattattcttttactagacataaatgaaaaaataggcaaattcatctccattaaaatttaaaacttttgcactcc

SEQ ID NO: 5445 - DNA, 201 bp, Homo sapiens
ctagtcctttcaacaaagaatagaagagtttagtcaaatgaggagtctttgggattggaatggttctagcctcattctctaaataattctacccaaacaayatttaggaataatttttttagagtggcataaacaccataattacatgcacatacttttcatcttttctgttctagaaaaggagtcttcttacagtccaag

SEQ ID NO: 5446 - DNA, 201 bp, Homo sapiens
ctcctacatttgctgcgtagcattggcaccttcactcaagtgacagtattatagtcaggtggcatcgatcagctttaatcagccttatatttaagagctasagtctctgggtgttttagggaatacccgggcaacaaagtgaaaaaaaaaaacaaaaaaccttttgcagtagattgcatgattgcacaactggcccaattc

SEQ ID NO: 5447 - DNA, 201 bp, Homo sapiens
agttactctctgctcagcactaagccacgtgtacagaggagataccaataaggaaaatgactgggtccctggttataatgtcctaaatctgtaatggagtkaatcaacaagacacttgcaaacaaaatggtgagggctcaggaggctgtaatttttaaaaagtgctggactgaggaaaggtgagagttacaggctcagttc

SEQ ID NO: 5448 - DNA, 201 bp, Homo sapiens
tacaggcacccaccacaatgcctggctgatttttgtatttttagtagagacagggtttcaccacgttggccaggctggtctcaaactccttacctccagtkatctgcccgcctcaacctcccaaagtgctgggattataggcatgagccactgtgcctggcccagaaagcattttttaaaagaggaacccagacccttgga

SEQ ID NO: 5449 - DNA, 201 bp, Homo sapiens
cgggtcagaagagatctgcacctgctctgttaaggtagtcttgccatctctaagggtttgatttgctggcttgtttactggagtcagaaacagaataaagktaactcacttcaaaggctagattcaaatgctacttcctagaagataccttcaggaccctccttcactcccaaatagaaggaactctgctttttcaacatg

SEQ ID NO: 5450 - DNA, 201 bp, Homo sapiens
cttggatccgatctgccttcaaaaaagaatgtgtcattcagccactgggggtgcaggttactgacatcctctggcttcagagccctcaggattcacttccrcttttgagctgaggtcacattctgccagagcagtcctcagccagtgacagggcatgagggggacatggggcctggcaacttctgcccaacatggggctcc

SEQ ID NO: 5451 - DNA, 201 bp, Homo sapiens
cgatctgccttcaaaaaagaatgtgtcattcagccactgggggtgcaggttactgacatcctctggcttcagagccctcaggattcacttccacttttgarctgaggtcacattctgccagagcagtcctcagccagtgacagggcatgagggggacatggggcctggcaacttctgcccaacatggggctcctttcatgg

SEQ ID NO: 5452 - DNA, 201 bp, Homo sapiens
gcttcagagccctcaggattcacttccacttttgagctgaggtcacattctgccagagcagtcctcagccagtgacagggcatgagggggacatggggccyggcaacttctgcccaacatggggctcctttcatgggcaacctcttctccaaagctttctgttaggttggcagagactgtctggtctgcatggtggtctga

SEQ ID NO: 5453 - DNA, 201 bp, Homo sapiens
tgtttgttccctccaaactcatgttgaaatgtcacctccagtgttggaggtagggcctggcgggaggccattagatcatgggggcagatccctcatgaacrgcctagcaccataaccctggtaatgagtgagctctcgctcttagttcacatgagatttggttgtttaaaagagtgtggcactgatcccctttctctcttg

SEQ ID NO: 5454 - DNA, 201 bp, Homo sapiens
ggcagatccctcatgaacagcctagcaccataaccctggtaatgagtgagctctcgctcttagttcacatgagatttggttgtttaaaagagtgtggcacygatcccctttctctcttgctctgtctttcaccatgcgatatgctacccccctttcaccttccaccatgattggaagcctcctgaggcctcaccagaagcc

SEQ ID NO: 5455 - DNA, 201 bp, Homo sapiens
cccactcgcaactatgaggaatagatactatcagcagcaacagcaactttttttttaaggacaaagaaagtaaatatgggaaaatgtaaacttgtccaaaracatacatctagtcatgagaaagctgaaacccaaaacagctaagccgatgtatcacagcctctgaatcaccatcactgaaagaaacaacacacttgggga

SEQ ID NO: 5456 - DNA, 201 bp, Homo sapiens
gggcagtgatcaatcatttcagccatcttaaatgagaccagaatagatacaagaagaatctcagccacatataactctaaccatcaagggtattactaacycccaaaatatttcatcttcttgaagttttatggctatggctcttgagtgttttgggggtacagggagatatgggtttaggcagctgaagcaatacctatc

SEQ ID NO: 5457 - DNA, 201 bp, Homo sapiens
tctctccactctcagaaatgcaaacatttatccttttgttgatgttattcaggaaccacttccagcagcctgtacctcccttagtcatgttccttttaacragctcagtttatcaatgtccttcttaaaatacagaactcacacatgagcataaccgaagatacaatatttgtgaagggactgtgaaaacgagagtaggca

SEQ ID NO: 5458 - DNA, 201 bp, Homo sapiens
ctctcagaaatgcaaacatttatccttttgttgatgttattcaggaaccacttccagcagcctgtacctcccttagtcatgttccttttaacaagctcagkttatcaatgtccttcttaaaatacagaactcacacatgagcataaccgaagatacaatatttgtgaagggactgtgaaaacgagagtaggcagaggcaaa

SEQ ID NO: 5459 - DNA, 201 bp, Homo sapiens
cattctgtcatctgttcattcatctgttattgaacctttcaaggtaaaagattagaggattctggccagcagagaaaagagaaaagtggatggatatgaayactatgtagaaggtgtagtcacagggtgaggggtgtgagggaaatggtggcagcaagaagttgagcctgggcatctgggaggatggtggtgccatgccct

SEQ ID NO: 5460 - DNA, 201 bp, Homo sapiens
tattgaacctttcaaggtaaaagattagaggattctggccagcagagaaaagagaaaagtggatggatatgaacactatgtagaaggtgtagtcacagggygaggggtgtgagggaaatggtggcagcaagaagttgagcctgggcatctgggaggatggtggtgccatgccctggaggaggaccagtttgaagaaggaat

SEQ ID NO: 5461 - DNA, 201 bp, Homo sapiens
gattctggccagcagagaaaagagaaaagtggatggatatgaacactatgtagaaggtgtagtcacagggtgaggggtgtgagggaaatggtggcagcaasaagttgagcctgggcatctgggaggatggtggtgccatgccctggaggaggaccagtttgaagaaggaatatcataggagtccaataaatactactagaa

SEQ ID NO: 5462 - DNA, 201 bp, Homo sapiens
gaattcgagaccaacctgggcaatatattgagaccctgtctctatttaaaattgttttaatttaaaaaaatttacaataaataaataaaaataagaaaaamctcccaaatcccaccactctagtacaaccaaagtggccacaccatcacacgtgaggttgttcacagcatccttctctggggatgattctaagtcccttga

SEQ ID NO: 5463 - DNA, 201 bp, Homo sapiens
atagatactgctgtgctagcatacttggaaaccaccatatatgttcttggaaattcaccaagcacattaccatgttaggcagacttattactattctgcartatctgcaagtaacatagaagcaaaaaaagcacataacacataaaataattacacatagacctgaggtagaaaacaaataatcagaggagaaggcaagag

SEQ ID NO: 5464 - DNA, 201 bp, Homo sapiens
gtctgaagtaattaggttaagaaaagttagtttaacacatacatccctgaatagcagaaactgaatccaccacagatgtacttcttactcgtctgaagtcraatgtggatgtttgtattcagagggcggccctctgacaagtgacgattcaggggctcagctcctttcatcttttggttctgccaccttcaacatatggct

SEQ ID NO: 5465 - DNA, 201 bp, Homo sapiens
gcttacagttcccaggcccacagcgtcagcagcagcggcagcagcggcaggcggccgcgcgggtgtttgtcgcttcgcggggccttgcggcagcatggcgraccatctgatcagtggcggcaccggctacgtgccccaggactggctcaccgtgcagcagctcttcctcggcgccaactgccgcacccacaacaacttcct

SEQ ID NO: 5466 - DNA, 201 bp, Homo sapiens
aggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttca

SEQ ID NO: 5467 - DNA, 201 bp, Homo sapiens
ccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagc

SEQ ID NO: 5468 - DNA, 201 bp, Homo sapiens
catcaactttcttgctgagaaggaccacaccaccctcctcagtgaggtgatgacgccaaggatcaagctgatggtggctccagcaggcatgacattgaaasaggcaaatgagatccttcagcctagcaagggaagctgcctatggtcaatgatcgccatgagctagtggccatcgtctcccacaccaacctgaagaagaat

SEQ ID NO: 5469 - DNA, 201 bp, Homo sapiens
gcctagcaagggaagctgcctatggtcaatgatcgccatgagctagtggccatcgtctcccacaccaacctgaagaagaatcgagactacattctggcctycaaggattcccacaagcagctgctgtgcagggcagctgtgggcacccatgaggatgacaaatactgcctggacctgctcacctgggtaggcatcaacgtc

SEQ ID NO: 5470 - DNA, 201 bp, Homo sapiens
cccacaccaacctgaagaagaatcgagactacattctggcctccaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattaca

SEQ ID NO: 5471 - DNA, 201 bp, Homo sapiens
cacagcagtgccctggggctgaccgcaggccatcacttcctgggtgatgcagatagagctgcagcccataactacatgcagtccatccacaccagtgtcartcaggttcttagcctgggctgctgtcaccacattcctcccaatcacctggaggtggaggtacttctgtttgatgtaatgcaccatggtgatttgatacac

SEQ ID NO: 5472 - DNA, 201 bp, Homo sapiens
tacctccacctccaggtgattgggaggaatgtggtgacagcagcccaggctaagaacctgattgacactggtgtggatggactgcatgtagttatgggctrcagctctatctgcatcacccaggaagtgatggcctgcggtcagccccagggcactgctgtgtacaaggtggccaagtacgctcagcactttggtgtgtcc

SEQ ID NO: 5473 - DNA, 201 bp, Homo sapiens
aagtatcgtttctggctgctgctgctcttctccatggcatctagcgagcccatgccccagtacttcttgagctgcaccctgtctgagaagaagtactcgcygctgggcctccgtggtggtggccagcagggagcccatcatcactgtggaggctccaagggccagggccttgaccacgtgccccacggtctggatgccaca

SEQ ID NO: 5474 - DNA, 201 bp, Homo sapiens
ccactgctatcctcagtacagctgcttctggtaagcgtgcaggccatggacgccaccctcgatctgggctgacatggtccacttctcaaatttgagctctyctgagtacatcatggagccatgctggttactcgctatgaggtagggcacaaacttctgaatggaccctttgtcctggatggaggccgagacaccctgcac

SEQ ID NO: 5475 - DNA, 201 bp, Homo sapiens
ggaagcttaagcaaaatgaagcaaaggggaattacttcagttaagttttactttagagcagatgctaaagcaagaaactggggggacatggtttagttggraggtgatcacaggaagtgtggtgaggaagtagaaaaataagacaggaaaggaaaagaagccagcagcagggaaattcatgggaaggttacttctggggat

SEQ ID NO: 5476 - DNA, 201 bp, Homo sapiens
agaagccagcagcagggaaattcatgggaaggttacttctggggataacagggatttaaccccacaagggccctccaataacagtgtaggacacacctcaktactgtctccctgagcagcaaagaagccagggtatgccaacttctatccctcatcattaaagacagttctggggggcatttatttatcccctgccacttc

SEQ ID NO: 5477 - DNA, 201 bp, Homo sapiens
gagcagcaaagaagccagggtatgccaacttctatccctcatcattaaagacagttctggggggcatttatttatcccctgccacttcaggtctgccataygcaggagccaaacacaatcgtatggccagagaacattcttaggcagagagatgcctgtgcttgaggtgagaagccatcactgtgttgggaactgtccatc

SEQ ID NO: 5478 - DNA, 201 bp, Homo sapiens
actcaagtttgaggtaaagtctcatttcacctcactgggtcttcctggaccagataaccatccccgaactgttcacagggaccaggagcatataatgaccrcattgttccagcactgaaccatatgctccatctctgcaccaggaggaatctctacaaaaagctcaggggctacagctggggagagggcttaacagagatt

SEQ ID NO: 5479 - DNA, 201 bp, Homo sapiens
aactgttcacagggaccaggagcatataatgaccacattgttccagcactgaaccatatgctccatctctgcaccaggaggaatctctacaaaaagctcasgggctacagctggggagagggcttaacagagattgattacatacaattaccagaagaatggaaatgagtgttaagataaaaaatacacaggttcattcca

SEQ ID NO: 5480 - DNA, 201 bp, Homo sapiens
ggttctcatttagactcctgtcacttatatctctggctaataaagggaactatggtcacccccaccccaccccacgcagcaattgtagtttttcccgcccsgatacttgcgacatcaatgtactgctgtgggtacagctctacaagcacctgttttgcaattttcaggttaacaagtaaaatcttccttgagtgtatacct

SEQ ID NO: 5481 - DNA, 201 bp, Homo sapiens
catgcccaatcctctggtaggtaattaggatatagaaattgggcacaatctatgtcttccagtcctggtatggcggagaagaaaagattcaagtagcagayagactgctgtatctaaaaacttgggttcttttcccagctccatcttaaactgtgcagaaagagaattctgctaaactctccccactgctgaataaagtgt

SEQ ID NO: 5482 - DNA, 201 bp, Homo sapiens
atattgatttattctacttgatcggaaatcatcagtagtccaattgtcctttctaatggaagatcagcataaacaaagtcacattcaggccaggactcttragaaaggggcgtgttttctcctcacttatttttctgctgattggaaagaaaagacagtgagatttaggggactggaagagccacaatatggcagaaatct

SEQ ID NO: 5483 - DNA, 201 bp, Homo sapiens
ctttctccgttctcctatttaacctactgggctttaaagccagtggccctttttcttagcttcctcattcatgaaacagttttctggggaggccctagaaytttacctctgtattaaaatgatctctattttcttttcattaagggaaaaatatacaaggggggtggatgcagggggcaaggagtgggtaagcagaccaga

SEQ ID NO: 5484 - DNA, 201 bp, Homo sapiens
tcattatgctgcttctttcattgcacaggaacgtgggggttttctctaaactatgactcatagcaaagcatacaggcaatcgtgtagagaaacctgttctycccaggaaaggagggtgagcaaatgctaaaagttttgatactttaatatagcactggccgtggctaattttacttaatatgaaagatttcaaataatgga

SEQ ID NO: 5485 - DNA, 201 bp, Homo sapiens
acttaatatgaaagatttcaaataatggaaacactgacaggcaaaaacattaaaagtttgcataaaatctcaaaaaaccctgcaaacaagagagaagcatkgtctaattaaaataaaggaaaagattgctactgggttcctgaatactcttttcacaaaggcttcacgtcagatgaacttcaagcaccaagcagcagggat

SEQ ID NO: 5486 - DNA, 201 bp, Homo sapiens
ctgagattctacattcaggctcccagaggatgtcaaagctgctggtgcatggaccacactttgaatgatgagatctgtttagctggttggtaggtacctgrtggctgagctttcaaactctgtaatcagactacctgggtttgcatccagcctccactgtttaccctttcttactgtgtgcctcagcttccacatttgcag

SEQ ID NO: 5487 - DNA, 201 bp, Homo sapiens
tcaaaatccacttgccttgggagaaacgcttgaacctgggaggtagagattgcagtgagcagagatcgtgccactgcactccagcctggcaacagagattmagtcttgaaaaaaaaaaaaatccacctgccttggtacaagatgggaaagtctttgggtgtttattggctgtatgttcaagatgaatcacctgtgagctgt

SEQ ID NO: 5488 - DNA, 201 bp, Homo sapiens
tagcatcatggtatatttatatataagaataattgcctgtttatctgtctccccagcctttttatagcatgaactatgtccttcaccactgtatccctagsaactagcacagagcctggcacctagctcacaatcaataaatatttgtggaattgatggatgaattcaggcactggaagcaagaaaagggccagcaccacc

SEQ ID NO: 5489 - DNA, 201 bp, Homo sapiens
gtcacaccagagagtctaacagtgtgatttagagtgggggcttagaatcacatagcatgagctcaacctccagaggacctggaagccaaggtcacccatayaagaactcaacagcagaccccaaaaaagactctgcacgccaaggctcagtgagcttcccttgttggcaacgtcccatgcttattttcatccgttgttgct

SEQ ID NO: 5490 - DNA, 201 bp, Homo sapiens
cagaggacctggaagccaaggtcacccatataagaactcaacagcagaccccaaaaaagactctgcacgccaaggctcagtgagcttcccttgttggcaamgtcccatgcttattttcatccgttgttgctgagaaggtggcactgtccatgattccgtaggaagatcaccactggcagctcacggttggacctttcatga

SEQ ID NO: 5491 - DNA, 201 bp, Homo sapiens
aggacctggaagccaaggtcacccatataagaactcaacagcagaccccaaaaaagactctgcacgccaaggctcagtgagcttcccttgttggcaacgtyccatgcttattttcatccgttgttgctgagaaggtggcactgtccatgattccgtaggaagatcaccactggcagctcacggttggacctttcatgattc

SEQ ID NO: 5492 - DNA, 201 bp, Homo sapiens
agactctgcacgccaaggctcagtgagcttcccttgttggcaacgtcccatgcttattttcatccgttgttgctgagaaggtggcactgtccatgattccrtaggaagatcaccactggcagctcacggttggacctttcatgattctgcctatgtgtccctcttttggctgattttagtctgtatccttcagctataaca

SEQ ID NO: 5493 - DNA, 201 bp, Homo sapiens
gctgctccccctctctccaacagatgactgggcaaaaatagaagagaatccctcctttataaatatctttacatgctaaatgtctctataaagcaccatgmgccaagctaggctgctaagaaacagatgcaaaacagatgcaaagatccatgagatagctgagaagttaaagaattttaattcaacaaaaggcaagaaaag

SEQ ID NO: 5494 - DNA, 201 bp, Homo sapiens
ttccagaaagataaaggaccaagggaaaagagagcaggatttggtctgagatataagcaggagattatggtgctccttctaggccacagcaagcaattgaytttaattctaggtaaaatggaaagctggaggaagattttaataaagatgcatgtgattcaagatatgggttttgtcatcgttcttactcactcgaccagc

SEQ ID NO: 5495 - DNA, 201 bp, Homo sapiens
tgatcataggatgtcaaagctggaagaagataccagtttagaagatgctgctgtcactgaatgcagatttcataaggagttgcagtgaaggtagaagcatktttcatggatctgtgttaagggcagagctagaagcccttgctgatggtttctacatagcaggtaagagggagagagaaatcaaaggtgacttgtaggttt

SEQ ID NO: 5496 - DNA, 201 bp, Homo sapiens
tgcccctgacgctagcacagtgcccgcccggcagggagcagacatcccctcccaccccccaatgtccccactgatgtctgttgatcaactagatgatagasagtgagtggaaaagaaaggcagaggggggacccactcttgttccttggtgccagggtttaaagaggtttggctgcatctagcgtgttttctcagatgctc

SEQ ID NO: 5497 - DNA, 201 bp, Homo sapiens
gcagcaaattcactgcgtgtttactttagctctttcccacatcagactgaaaccaggtctgcttctattttgtgcccctgacgctagcacagtgcccgccyggcagggagcagacatcccctcccaccccccaatgtccccactgatgtctgttgatcaactagatgatagacagtgagtggaaaagaaaggcagaggggg

SEQ ID NO: 5498 - DNA, 201 bp, Homo sapiens
ggaagccccctggccccctcatcccccaaacagcagcaaattcactgcgtgtttactttagctctttcccacatcagactgaaaccaggtctgcttctatyttgtgcccctgacgctagcacagtgcccgcccggcagggagcagacatcccctcccaccccccaatgtccccactgatgtctgttgatcaactagatgat

SEQ ID NO: 5499 - DNA, 201 bp, Homo sapiens
aatgagactccttctcaaaaaaaaaacaaaaaacaaaacaaaacaaaaaaaacaaaaacccaccctagatattgccaaatgtcccctggcctagataattscaactagtccttcaaaaatcagggcagtgtcacctcctccaggaagccccctggccccctcatcccccaaacagcagcaaattcactgcgtgtttacttt

SEQ ID NO: 5500 - DNA, 201 bp, Homo sapiens
tcttaaccccagcactgcgaacatttggggctggataactctgcattggagggggctgtcctgcacacactgtaggttatttacaagcatccctgtcctcyacctactagatgccagtagcaactccaccttatccccagtttggacaacagaaaaacctagatattgccggccaggcgcggtggctcacgcctgtaatcc

SEQ ID NO: 5501 - DNA, 201 bp, Homo sapiens
accacagcacttttcctcctcttgtctagacctgtgtttcttaaccccagcactgcgaacatttggggctggataactctgcattggagggggctgtcctscacacactgtaggttatttacaagcatccctgtcctccacctactagatgccagtagcaactccaccttatccccagtttggacaacagaaaaacctaga

SEQ ID NO: 5502 - DNA, 201 bp, Homo sapiens
ctatcactttggagatcaagatttcaacatatgaattctagggggacgctaacattcaaaccacagcacttttcctcctcttgtctagacctgtgtttctyaaccccagcactgcgaacatttggggctggataactctgcattggagggggctgtcctgcacacactgtaggttatttacaagcatccctgtcctccacc

SEQ ID NO: 5503 - DNA, 201 bp, Homo sapiens
tctagagatttttgccttgcctggcttgccctaatcccattcatgacttaatcacctcccaaaggctccaccccacctcagcctatcactttggagatcargatttcaacatatgaattctagggggacgctaacattcaaaccacagcacttttcctcctcttgtctagacctgtgtttcttaaccccagcactgcgaac

SEQ ID NO: 5504 - DNA, 201 bp, Homo sapiens
ttcatctccatctgacagcttctctactcctatttcttttattattggtttttattttttagagacagggtcttgcactgtcacccaggctggtgtgcagyggagtgatcagagttcactgcagcctctacctcctggactcaggtgatcctcccacctcagcctcctgagtatctgagacaggcgcatgccaccacaccc

SEQ ID NO: 5505 - DNA, 201 bp, Homo sapiens
gaaacatggtgatcacttctccgcttgcatgcactaacagcccgcatttgaagcctctccccgccgtgtgcagccctgccaccctccaccgcacccgacaygcattatccagagtgatcattctaaaaagtatattggactaagttacttaaaacctgcttaaaacactttaatgtttccccttccctaagataaagtcta

SEQ ID NO: 5506 - DNA, 201 bp, Homo sapiens
aaacgaccctgttgtataactgcattccattgcactgcattaactaaaccaattctaagttcttttgtggaaacatggtgatcacttctccgcttgcatgyactaacagcccgcatttgaagcctctccccgccgtgtgcagccctgccaccctccaccgcacccgacacgcattatccagagtgatcattctaaaaagta

SEQ ID NO: 5507 - DNA, 201 bp, Homo sapiens
acaacgcccggctaattttttttttttgtatttttagtagagatggcgtttcactgtgttagccaggatggtctccatctcctgacctcgtgatccgcccrcctcggcctcccaaaatgctgggactacaggcgtgagccaccgtgcctggccagtattattttttttaagattgtatgcatcttcataccatctctcctc

SEQ ID NO: 5508 - DNA, 201 bp, Homo sapiens
gctgggactacaggcacccgccacaacgcccggctaattttttttttttgtatttttagtagagatggcgtttcactgtgttagccaggatggtctccatstcctgacctcgtgatccgcccacctcggcctcccaaaatgctgggactacaggcgtgagccaccgtgcctggccagtattattttttttaagattgtatg

SEQ ID NO: 5509 - DNA, 201 bp, Homo sapiens
agtgcagtggtatgatcttggctcactgcaaactctgcctcctgggttcaagcaattctcatacctcagccttcccagtagctaggactacaggtgcttgycaccatgcctggctaatttttgtatttttagcagagacggggtttcaccatgttggccaggctggtctcgaactcctgacctcaagtgatccgcctgcct

SEQ ID NO: 5510 - DNA, 201 bp, Homo sapiens
aactggctcagggccgggcatggtggctcatgcctgtaatcctagcacttcgggaggctgaggaaggctgatcacttgagaccagaagtgcgagaccatcytggccaatatggtgaaaccctatctctactaaaaatccaaaaaattagccggaatgttagcacatgcctatagtccctgctactcgggaggctgaggcag

SEQ ID NO: 5511 - DNA, 201 bp, Homo sapiens
tcctatcaaccgggccaaacaaccagcaaggaacacctgctgaaaggtgaagaggacagagccttggcagagattaatgccttcctgatgccaggcggccrtgagaactgagattggcagtgtgaaggtccaccttctctgcaaccaaatcataagtgtcccatagacaaaggctttgtgtttatctgccttcagactggt

SEQ ID NO: 5512 - DNA, 201 bp, Homo sapiens
gactcccagctgcaactcctaacataagtctctgctcatgtgaaagagttcagtgtcctcacccaatggagagtttccttatcattgtccttaaccaatgragagtttcttgtgtccatatatccagtgtccttacccagtggagagtttctcgaacccatgactacaccatgcttttaagcacaccaggctcctaggata

SEQ ID NO: 5513 - DNA, 201 bp, Homo sapiens
tctgcctgactcccagctgcaactcctaacataagtctctgctcatgtgaaagagttcagtgtcctcacccaatggagagtttccttatcattgtccttamccaatggagagtttcttgtgtccatatatccagtgtccttacccagtggagagtttctcgaacccatgactacaccatgcttttaagcacaccaggctcc

SEQ ID NO: 5514 - DNA, 201 bp, Homo sapiens
agacatttaccatgtgttccaagtgctttatataaattaactttcagcccttgcaacccaccttcaaaggtaaatactatcattatccccatttcacagaygaggaactgaggcaccaaggaaaatgaaaactttccagtaggcacacccctagaaagtggtggattcagggttgaacgaacacagtttaatgccggtctc

SEQ ID NO: 5515 - DNA, 201 bp, Homo sapiens
tgatctaaatgccacctctgctgagtttcttttagcgccttttgcattatgaaaagtcagtatctcattgaatcttctcatcaaaacagccagacatttascatgtgttccaagtgctttatataaattaactttcagcccttgcaacccaccttcaaaggtaaatactatcattatccccatttcacagacgaggaactg

SEQ ID NO: 5516 - DNA, 201 bp, Homo sapiens
tccacgtggccaccagaggatgcttctggaaggtaaatctcatgttcaccaccatccaccctggctttaaaatctttagtggtttctttctgctcttatarcaaagatgcaacacccaaatgtggcctgagggtctcagcacggttctgctctgacctccttcactcttaccctccaagcaccagggtcttctcaggcaat

SEQ ID NO: 5517 - DNA, 201 bp, Homo sapiens
ctttgtcgtggtcagtgctgcgttcctggcacccagcagagagcccgtagacagtggtgcacaataattacccatggaatggtgaatgtttcttagcaacygtaacttactgcctgcactcctctcccctgcagccagttctccacgtggccaccagaggatgcttctggaaggtaaatctcatgttcaccaccatccacc

SEQ ID NO: 5518 - DNA, 201 bp, Homo sapiens
aatgtcagcacaagaggtttttcctgcctaaatggcagccaatatgctctagtctctcgccctgcttttaagtatttcttcccagccacactgcttcctgmcacattcattcacttgcttgtccatttgccgtctctgtccttatacagaaacgtcatctctctaaggcaggggctttgtcgtggtcagtgctgcgttcct

SEQ ID NO: 5519 - DNA, 201 bp, Homo sapiens
tgttgccctgggggtgaagatgctacctgaaaacccacatatcctggaaaggtctcacacaaggatcaggcgttttcagacagaaaggttttcttgttgaygttttctactgcattctctcttaagctcaagactttttattttgtgttttttacattgatgagttataaaggggcctctctcatctttcccttcttttta

SEQ ID NO: 5520 - DNA, 201 bp, Homo sapiens
actcaggaggctgagacaggagaattgcttgaacccgggaggcagaggttgcagtgagctgagattgcgctactgcactctagcctgggccacagagtgasactctgtctccaaaaaaataaataaataaataaaagtatatatatacaaaaagaaactcaatggaggctgcagcatcttcaaagtttatcactgattgtg

SEQ ID NO: 5521 - DNA, 201 bp, Homo sapiens
atgccccaacatttattttggggatacggcatatgtctcacctagtctgggactaaaaagtttcctgccttattcatgcaggggcttcttcatggtttgcrtaaggcagccaattaaagtagaaactcagacctggcacaatgctcacgcctgtaatcccagcactttgggaggccgaagggggtgtagatcacctgaggt

SEQ ID NO: 5522 - DNA, 201 bp, Homo sapiens
aagtggaccctcccgtggagatggctctatttcaaatcaaaaccccatcgcaccaccacccaagggcttccttttgcctttccctaatccactttttgccyagtgcttattatcagctgacacattaaatatttgttatgtttctgttggcctctcctcacacaaagaagacaggtttgttgactgctgtatctccagcat

SEQ ID NO: 5523 - DNA, 201 bp, Homo sapiens
aaaaagtagcttcctcatggtattattgtgaaaaataaaataaaatgcttggtgcactgtccagcatgtacagggaatctattgctattatttattattgktactaacagcattagatgcatttcctttctctgcatcttgaaggtagtctatgcaaagtacccagcatagcctgtaggatatctccaggccattagagag

SEQ ID NO: 5524 - DNA, 201 bp, Homo sapiens
ttggacacatgactgcttggagattgagagccaaattcaaatcccaacttaggttctcactaattggatgagttggggcaagtcacgtcaccttcctaagsctcagtttgctcctctgtataacaagagtaataaaaagtagcttcctcatggtattattgtgaaaaataaaataaaatgcttggtgcactgtccagcatg

SEQ ID NO: 5525 - DNA, 201 bp, Homo sapiens
agaatctctgtatgctcactacagaaaaaaataaaaaaatatctagagcatgaggacacagaaaggacttccagaatcccccacccagtggcaaccacttkgacacatgactgcttggagattgagagccaaattcaaatcccaacttaggttctcactaattggatgagttggggcaagtcacgtcaccttcctaaggct

SEQ ID NO: 5526 - DNA, 201 bp, Homo sapiens
gctaggggatgcaaaatctcatgggtagagatgcagccttgcttcagagaaatcttactgcaaaccctggaggccagactttagacaggattgcaatgacmttatgtatccgaggcagtggaagtttcctctaaagaaaaaatgggaggcaagtggcttgaggaagtcaggcacagcgagcttcgtagccagggtcctgga

SEQ ID NO: 5527 - DNA, 201 bp, Homo sapiens
tgaaggaattaaaacaccaaaaagagccttggtatttcctctcatcttggttcaataacctcttgtgagaaaaaagttttcagtgcgtgtcgctataaatragcatgattggcttgccagttgaacctacaaacagaaataatgtgagaggtcacaagtccactcatttgcactggacttccaaagagttttgtcatgcag

SEQ ID NO: 5528 - DNA, 201 bp, Homo sapiens
tgatgaaagaaatagatgtgaaggaattaaaacaccaaaaagagccttggtatttcctctcatcttggttcaataacctcttgtgagaaaaaagttttcastgcgtgtcgctataaatgagcatgattggcttgccagttgaacctacaaacagaaataatgtgagaggtcacaagtccactcatttgcactggacttcca

SEQ ID NO: 5529 - DNA, 201 bp, Homo sapiens
caacaaacaaaaagagggccacagctgcccccagtgttcagctgcattcccaagctagagaacgagacacttccaaatctgaaataactcatccaactgargcagggctctataaacaacagacaagtaaaatacattgaataaatattacataatctattttctttagtggttgtgtctgtatatatgtgggtacattca

SEQ ID NO: 5530 - DNA, 201 bp, Homo sapiens
taaccacctggtattgagatggtagattccgactgagtccactcaggctgatcttagaccgagttggcaacaaacaaaaagagggccacagctgcccccartgttcagctgcattcccaagctagagaacgagacacttccaaatctgaaataactcatccaactgaagcagggctctataaacaacagacaagtaaaata

SEQ ID NO: 5531 - DNA, 201 bp, Homo sapiens
gtgggtgggagagggaagaccacagctgggtcccctaagcagcctgtaccttcccagctctaaggcagccatgagacctaggtagtgaatgaatggactgstcaatgacggctctattcaacacatatttattgaacatctatgttgtgtcagactctgccctcctggaatccctcctggatggccctgtgaggggaatct

SEQ ID NO: 5532 - DNA, 201 bp, Homo sapiens
atggtgccacctatgatgctgtaaggacaagataaaagtaagtacatataaagcaccaagcatagtgcttggcccatgttaagagctcaataaaaagcatkattttactataattatgatcatcattattatcattgctactcccctgccaggtttagcaggggtcctacctgtaccagctccaacataaagagccacagg

SEQ ID NO: 5533 - DNA, 201 bp, Homo sapiens
ctggattcaagagagtcatactagctatacgatacaaggttaattgttctgattctcagctgcaaaatgaggataaataatcatggtgccacctatgatgytgtaaggacaagataaaagtaagtacatataaagcaccaagcatagtgcttggcccatgttaagagctcaataaaaagcattattttactataattatga

SEQ ID NO: 5534 - DNA, 201 bp, Homo sapiens
ggtggtaatcatttcacagtctacacactcatcaaaacatcacattgtacaccttgaatacaaaccactttatttgtcagttaaacctcaataaagctggraggaaaaaaacagtataccaaagaaatgaaaagatgggccaggtgcagtggctcacgcctgtaatcccagcactttgggaggctgagatgggtggatgac

SEQ ID NO: 5535 - DNA, 201 bp, Homo sapiens
gtgaagcgattagatcttaattatactcacaccacatacacagacacccaaaatggtaaccaacagtcgtgaaagatgtgttaattaattcgatggtggtratcatttcacagtctacacactcatcaaaacatcacattgtacaccttgaatacaaaccactttatttgtcagttaaacctcaataaagctgggaggaaa

SEQ ID NO: 5536 - DNA, 201 bp, Homo sapiens
attattaagttgtaaaaattagaattagattatgcatggaaagcatctatcaccgtctggcatacagcagaggcacaataaatggaagatattgtcacaakgatagcaaggaggaaatgtttaatctgtaaggatttcaaagagggaagctaaaattgtatttctaagcagaaatttgtggacccattttaatgaaaagat

SEQ ID NO: 5537 - DNA, 201 bp, Homo sapiens
tttgatacatgaaagctactgtttatcattgttttataattatcactattattaagttgtaaaaattagaattagattatgcatggaaagcatctatcacmgtctggcatacagcagaggcacaataaatggaagatattgtcacaaggatagcaaggaggaaatgtttaatctgtaaggatttcaaagagggaagctaaa

SEQ ID NO: 5538 - DNA, 201 bp, Homo sapiens
aaaaaatattttttttggaaaacgtgtttttaacaatgatcatccatttcccaataagtccaaggaagtgttgatctccaaaaaaaaaaaaaactgaatcycaacgtaagtttgtgaccttgagcaaattgcaggatctgtctgtgcctcagttgccccattaataaaaagagggaagtcacctcactgctaacacttcat

SEQ ID NO: 5539 - DNA, 201 bp, Homo sapiens
gggcatgcctgcactgccagtcaccccccacacaccgtgcaccccagctccgctttcaccatgaagatgagcaggaaagaaaactcatctcccaacccgasgttgctctgattctctaggtcccagaatctctgagttgcagacaccttggaaatcctcattgtcataagcaagaatgccccagagttacagctccacctt

SEQ ID NO: 5540 - DNA, 201 bp, Homo sapiens
ccacctattgctgatgctgcacgagggaaactctatccagggaggtgattgtcctggtgccacggcactcacagctgggcatgcctgcactgccagtcacyccccacacaccgtgcaccccagctccgctttcaccatgaagatgagcaggaaagaaaactcatctcccaacccgacgttgctctgattctctaggtccca

SEQ ID NO: 5541 - DNA, 201 bp, Homo sapiens
tctcagtaaggtaagaggaggctggtgttttccagaaacagaagagaagaaggtggggtttctgtgctagcaccagaagacacaaactggaggcagcaatmccactgcagttgatgtgacagaagcccctggagaagagttcaccaaaacgtgaaaggggagtccagcagctgcgtgctaagggggtgtggctctcagctc

SEQ ID NO: 5542 - DNA, 201 bp, Homo sapiens
agactgtatgtgaaaaaggaccctaagatgaaacagtggtgggtgttataagaattctgatctcagtaaggtaagaggaggctggtgttttccagaaacakaagagaagaaggtggggtttctgtgctagcaccagaagacacaaactggaggcagcaatcccactgcagttgatgtgacagaagcccctggagaagagtt

SEQ ID NO: 5543 - DNA, 201 bp, Homo sapiens
acgtggctttccaattttctacgatgagagtagttacttttacatttagaagaatcaaatgatatgacttttttaaagagatgagttattaaaaggagacrtgatcagaagacatttagcttcgtttaggaggcaaagcagatgcacgtgggccatttcaaatagaaaaccataagactgtatgtgaaaaaggaccctaag

SEQ ID NO: 5544 - DNA, 201 bp, Homo sapiens
tctattctctaaaatattgcactgaaatggtatttaccttgataacttaattgtttggcacccttttaaattttgcatccaaggagggattcttaatctcytcttccttgtcctggccctgatacgtggctttccaattttctacgatgagagtagttacttttacatttagaagaatcaaatgatatgacttttttaaag

SEQ ID NO: 5545 - DNA, 201 bp, Homo sapiens
tcattacacattaagataatcattacacgattaatagataatcattacacgttgttaagtgctacaatggcagcatgatagggcacttgatgagtcttggkggggcggcagtcagagaagactacctgggggctggggatcatgaaagaaggcaggaggggaaatcatttctgcacaggttacagtagactgagtgcatgt

SEQ ID NO: 5546 - DNA, 201 bp, Homo sapiens
tggaaaatggccccaggccactgctgcttaatgggccatgatggatgaacacagatctagagaaatgattgtttaccaactaagggatcagagcctatggscctctttctgtcctctgaagagcatgctgctactggggcaaatgagtttgagtccagagccgacaatgagcaggtgatcaagccccaagtgaaatggcct

SEQ ID NO: 5547 - DNA, 201 bp, Homo sapiens
cactccagcctgggtgacaagagtgaaactccatctcaaaaaaaaaaaaaaaaaaaaaagtggtaggcatggcctgagcacgggaaacccagggtaatgtragaggcgcagagaagaggccccctaattcagcctgcaatggtgcagtggagtgggggacagtcaggaaagacactttggatacctgagcgttgtttggtt

SEQ ID NO: 5548 - DNA, 201 bp, Homo sapiens
ctactaacaccttgattttagctccatgagacccatttcagctttctgacctgcagaactgtaggataataaatttgtattattttaagccagtaagtttrcggtaatttatttcagcaataggcaactaatacaccatgtatcaactgcaaacaattgttgcagttctagaaagctggcccaatttaccagttcttgggt

SEQ ID NO: 5549 - DNA, 201 bp, Homo sapiens
caccttttatacctgatctccagcccctcaaagggttgtattaatgcatttaaccctcatatgctaaatttcatttctaattataggataaccacaggaaraatggttatccagaccagccctttaactcaagaatcacaaatgcaacatctagcatggagaagcaggtaaagaaaataatgtaaaccttgttcaatcgat

SEQ ID NO: 5550 - DNA, 201 bp, Homo sapiens
agaacagagcacagattcaatgttgaattgaactgattatgtgacatcctgcaaacaataaaagcatcacttttaaagaacttaaagttccttctcacacmttttatacctgatctccagcccctcaaagggttgtattaatgcatttaaccctcatatgctaaatttcatttctaattataggataaccacaggaagaat

SEQ ID NO: 5551 - DNA, 201 bp, Homo sapiens
ggagaccatagcatagataagaggtcctcaaaactaatggatcatgagcagctgtgaggtgtgatgcactaattagttaggatcccagtccaatcagtgawacttggaaatgattttggctttttttgtaagctacagcacattcaaggtcatttctataataacatcattcttactcatttacaatctgaaatgttttct

SEQ ID NO: 5552 - DNA, 201 bp, Homo sapiens
atgctaattaattatttttttttaatctaagttacccagtgttggtttcatctacctgctgccctactgcagaatcagaaagtgggaatctgctttgtggygggatgacgttcaccaagcatcgttcagggctggttcaccatgatgcctgtccaaacccctgagcacctagtgtctgtaccacacatgtaagtacttaat

SEQ ID NO: 5553 - DNA, 201 bp, Homo sapiens
cattctccaaacatttccaacacaggaggaaaaacacaaggtcagggccgattcactgactgctgtgtgctgaagtaactgcctgtcagatcctccttcayggatccctagagaggctctccttattcattgcagatgcacgctttttgcagagcacccttgaaacatgctaattaattatttttttttaatctaagttac

SEQ ID NO: 5554 - DNA, 201 bp, Homo sapiens
atatctagcttttactttgtacactaatacaagaagaatcctcacctaggtgagtttccacagccttatttttcttagtcctccagagttttcaagagaaycttattccacagacaggaaaaataactaatgggtactaggcttaatacctgggtgctgaaataatctgtactacaaacccttgggatatcagtttacctg

SEQ ID NO: 5555 - DNA, 201 bp, Homo sapiens
ataagtgcccttttatttgtgattcggctcaattcccaaggacggcacaacccctagactcagaccaggaaaggcagtggtaacaaacagggagacctggrcaggatgggggttgcaatagagtctgtgcctgagctcacctgggcacccaccccacatgttcctcaagggtcttgcttgcagggagctcagtgatataag

SEQ ID NO: 5556 - DNA, 201 bp, Homo sapiens
tcaatttgctggtaagtgaccactttgatccataaagaaggtgattttgaaaggcttagccaaatacatactcagacaaaatgatgtacaagaaacagcarttcctccaggaaggaagcttagaagaaaaaatacttgctagacacatacagatgctgatttaatttttgtaatcccatgtgggtattgcctattcaaaac

SEQ ID NO: 5557 - DNA, 201 bp, Homo sapiens
ggagatttagcagtaaacaaaacaagccctggctccatttagcttacactctgatggagagagacaggcaatacactaatacagatgaaaatacgttataygtcaagtgctgataaagtcccgtatttatgctggaatttgggtgaatcatgtcaatttgctggtaagtgaccactttgatccataaagaaggtgattttg

SEQ ID NO: 5558 - DNA, 201 bp, Homo sapiens
tatttacccagtaatggggttgctggatcatacagaagttctacttttagtatgaggaaactccataccgtttttcataatggctgttctaaattcccacsagcaatgtatactagttctctttctccacatccttgccagtatttactttttgtatttttgataatatcttttctgagctgagattatatctcactgtgg

SEQ ID NO: 5559 - DNA, 201 bp, Homo sapiens
agcagcagaatgtgtggcctcttggtttgccaagcctaaaatattgactatctgggcttttaaataaaacacttgccaattgctgctttacaatactttcyggtagcttatcaaaataatcttgggatcttttaaatatgcagcaccttaagcccagaatctgaattttaactagtttcccaaggttcgagaatccttgca

SEQ ID NO: 5560 - DNA, 201 bp, Homo sapiens
gccctttcctgtattgtctgtggctgcctttgtgctatagcagcagaatgtgtggcctcttggtttgccaagcctaaaatattgactatctgggcttttamataaaacacttgccaattgctgctttacaatactttctggtagcttatcaaaataatcttgggatcttttaaatatgcagcaccttaagcccagaatctg

SEQ ID NO: 5561 - DNA, 201 bp, Homo sapiens
ttaggtgtaaatcctgggaatactcaggtctcagggaactactccaaatgatgtacaaacctagagtttccatttaggcaaaagtttctaataaagtaagrcttcttcactaaatactatcagttgcatactcacacgctggcagaacaaagactgcagggtgtttcagcatctccataccaacagctagaacagattcct

SEQ ID NO: 5562 - DNA, 201 bp, Homo sapiens
gcaaatataaaccaagttaggtgtaaatcctgggaatactcaggtctcagggaactactccaaatgatgtacaaacctagagtttccatttaggcaaaagkttctaataaagtaaggcttcttcactaaatactatcagttgcatactcacacgctggcagaacaaagactgcagggtgtttcagcatctccataccaaca

SEQ ID NO: 5563 - DNA, 201 bp, Homo sapiens
catcttcacatctttctctgtccacatcctggaaaagctcttcacttttgaggattcacaggattaagttggtcccaccttgctaatccaggatcatccgmatctcaaggtactaaaccctgaatctcacaactgcaaagtcccctttacactataagcaacatattcacagcatggacatcttagggaagccattattct

SEQ ID NO: 5564 - DNA, 201 bp, Homo sapiens
aggctgcccacattcctcggcttatgactccttccttcatcttcaagccagcaccactgcatctctctgactcttccatcttcacatctttctctgtccayatcctggaaaagctcttcacttttgaggattcacaggattaagttggtcccaccttgctaatccaggatcatccgcatctcaaggtactaaaccctgaat

SEQ ID NO: 5565 - DNA, 201 bp, Homo sapiens
atttaatgggatcagccatggtgcgttcattttctattgctgctatgacaaattaccatcaacttggcgggggcttaaataatcctcacttattgtcttayacttctgtggttctgaaatgtgaaatgggtctcgctggactaaaatcaaggtgtcagcaggattgctttcctttccggaggccgtaggggagaatccact

SEQ ID NO: 5566 - DNA, 201 bp, Homo sapiens
tcaataattcatccattcaacagatatttactatatagctactctgtgccaggtactattctaggcactggagtatagcaatgatggacaaactccctgcytcatggggcttgcattttagagctatgtgccagacatagtgccatgtcctggtggaggagaggaagtgcttgtggtgcaggaatgaaagaactcacagtc

SEQ ID NO: 5567 - DNA, 201 bp, Homo sapiens
atactatatgtaagctatgcctccataaagtaccactgaaacataaacaaaaggcttttagataattactacaggtttattaaccttcagcctctgtatayttattgagaatctgctattcaataattcatccattcaacagatatttactatatagctactctgtgccaggtactattctaggcactggagtatagcaat

SEQ ID NO: 5568 - DNA, 201 bp, Homo sapiens
agcgagtttgttattgttgttgtcatttacgtgcaatttaatggatgtaaaatactcagcactatagtgcttggtatatagcaagcattcaatatatgtaygactttagcacccaaaagactattagaaaagtacagtacttattcacgtactcgtttacttaatggctctttattaagcctcaaccatgtaccaagaact

SEQ ID NO: 5569 - DNA, 201 bp, Homo sapiens
gagttatacacttgagctaataacatttaccattcaagcgagtttgttattgttgttgtcatttacgtgcaatttaatggatgtaaaatactcagcactayagtgcttggtatatagcaagcattcaatatatgtatgactttagcacccaaaagactattagaaaagtacagtacttattcacgtactcgtttacttaat

SEQ ID NO: 5570 - DNA, 201 bp, Homo sapiens
gagccaccgcacccagctgtaattttcttagtctcaatttcctgagttatacacttgagctaataacatttaccattcaagcgagtttgttattgttgttktcatttacgtgcaatttaatggatgtaaaatactcagcactatagtgcttggtatatagcaagcattcaatatatgtatgactttagcacccaaaagact

SEQ ID NO: 5571 - DNA, 201 bp, Homo sapiens
ggttttgccaatgtcgtccaggctagtctcaaactcctggactaaagtgatcctcctgcctcagtctcccaaagtgctgggattacaggcatgagccaccrcacccagctgtaattttcttagtctcaatttcctgagttatacacttgagctaataacatttaccattcaagcgagtttgttattgttgttgtcatttac

SEQ ID NO: 5572 - DNA, 201 bp, Homo sapiens
gtcgccgttctgacttagtacacaggctttccactgtgctaaagcaaggagcccaaagaactagagggcttgccaatggttttcttgtggttttattcgtstactaattaaaaacattggccaggcatggcggctcacgcctgtaatcctaacactttgggaggctgaggtgggtatatcacctgaggtcaggagttcgag

SEQ ID NO: 5573 - DNA, 201 bp, Homo sapiens
cagccctcttgaaaacatctccaatctcctaagagataaaaagcctcactcattttcccacccctgacccaccaaccagcttccatccctaaacctagagsgaaattatgatgttctgtctcctcctcctatttctattcctcatgccctgcatgtctccccataggagctcataataggcttgtaggttccacctgattc

SEQ ID NO: 5574 - DNA, 201 bp, Homo sapiens
acaaatgttcagcttatgccccaaatttttacaaccatctcccttttaagtcactgaacaactgctaggagcctctgagccatgctaccccagaatacccyagaatactcattcctattcaaatatttggttttcagtgttacaaggacaagtattcatttggaccagagaaataggctggatttgcactcatctgtcaca

SEQ ID NO: 5575 - DNA, 201 bp, Homo sapiens
tggggctctgttcccacggattttatctggcacagtatgtctgaggtgtgacccagaaatccgtatttttaagtagattctgaagcaaatagtctgcaaaytggtactaggacagaccccatgggatggaagcactttgccaaagtgaactatcaggaattacagagagctggggaaagaatgcttgctgtgtattaggtt

SEQ ID NO: 5576 - DNA, 201 bp, Homo sapiens
actactcctcatgcccatcaatgaccacacagacacatgcacacacacacacaggttcaaccccacttccatatctttagcaatggtctcctggggctctrttcccacggattttatctggcacagtatgtctgaggtgtgacccagaaatccgtatttttaagtagattctgaagcaaatagtctgcaaattggtactag

SEQ ID NO: 5577 - DNA, 201 bp, Homo sapiens
tgaaagaggattgccaagtgaatggtgatgtcacttacaaaagtggagaacaggttagggaccctgctttcttcctcacaattgtagctccagcacctagycttgtacctgacatacagtagccactctgtaaatgttttttgaatgaatgagtgagcaagggtggaagtgagtataggtagggggacagagaaatgcata

SEQ ID NO: 5578 - DNA, 201 bp, Homo sapiens
gtttttatcttcgggaaggaccacttgagcttgagtatgaggaagggcttggaggagggaatgaatgaaggcagaaaagcaggcccagagaaatctcactraagcaactccagaaaagagagaaagatctgaactaggattgctgcaatacagatacacaaaagagaggttcaagagatgtttaggaggtacattcaactg

SEQ ID NO: 5579 - DNA, 201 bp, Homo sapiens
ttgctcttcaccactgacaacgtgcacctccctccttatcggtgcttaacctgtgagctccctttcctttacctggtcattctcccatatattcagatacsatctgaagatcaacccttccccagcacagtgcttcctccatcaccagcttcttcctctggaagcaatgcatccacagcagaagaatgcaccctgaactaa

SEQ ID NO: 5580 - DNA, 201 bp, Homo sapiens
tggatggatggacagatgaacagatggacggatgggtggatgtgacatgagttgtgggtataagagattgaagaaataaacgaacatccagtgagaaaggsagtggctgagttagtagcacagtgatgggttagagagggcagggtataagtgagagctggatgaacagggggtgtgaaatgagggggctcagaggtagaa

SEQ ID NO: 5581 - DNA, 201 bp, Homo sapiens
agtcacatggcatgcccaatatcatgctgcaagcatctctcagagtgatggttctgacccaggggtcctggtgccaggtgacctctgtccatcccagggargactaggcaatgacataagacagtgtctgatgtctaacattctcaccaccgtgtgtttccttcaggtatatcacaggtatgtcatgcctgtcagtcccca

SEQ ID NO: 5582 - DNA, 201 bp, Homo sapiens
gcacataccgagagctccattaatgagagctgtgattatggtggctgttgtaatcaagaaagaatcaaccacaatgacagcaacaaaacccaaaacactamaacccacaaacacagcactaatgcaaatacaaacagctcccctgtggcttttttccacgtcttctaaatgacacaactttgcagcaccatggcaaaggag

SEQ ID NO: 5583 - DNA, 201 bp, Homo sapiens
agagcataatagcaacttacattccatttacccattcataaaggttacaaagcccatccacacccattatctctttgatcctaactactcaagagataacrcaagtggcataacactcatggatggcatttctcctaaagacacaggatgagaggttaaatgacttccctgagatctacatggccccatggtgatggcagc

SEQ ID NO: 5584 - DNA, 201 bp, Homo sapiens
tctgctctagactctgtgtttcagtaccatcataactgaggactcattcaatcaggtctagagcattcaatcctgttccagaatgttccagagcttgctgrgtccccagggtgacacctgactccatgggtaccaaagcctggtgtttcctagagcataatagcaacttacattccatttacccattcataaaggttacaa

SEQ ID NO: 5585 - DNA, 201 bp, Homo sapiens
gtctgctctagactctgtgtttcagtaccatcataactgaggactcattcaatcaggtctagagcattcaatcctgttccagaatgttccagagcttgctsggtccccagggtgacacctgactccatgggtaccaaagcctggtgtttcctagagcataatagcaacttacattccatttacccattcataaaggttaca

SEQ ID NO: 5586 - DNA, 201 bp, Homo sapiens
ggactgtggctaacctagccagccccgtggctttgaaaaagtgcttaatctttctgggcctgagtttctttacctataagataggaataatgacccttccrtcacatgggtctgctgtgagaatgggatgaaaaggtagaagtgggagactcatctgtccacgcctgactttgacagtttgggtgcttgtctccacatcct

SEQ ID NO: 5587 - DNA, 201 bp, Homo sapiens
ctctgagctagacatgaccagggtacccatgaaaaggtctgtgcacagagcaaagctgtaagcacacgcatcttatctggttctctacatgtagagaggarggcatggctgcactgtgaacttcctcaggagaaagataattggagggacagcagttaattggcccagagccagctcggcacaggccatctgtgaaagagt

SEQ ID NO: 5588 - DNA, 201 bp, Homo sapiens
ctggaaggatgtctgtaattattgcttgcttatcatctattcttctcattttcctctagttcgtcctgccccttcctcctttgagtctatatggttctaayagaacaaactctatctgacccccaccccagctcatgaccggaaaatcaagccacggaaataaaacagcatcagcaaagacagttttctaacgatatattt

SEQ ID NO: 5589 - DNA, 201 bp, Homo sapiens
acacacacacacacacacacacacacacacacacacactcctccagccccagttcagagataacctctgaactgtagcagattcaaagtcctaaagccttycagaaatatttcagagtgacatagtaccctgctggtaataaaccaacatggtttgttgactgtatttcccttttattattattatttttttgagatggaa

SEQ ID NO: 5590 - DNA, 201 bp, Homo sapiens
gtttcattaaacaccaagcagtggatggcgacttaccacgcttgatgcattgcttctctggggctgaaataccatttacaaaattactgtgtttaaaggcrtaactttgggaaattgcgcaacagcatttcacagcagcagaattttttaaaaaaagcatagaatccagggtggtcactggaaagggatctaaatgtcttg

SEQ ID NO: 5591 - DNA, 201 bp, Homo sapiens
tgccactgcctcccagggggccctggccactcctgaactggacagattcttgtgatggaaccggacacaacagccgggattccaccagccaaacaggtcawggtttaccttcacaattttgggagttaacagtgacatggtctgtgcttggtgaaggaacagatgtttaataactgtgcagtagcaaggaggttatataac

SEQ ID NO: 5592 - DNA, 201 bp, Homo sapiens
cctgatagttatttgtaaaatgccttctccatgcctggcaccatgctaaatgtatatactttaagatgttacaagaagaagagatgtctatcttacacacrcaccctctttaggaaaactcctgggttcacagttgttaataacttatacttggtaaatatgtggtaaattcatagtcaagtctgtcatactacctagacc

SEQ ID NO: 5593 - DNA, 201 bp, Homo sapiens
aaaacacataaatggtcatgccaggtgtcatcaatgaaggccaaataacttcccttcaatactaattcataactctcctgggataagactttttttgcccmctcatttgtgctatagatctacttgagctcttctacttgatttccagtgcagtaacttctccatgtcctacttccctaactaaaatgggaaccacacaga

SEQ ID NO: 5594 - DNA, 201 bp, Homo sapiens
gttcctctggattctctcacctcgtatctcttgctgatttactttgagactcagctgtttttcccacttctgagttcagagtcccaatcagatgtacagcraaggcccacaggacagcttggcctctgaggtgcctgatttcactgcgagaagtgtttgttgagcatatggtgatctcccagataaatatttgcaaagagt

SEQ ID NO: 5595 - DNA, 201 bp, Homo sapiens
tccatgtgggaagagcacctggaatttacagcgtaactctttctctccaacattctcctttcccttggaggattatttaccaattaatgttaaagttcctyatggtttaaacccaggccctcctgagtcatcattctcccctgcaagaccttgcccagtcgtagggctttgactgccatcaataagctcaaatcctgtgta

SEQ ID NO: 5596 - DNA, 201 bp, Homo sapiens
taaccaaatgaagcagatcctcaggaagctgactgtggggatttggacaatggtacaccagacaccagcagatctgccagttcatttacccaactttgagrcccatgtagaaatgtggctggcctcccatgcccacgcagaacacagctagcaccatcacgctggaccgtgactcctccatccctaagattcatgccagga

SEQ ID NO: 5597 - DNA, 201 bp, Homo sapiens
cctgcagctttaagtaagaatgtttgaccagtaatgctgtaagcatataggataagagagacctatgttgtacacacttccagttgtgctaactcaggtaygaagatctctggaggtgagctatcaaaactccctgttattgctcattctaatatctgccaatcttaataatcatcaagttcttgttttggaaataaatac

SEQ ID NO: 5598 - DNA, 201 bp, Homo sapiens
gttaaatgacacattggaaattttcaagacaatttcttaagcaagtaatacgggttccatccggctccatcatttgccattcacttgacaaatgtcataaygccactgcacaccccaccagagcaaatattttcttccaaccttaaaataacatctacaaattaattcagtctgtcaaggggaactctccttgggtaattc

SEQ ID NO: 5599 - DNA, 201 bp, Homo sapiens
atggcaatatttaatgccaaaaatcttcatgatctgaaatctacttagtgtcttattaatacagccagtccagttttttaaaattagtattagtgtgtacrtatttttccatatttcaactttcaacctatttatgcttttatatttaaagtgggtttcttatgggcaccttagagttggttcttgctttgtgatgtttat

SEQ ID NO: 5600 - DNA, 201 bp, Homo sapiens
acactcaagacagcttctcacgcattcctctatctcctcccctggggccaaggtccagataagcacatataagttaagtgagcaagtctaaaagcagatgygcttatcctttcaatcactctacttttcatcactctcccttttacactctgctccaccatccaaccccactggttctgaaggtttcctattgaaccaccc

SEQ ID NO: 5601 - DNA, 201 bp, Homo sapiens
gatcaactgtgtttaataaaccaataaataaatcaaatccaaggaagtctatgaaagggtttcagagggtctgtgatcccctgaaattgcacataattttractgcatgtttatgaacacgcactcctctggaagggtccgtagccttcattagattttaaagtggtccccaactccccccaaaatcaccccaaattatct

SEQ ID NO: 5602 - DNA, 201 bp, Homo sapiens
ccaattttctctgcatgtctttatcacccaactaacagaccagaaaggaagatttctcagctcatttccggttacctggtattcttagaagatcccaccayttgccagaagtgagaaacaaaaaggtttcacacaatcatgttgtctaacaggaattctttttgcaactgatcagccttcctcaaagacgttccctatagg

SEQ ID NO: 5603 - DNA, 201 bp, Homo sapiens
aagcccaggaggtagaggcctgcagtgagccactccagggagtgcagcggcatgaacatggctcgctgtggccttgacctatgggctcaagcaattatctkgcctcagtccccacaagtagctgggactacaggtggctcctcactgcagcctctcgtctcttaaaaaagggtgtgtgggggaatcaaagtggtgaatcta

SEQ ID NO: 5604 - DNA, 201 bp, Homo sapiens
acagagaggaatgctaactgtaacttgaatgatttgagttctcattgcttttctcccatcttttctttctctttcatcaatgttatacaattagttttttmataaagctcctactagcaagctactcctccccacactcagaaaacctcctacctaaaatctgataaaaatctttgttttcactactttaaactcttggcc

SEQ ID NO: 5605 - DNA, 201 bp, Homo sapiens
agagattttcctagttttctttttacagactaagtgactcattaaagttctcaaatgtattaaccagaaaaaaaagcatacatgttaatgagttttttttwaaaaaaataggaaatccatccctttccagttcctcacccacaaaaatgggtgctgatcaatcggttgtgtaggtaaagggatgagaagagggtatcttga

SEQ ID NO: 5606 - DNA, 201 bp, Homo sapiens
tccaccaacactatctcaaactcatccagatttctctgcccaccatgtacctcagacctgcacggctgcttcctcttctcacaaaaacaccaatgccatcyctttggaaatacaatgtgctgttgacgtcccccctccctttggaggtattttgttttgttttgttgagatggggtctcactacagtcgcccaggctggag

SEQ ID NO: 5607 - DNA, 201 bp, Homo sapiens
tagttctgcaccatcgtgaggaaagctgtaagttcagtagaaggagcaaggtgtcaaggtcactcttttcctaatgctgacaacattaaaagacagagtawtagagtttcaggagtcaaccgtcagagagatgcagaatctaaaagggaacaggcaaggataattgaggcagtgttgtgtgtgtgtgtctccaacttgctt

SEQ ID NO: 5608 - DNA, 201 bp, Homo sapiens
catcctggattttttttttttttttgtatagaatttgtcacagtggaacgtaattgtcactgggaggtgagtttattcagggcagggatcttgttttattstccttgtacccccagtctgtggcacaggtcttggtacatgtggttcatgacattgcaccaactgtggataacacaaggctcctgtctccttgattagttt

SEQ ID NO: 5609 - DNA, 201 bp, Homo sapiens
acaaaacaaaggcccaataaatctgacaaataagaaaaaaaaatgagctagagaaaaataagacccaagtaaccctgggttcagaaataatattctggagsctgtgacctctgttctcacgatctcagagggtcactgaactatttgccgaagtgaaaaaatacttttgatggtggtggtgataggaaatagtacaagatt

SEQ ID NO: 5610 - DNA, 201 bp, Homo sapiens
caaacatcaaacaatacacatggtcataattttccattactggatgaagttggagagatacaattctttgaagtaagacggcagaaaccttgtaggaatcyaggaaaccttattatataccaagcacttctggaatctgcttaaccaatctgcctcacacaaataaagacggtcaagctgacatggcttaaaaggcacatg

SEQ ID NO: 5611 - DNA, 201 bp, Homo sapiens
acacacacacaaacacataaataaattaaggaggacgcttttgagtgtttaaattcttaggactgcagcagcaagtttagcaaagaacacagtaggagctygatccagtttggcaaagggtctggctaagtcaaaactgtgcaattatcattcctggttgttggggttttagaattctctattcatgctaatgacattgca

SEQ ID NO: 5612 - DNA, 201 bp, Homo sapiens
tagagacatttcccaaacccaagtctgaccaggaaggcaatgagccagaacagaaaatatcgatgagaacctagatgttctgtaagtacatgaacaaaccyctggcccatctggatgcttttactgtttattttttatttggtgcaaagaagaccttttctgtttagcaccacaaaagttgtttctgtgttactaacttga

SEQ ID NO: 5613 - DNA, 201 bp, Homo sapiens
aatgatcaatgacgcattttcacccaacaagcacccactaagtgcctactgtgcacaagacatggaactgggccttggggacacaggatgaaaaaggcacscagcaaaggcaatagttgaatttatcacagtaattatggaattgcagaccagcttgtaattgggaacgtctgttggttcctattacagcccttgtgtggg

SEQ ID NO: 5614 - DNA, 201 bp, Homo sapiens
gaggcttacttataagataataacaacaaacatctcttaatgcacagttcctggcacacagaaaggtctccatacgtggaactattatcattaattcaacrtttgttaaacttatcttcaggaaaatgagcctctgtagcagaagaactaattgacaaatggagatctgagtttcttcaatggcattcccttgacttttga

SEQ ID NO: 5615 - DNA, 201 bp, Homo sapiens
ctgccctgaggattgacgtccccgagatgttaacctctgtgtgtcaatgaagcagggaaactggacagttggttcacttttctaaatgcaggagcaagatragggaaattattgatttctatcaaaacagacaagaagcaaatagaagagaagaccatgggcagggaagggtttgaatacaaatggaaaccaccaggcata

SEQ ID NO: 5616 - DNA, 201 bp, Homo sapiens
ctgtcacagtcagcaatgtttgagacgaaacttgaatggtgagaacaagacaaccacagaaaggtccaggggaagaaattcccaagcaaacggaacaacamgtgcaaaggtgagtgtgaggaatgttccagaaagataaaggaccaagggaaaagagagcaggatttggtctgagatataagcaggagattatggtgctcc

SEQ ID NO: 5617 - DNA, 201 bp, Homo sapiens
tcctccctagttcaagagattcccctccctcagcctcccaagtagctgggattacaggcacccaccgccacgtctggctagtttttgtattgttagtagasatggggtttcaccatgttggccaagctggtctcaaactcctgacctcaaatgattcacttgccttggcctaccaaaatgctgggattacaggtgtgagcc

SEQ ID NO: 5618 - DNA, 201 bp, Homo sapiens
cctgacctcgtgatccgcccgcctgggcctcccaaagtgctgggattataggcatgagccaccgtgcccggccaaaaaatttttacatggaattagttacyaatatttaaaaatggaaaggtttctaacaaaatcagatgacattttctctttttaaaaaactagaagacctgataatattgactctacattcccataaga

SEQ ID NO: 5619 - DNA, 201 bp, Homo sapiens
ttccatgcaggaatctgtgacaactgaaatgccccatatgagctaattttctggataatcaaaatcccctcattaaacaactctgtcatttaaaataaaaycatttttattggatttaatcctttctaaaatggatttcatgcattcctgggtctacatccaggacacactccgtgcttcctacgagaatgattcctagca

SEQ ID NO: 5620 - DNA, 201 bp, Homo sapiens
ggagcagcttagcctttgtattctcacacagattagtctttggttacaggtgaccacaaagattgagggaacttaaattgccaggcatttaccattccagygcccaaaggcaaaaatctgctgaggatccctgaagtgaggctttgtcagcaaagcacagaaaggtggggctgggcacacagcgctgcaaaagggatccca

SEQ ID NO: 5621 - DNA, 201 bp, Homo sapiens
cacctgcctctgcacacatgtctttcttctcccctctttcagtaataaaggaggcatctctcctctagcctaacacgcatcccagcccttgggctctagayacattctcttctgcactgtccttgcctctcaaactgacctaagacctccagtggttttcactaaatccaacaggtgcactgcacataagcccctcctctg

SEQ ID NO: 5622 - DNA, 201 bp, Homo sapiens
agcccctgatctgctgcctttcccccattcttctctactgcctccgagaaacctcaaactcagtaggcttagagaagaactcagcctcttatcttccaccrtaaaaaatagtttctctcccatctgccatataggagttcttgaaatcccaaccatggaaatatccattaattcatctctcttctgccacccccatatata

SEQ ID NO: 5623 - DNA, 201 bp, Homo sapiens
taaattcttccaattgttggaattgtttcaaaataacatgtcacttttattgtttaagccagaggtcactaatctttttttttttttttttatggtaaacrgccaattagtaaatattttcagcactacaggccatacggtctctatcacaactactcaactctgcctttgtagcacaaaaacagccatagacaatgcgta

SEQ ID NO: 5624 - DNA, 201 bp, Homo sapiens
tttgatggttctcttgacatttgactttctctggtttgagcaattcactgcttgtcaggcatgggcctggcatgctgaccttgtactaatcctggtgttgkattgataacagacactaagattctgaatctcaacaggcccattagggaattcactgcaaatttacgcagattaaatcccctggagttttaccactgagga

SEQ ID NO: 5625 - DNA, 201 bp, Homo sapiens
cttgacatttgactttctctggtttgagcaattcactgcttgtcaggcatgggcctggcatgctgaccttgtactaatcctggtgttggattgataacagmcactaagattctgaatctcaacaggcccattagggaattcactgcaaatttacgcagattaaatcccctggagttttaccactgaggaagactcagtggc

SEQ ID NO: 5626 - DNA, 201 bp, Homo sapiens
tcctcactgcagcctctcgtctcttaaaaaagggtgtgtgggggaatcaaagtggtgaatctatagcccctaggccataatcatcatcatattttttttayaacatatgggtaattatctcaaggtacaagttcttcagagtctagaaagcacattaaatcctccacagcttagagaccaatgctgagaatatgcaacctc

SEQ ID NO: 5627 - DNA, 201 bp, Homo sapiens
aaactatagaatgagatgatatggatcaattgacattcaattcaaggtgcgatttttatttcagaatttctggatattcacatactggaatatagaattcrtaaaagcagggattttgcctggtttttccttctgctgctttttctcccttgaagaacctagaatactacctggtataaagtagatgctcaatgcaaattt

SEQ ID NO: 5628 - DNA, 201 bp, Homo sapiens
gaggtgagaagctgctggggagctgatgtcaccactaccccctccgaagcccatccatggggcacagtgcactccactggcagatcccggaaagggagcaygctgactgactggctgactgactgcctgccacatcaccgtctctgcattgcaattgcaaacattgttgtgcattctgaatccccagtgtctttctgtttt

SEQ ID NO: 5629 - DNA, 201 bp, Homo sapiens
cagaaaaacaaatacttcatgttctcacttataagtgagagctaaacactgggtatacatggatataaaaatgggaatagacactggggatgatgataagygtgaggagagcaaggctgaaaaactacctgttgtgaactatgctcactacttggatgatgggaccattcatatcctcagcatcacagaatatacccatga

SEQ ID NO: 5630 - DNA, 201 bp, Homo sapiens
cattctgcctgagttgagatcattatgctgcttctttcattgcacaggaacgtgggggttttctctaaactatgactcatagcaaagcatacaggcaatcrtgtagagaaacctgttctccccaggaaaggagggtgagcaaatgctaaaagttttgatactttaatatagcactggccgtggctaattttacttaatatg

SEQ ID NO: 5631 - DNA, 201 bp, Homo sapiens
gtcacagaggcacgagctcatcatctattttcacaacactaatgcaagagacctccaacacaagcaaagcaaaggtaccgactgggtgcagccacatatcrtgactttccaggccattctgcctgagttgagatcattatgctgcttctttcattgcacaggaacgtgggggttttctctaaactatgactcatagcaaag

SEQ ID NO: 5632 - DNA, 201 bp, Homo sapiens
aatcaggcaggtctcaagaaacaaagtcacagaggcacgagctcatcatctattttcacaacactaatgcaagagacctccaacacaagcaaagcaaaggyaccgactgggtgcagccacatatcgtgactttccaggccattctgcctgagttgagatcattatgctgcttctttcattgcacaggaacgtgggggtttt

SEQ ID NO: 5633 - DNA, 201 bp, Homo sapiens
cgggagcccacacatctttctctgtgttcttgtgaccatggaaatcaggcaggtctcaagaaacaaagtcacagaggcacgagctcatcatctattttcayaacactaatgcaagagacctccaacacaagcaaagcaaaggtaccgactgggtgcagccacatatcgtgactttccaggccattctgcctgagttgagat

SEQ ID NO: 5634 - DNA, 201 bp, Homo sapiens
aacagtgtcaggcagagcccccgggagcccacacatctttctctgtgttcttgtgaccatggaaatcaggcaggtctcaagaaacaaagtcacagaggcaygagctcatcatctattttcacaacactaatgcaagagacctccaacacaagcaaagcaaaggtaccgactgggtgcagccacatatcgtgactttccagg

SEQ ID NO: 5635 - DNA, 201 bp, Homo sapiens
gctctcaacagtgtcaggcagagcccccgggagcccacacatctttctctgtgttcttgtgaccatggaaatcaggcaggtctcaagaaacaaagtcacaraggcacgagctcatcatctattttcacaacactaatgcaagagacctccaacacaagcaaagcaaaggtaccgactgggtgcagccacatatcgtgactt

SEQ ID NO: 5636 - DNA, 201 bp, Homo sapiens
acctaccttgtttggggacacctttttagaggataactcttggtcctcaagcttagaagctgttatgaggaagatgttggggcttttcagaataacatccraagattaccccacagataccttctcctctggaatcgctctcaacagtgtcaggcagagcccccgggagcccacacatctttctctgtgttcttgtgacca

SEQ ID NO: 5637 - DNA, 201 bp, Homo sapiens
acccctggaaatactgggggaaagtcacctaccttgtttggggacacctttttagaggataactcttggtcctcaagcttagaagctgttatgaggaagaygttggggcttttcagaataacatccaaagattaccccacagataccttctcctctggaatcgctctcaacagtgtcaggcagagcccccgggagcccaca

SEQ ID NO: 5638 - DNA, 201 bp, Homo sapiens
aagccttcatattctctccccactcccctgccccatggtcccctatttccactcccctccagtcatccccacactgtcctcctcccacagctgtcccctgwtccttcctaacttcagctcattgtggcatcttttcagcccctgtatccacgatgctaactgaaaaatcctattctatttctaattcaaaagcccacattc

SEQ ID NO: 5639 - DNA, 201 bp, Homo sapiens
caacagtgggctatagtttatgggaatcaaaagttatacatggattttaaactgcatgggggttaatgcaactagcgcctgcattattcaaggatcaactstgtttaataaaccaataaataaatcaaatccaaggaagtctatgaaagggtttcagagggtctgtgatcccctgaaattgcacataattttgactgcatg

SEQ ID NO: 5640 - DNA, 201 bp, Homo sapiens
agcattagatgcatttcctttctctgcatcttgaaggtagtctatgcaaagtacccagcatagcctgtaggatatctccaggccattagagagagaaaaaraaagtccttcctaaattcaaacttcatatcacttcgccctctgatttaagcagggcattaggttcatctctaactctccctttctgtcaactgaagaaca

SEQ ID NO: 5641 - DNA, 201 bp, Homo sapiens
tctaacgatatatttggagcccctagagtctgccaagtatgaagccatttctcctggacccctttgttatacaagccagtgagtttctatgttcatttaargagtttgagtagggtttctgtcacttgaacatacggctcccacataatacagagtatcataaataccatgtggacatctaccttttcaatcaacaaatat

SEQ ID NO: 5642 - DNA, 201 bp, Homo sapiens
tcctccacctaaacactacctccctacccccatactccaccctggttggccaacttctaatcatttttccaatcttagcctaactaccaccgccctgggargtcttcaccagcaactgtgccaggcacccttgtgcaccaagagcctttagtatcatttctagcatcatggtatatttatatataagaataattgcctgtt

SEQ ID NO: 5643 - DNA, 201 bp, Homo sapiens
tggctcaaactgccaggaagctttctgagcaacagcagatgttggggcttcgagaaagattgctctctgcttttggccagaatccctggggtcatttaggyggtgatgttgccagttcttctcccctctggccaacacctctcaatccattatttgggataccaattataaacttgggacaagagcctaatctcccagcaa

SEQ ID NO: 5644 - DNA, 201 bp, Homo sapiens
tccgagcgccgtggaagagaacagtctgattaagttggctcaaactgccaggaagctttctgagcaacagcagatgttggggcttcgagaaagattgctcyctgcttttggccagaatccctggggtcatttaggtggtgatgttgccagttcttctcccctctggccaacacctctcaatccattatttgggataccaat

SEQ ID NO: 5645 - DNA, 201 bp, Homo sapiens
ataccaaaaggacagctatagaaaggcttcaaatctacttcttagtaaacacatcacttcaataaacatccattgaacatctactttatgctagcaaagtrtaggaattaaagaggtaagtaaaaattgtgtggtcctttctctgcaatcatttagagtttaagggaaaggcagatcctatgcaaataattacaataaatg

SEQ ID NO: 5646 - DNA, 201 bp, Homo sapiens
taacagcattagatgcatttcctttctctgcatcttgaaggtagtctatgcaaagtacccagcatagcctgtaggatatctccaggccattagagagagaraaaaaaagtccttcctaaattcaaacttcatatcacttcgccctctgatttaagcagggcattaggttcatctctaactctccctttctgtcaactgaag

SEQ ID NO: 5647 - DNA, 201 bp, Homo sapiens
ccttgacacctctagaaatctcttccctctgtctagaatgtctttccctatccccttcacctgtggaggttttactgtgattatgaggcacacatcaaaayaccacagcatccaacatatagcaggtgcttgataaatatgtgttgaataagtgaatacaaactccctagcagaatagaatgcaagccttgatttccagct

SEQ ID NO: 5648 - DNA, 201 bp, Homo sapiens
ctgcctcggcctccctaagtgctggaattataggcgtgaatcaccatgcctgacacagcagaacctttgagatatatttaagcaaggaggctggaataccrcctcatttgactccagggaaaatataactttttcccagagatgaaaataaagacaccagagcggggtccactcaaggatactgatgtgagccatcccctg

SEQ ID NO: 5649 - DNA, 201 bp, Homo sapiens
tgaattcctgctttctactccctagtactgtgccctcaggcacatagatgaacatctcagttcctttctcctttctgataagggtagagaacagcaaggcstacctggttctttccttattttattattatcaagctgttcatttcagcacatatatctagcttttactttgtacactaatacaagaagaatcctcaccta

SEQ ID NO: 5650 - DNA, 201 bp, Homo sapiens
tccccgagatgttaacctctgtgtgtcaatgaagcagggaaactggacagttggttcacttttctaaatgcaggagcaagatgagggaaattattgatttstatcaaaacagacaagaagcaaatagaagagaagaccatgggcagggaagggtttgaatacaaatggaaaccaccaggcatagcattgggagcttctgaa

SEQ ID NO: 5651 - DNA, 201 bp, Homo sapiens
cagtaatcactagtgttggagatgctataattgaagtcagcttatgacaacagggaaaaggctgagtctaaaagctctcaccattcaacactccccactcmcaatgttcccactccaaatggtacagtaatggtgtgatgataggtccatccagattctatcccgggggatctcttcctgtgtgtagccttccccctacac

SEQ ID NO: 5652 - DNA, 201 bp, Homo sapiens
aagatagccagagttctgcttctggtatggtaggaaatctcttaacagattccctcccacacccaaacaggtaaaaaattaaagctagaaggaaaaaaaawatatacctgaaggctctgtagagtaaaaatagccagtagatttcacagggacattgaaacatggaagaagggctcatcatagagttctacatttttgcca

SEQ ID NO: 5653 - DNA, 201 bp, Homo sapiens
ctctcattttcccttcaagccaatattgaagacttgatatcttggtccattattctgtccaaataaggaaaggaaacaatgttgaatcttgatacgtgacstgataagactttggtgctctctgaacatccatcttctttgcctcaaaataaaaaatatagggttgatgaatgggcaaggcaatcctaagcaaaaagaata

SEQ ID NO: 5654 - DNA, 201 bp, Homo sapiens
gatggggtttcaccatgttagccaagctggtctcaaactcccaacctcatgatccacccgtcttggcctcccaaagtgctggaattacaggcgtgagccamcgtgcccagccaatgtcacgcacagttttaagcaaaactatgtttcagtctcagctaaactatgtcattaccacgtcttctctgtctcccattgccgctt

SEQ ID NO: 5655 - DNA, 201 bp, Homo sapiens
agcacctctgcatctgggtgtagccatgtgactcgttcatccaacaggatgtgggccagagttttggagagataggacaccctttcttctctccttcctgyttcctggattttctggctgcttgcagaaaatcctaagttattagaagatggcagagccacaagatagtggagactgagttcttaaatccccacatgaaga

SEQ ID NO: 5656 - DNA, 201 bp, Homo sapiens
atgctgtatctggaggactttgcagttgagttcagtgatgttttttaaaccaatacctgatctaaagagtatcccagaaaaccagtctgctgaaatcaagygtcactttggaactcaattttcccctgtgtggtatgcacaaacaagtttctatgcagaaattactaaagagcaggtgtgggtcaaacctgctctgtcttc

SEQ ID NO: 5657 - DNA, 201 bp, Homo sapiens
acgatggtacaccaacgcagtataatgtattctttgtgtgtgtgtgattgagtctcgctctgtccctcaggctggagtgcagtggcacaatctcgactcamtgcaacctctgcctcctggttttaagcgattctcctgcctctgcctcatgagtagctggtattacaggtgtgtgccaccatgcccagctaatttttgtat

SEQ ID NO: 5658 - DNA, 201 bp, Homo sapiens
aatcaccaccagcctggggtgcacctggtagccttcctcagtgaaggataagtctttgccatcccatgtaacattgaccataaatctagaaaggggaagasagaaagacaaatttttaggaaagaattagagcaatcgaacaaataagtggatgccaccattaatggaatactgaaaaattataaacttacaatgctatat

SEQ ID NO: 5659 - DNA, 201 bp, Homo sapiens
gaagaaatcatacccggtgaggccaagggagcgggcctcactcagaatgagaacagcctcgtctttggaacagtagagcaagatgacagaagagtggatcytcttcagctggacttgtgtctttgcatcctcaaaggaagtgtccagtgtgatcacattctgcatgtcccagcccacaaagctgttgtccactgtggtctt

SEQ ID NO: 5660 - DNA, 201 bp, Homo sapiens
acggccacctccaccgtgttagggttggactcattgagagtaagaggatgttgtccctggaatacatagttattgaggttatccttctgccggttggccasaaatgtttggagttcgttcatgttgtctccaaaaatgctctctttcccctgaaaggacctgttgtctgagtacatcaaattccccttatctgaaaccatg

SEQ ID NO: 5661 - DNA, 201 bp, Homo sapiens
acttcttgagtgaagataataatgattacatagcctacctaatattgttgcagtgaggacaaaatttatatataaaaatagagaatataatatatatatakagagagagtatagcaaacttattctctattaatatgtatatatattatatattatatacatatataatatatataacttagcacagttcctggttttgtt

SEQ ID NO: 5662 - DNA, 201 bp, Homo sapiens
ggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggta

SEQ ID NO: 5663 - DNA, 201 bp, Homo sapiens
aggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggt

SEQ ID NO: 5664 - DNA, 201 bp, Homo sapiens
caatatcctaactgcaccagctctttgcctgagattataaataaagtccatgaggaccaccaagtggcatgtctagctggccccatgactttgttctcaaycagtcaaatctggatcccagatcccctcagtaactcaccacgaagatatcaggtatgacctcatctgaacttcttctggagctatttgcaacctccctgc

SEQ ID NO: 5665 - DNA, 201 bp, Homo sapiens
ccagcccatgagcaacaatatcctaactgcaccagctctttgcctgagattataaataaagtccatgaggaccaccaagtggcatgtctagctggccccawgactttgttctcaatcagtcaaatctggatcccagatcccctcagtaactcaccacgaagatatcaggtatgacctcatctgaacttcttctggagctat

SEQ ID NO: 5666 - DNA, 201 bp, Homo sapiens
gctttcctagcttactcagagcttgcagtgtaacaagtataaagttataataatgatgatgatgaccacaataataagaaaaataaaattataataatgayctgatagttatttgtaaaatgccttctccatgcctggcaccatgctaaatgtatatactttaagatgttacaagaagaagagatgtctatcttacacaca

SEQ ID NO: 5667 - DNA, 201 bp, Homo sapiens
gattatgataaaaataataaaaatgagtacaagacaacctgggataaaatactttaaaaagccctggaggtaacatggataaataaaccaacccaggtggkgactaaggtgtactgcgcagagatgacagtcacttccagcttccagttgatcattagcaggtcaggatatgggattattatcactaactccatctttttc

SEQ ID NO: 5668 - DNA, 201 bp, Homo sapiens
actaacttaaacaaaattaaaccactacgggcgtttagtggttaatgtctgaaattggagcggcgcggtggctcatgcctgtaatcccagcgttttgggargccaaaacgggcagattacttgtggtcaggagtttgaaactatcctgaccaacatgatgaaacctggtctctactaaaaatacaaaagttagccaggcgt

SEQ ID NO: 5669 - DNA, 201 bp, Homo sapiens
ataaaggagttgcccatattacagatgaggaaactgaggctcagagagaacagacttttccaagctctcacagcaaagtttagcatctcagctatcaagamaacccaagtattaacgttagaatatagtgaatgtccccccctgccagtgctccaaggaacgttcatcctgccttgtttcagaagcaacatccacagccac

SEQ ID NO: 5670 - DNA, 201 bp, Homo sapiens
ttgatcagtaaaatgggcataatcatagcagccatgccataggtttgtcatgagtataaaatgagaattcatcgagagtcctgagcaccatcccaatcccygtatccagtggctctcattaatattagcccatgaatgttaacaatgccctccaacttaggaacaaggaagtgcatttggaaaaacatagctctacaaagg

SEQ ID NO: 5671 - DNA, 201 bp, Homo sapiens
actgagctaattcaaggatacaataagtagttgaaaagcagtcatagctgagatatgagatttaaactcatatttgagtctcatatgaagtctcagagttyttttttttttttttttttttgagacggagtcttgccgttgcccaggctggagtgcagtggtgcgatctcggctcactgcaacctctgcctcccaggttta

SEQ ID NO: 5672 - DNA, 201 bp, Homo sapiens
agaactgagctaattcaaggatacaataagtagttgaaaagcagtcatagctgagatatgagatttaaactcatatttgagtctcatatgaagtctcagasttcttttttttttttttttttttgagacggagtcttgccgttgcccaggctggagtgcagtggtgcgatctcggctcactgcaacctctgcctcccaggt

SEQ ID NO: 5673 - DNA, 201 bp, Homo sapiens
tttctctgcatcttgaaggtagtctatgcaaagtacccagcatagcctgtaggatatctccaggccattagagagagaaaaaaaaagtccttcctaaattyaaacttcatatcacttcgccctctgatttaagcagggcattaggttcatctctaactctccctttctgtcaactgaagaacatggatctgctccattcac

SEQ ID NO: 5674 - DNA, 201 bp, Homo sapiens
actaacagcattagatgcatttcctttctctgcatcttgaaggtagtctatgcaaagtacccagcatagcctgtaggatatctccaggccattagagagagaaaaaaaaagtccttcctaaattcaaacttcatatcacttcgccctctgatttaagcagggcattaggttcatctctaactctccctttctgtcaactga

SEQ ID NO: 5675 - DNA, 201 bp, Homo sapiens
atctcggctcattgcaacccccacctcctggattcaagcgattcacctgccttagcctctctagtagctgggactacaatcgcgtgccaccatgcccagcyaatttttttgtatttttagtagagacggggtttcactgtgttagccaggatggtctcaatctcctgacctcatgatctgccacctcggcctcccaaagtg

SEQ ID NO: 5676 - DNA, 201 bp, Homo sapiens
agtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctc

SEQ ID NO: 5677 - DNA, 201 bp, Homo sapiens
cagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacct

SEQ ID NO: 5678 - DNA, 201 bp, Homo sapiens
gtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttataag

SEQ ID NO: 5679 - DNA, 201 bp, Homo sapiens
ggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttataa

SEQ ID NO: 5680 - DNA, 201 bp, Homo sapiens
aggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttata

SEQ ID NO: 5681 - DNA, 201 bp, Homo sapiens
gaggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttat

SEQ ID NO: 5682 - DNA, 201 bp, Homo sapiens
ggaggtggaggttgtggtgagtggagatcgcaccattgcactctagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggattttta

SEQ ID NO: 5683 - DNA, 201 bp, Homo sapiens
gtaattacaactcacagcagcctcgacctcctgggctcaggcatcctcctgcctcagccttccaagtagctgggactataggcctatgccaccacatctgrctattttttcttttttttggagggacagggtctccctgtgttccccaggctggtcttgaactcctaggcttaagtgatcctcctgcctcggcctccctaa

SEQ ID NO: 5684 - DNA, 201 bp, Homo sapiens
gcatggtgcagaagcgactgatgggggtgttgtgtgggggagaatctggtttccaaggacaaagtgaagaaattggggaaaaggaaaagagcaaatattgygtatttattcaacagaccattcgggtcattgaaaatcatgtttttgaagacaaattaatgatgcagagaaaatgcttactatttaatgttaaagaagcag

SEQ ID NO: 5685 - DNA, 201 bp, Homo sapiens
ggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattgga

SEQ ID NO: 5686 - DNA, 201 bp, Homo sapiens
aaatgaattttttaaaaaaagcatagttgaaatggagataagtcatggaagagtcagagaggagagaaaagaagagggaagggaggaagagggaagagagkatgatggagagaggaatcgagagatgagaggagatggagaggaaaagagaggaggaaagaagagaggaatgagtaaagaagaaaattgaaagaggtggca

SEQ ID NO: 5687 - DNA, 201 bp, Homo sapiens
attatgattagtaacatattgaaaaactttgtatagagtgctgttatttcttttaaatgtttgttatagatagacgaagccatctaggccaggagtttctyttttgtctttttaaaatgggaaagtttttaggtatattttcagtttttcagcaaatatgagctattcagatcgtcaatacctacatctcagttgtagaaa

SEQ ID NO: 5688 - DNA, 201 bp, Homo sapiens
agatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccc

SEQ ID NO: 5689 - DNA, 201 bp, Homo sapiens
ctcattaatggtatgcatgtttgtttgtttgtttgtttgagacggaggctcgctctgtcacccaggctggagtgcagtggcaccatcttggctcactgcarcctccacctcctgggtcaagcaattcttctgcctcagcctcctgagtagctgggattacaggtgtgtgccaccacacccagctaattttatttttagtag

SEQ ID NO: 5690 - DNA, 201 bp, Homo sapiens
ttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtg

SEQ ID NO: 5691 - DNA, 201 bp, Homo sapiens
gttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgt

SEQ ID NO: 5692 - DNA, 201 bp, Homo sapiens
gctcattcgtgactttccattttttccctattacagcccagatctctttatcacagcaacagatttcctgccacgcccacaattttcctgctcccatcttrtcctcctgtcacacccacctggcaccaccttccacccagctctgagtcaatccaccacttcctcacctgtcaaccaccaagcctcattcacaaattacag

SEQ ID NO: 5693 - DNA, 201 bp, Homo sapiens
cttgaccatcacagcagagtcacatagatgtgaaagagatattattacaatttttcagagcggtaaactgatgttccttcaagtaactttttttctttttyttttttttttctttttttgtagagatggagtctcgctctgttgcccaaggtggagtgcagtggcatgatcttggctcaccgcaacctccgcttcccaggt

SEQ ID NO: 5694 - DNA, 201 bp, Homo sapiens
atatatattcccacagttctcttcctatcagtcaatgaacaaccacttaataagaccccgtttcttttgagtattatgccagctctttgggagaaaaatgmcaacaatgacactgttctcaagaactgaaaatgtggtctaagaacggcaccactagaaagtactacacatgcataatcagtatgactaccacacctggta

SEQ ID NO: 5695 - DNA, 201 bp, Homo sapiens
aataagcttaacgacagctttgcccagttaaaaacgtgattattctaaggcactgggggaagaggagggttcccttgggatgggatggataagacttgctrtttttgaaaactaagcctaagtaacccaccaccgtcaatccaatttcacccaaaccaattatccccatctcagacagtaatcaacaatttgagagcccta

SEQ ID NO: 5696 - DNA, 201 bp, Homo sapiens
ataacatccaattgtaaaataaatgaaatgccatttgcagtctggcagagtaaacagctcttttggggagtatttacctgaatgatattaagaagtttttkttccctcagcaaacttgccaataagagttagaaagtggctaagagaggtagactgtgatcctgggctgacagctgaaaaagccttttatttattgtgata

SEQ ID NO: 5697 - DNA, 201 bp, Homo sapiens
agcataacatccaattgtaaaataaatgaaatgccatttgcagtctggcagagtaaacagctcttttggggagtatttacctgaatgatattaagaagttytttttccctcagcaaacttgccaataagagttagaaagtggctaagagaggtagactgtgatcctgggctgacagctgaaaaagccttttatttattgtg

SEQ ID NO: 5698 - DNA, 201 bp, Homo sapiens
tcagcataacatccaattgtaaaataaatgaaatgccatttgcagtctggcagagtaaacagctcttttggggagtatttacctgaatgatattaagaagytttttttccctcagcaaacttgccaataagagttagaaagtggctaagagaggtagactgtgatcctgggctgacagctgaaaaagccttttatttattg

SEQ ID NO: 5699 - DNA, 201 bp, Homo sapiens
cccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaag

SEQ ID NO: 5700 - DNA, 201 bp, Homo sapiens
gctgtgttaccttgggcaagtcgcttcacctctctgagcctcagttttctcattagtaaaatgagagtaatggtcataatacctatctcataatacctcayacagaacaccttgctgttcctccatgtcccaccttgacacctctagaaatctcttccctctgtctagaatgtctttccctatccccttcacctgtggagg

SEQ ID NO: 5701 - DNA, 201 bp, Homo sapiens
tttagccatgtgaccttgaacaagccacataatctttttgaacctcagttcactcaatcaccaaataaaaacaacacttccatttcatatgctgttatgasgcttacttataagataataacaacaaacatctcttaatgcacagttcctggcacacagaaaggtctccatacgtggaactattatcattaattcaacatt

SEQ ID NO: 5702 - DNA, 201 bp, Homo sapiens
aaaaggaaataaaaaaggaagctgaaatccacattgacagcaaagataggcaggaggggattgacaggagcggaagcaagccctttctcaggagatgatgsataatgatgagaaatagccagccaagggagggaatgaggggaagagcattccaggtggaaagaaaagcatatgcaaatgccccaaagcaggggagacctt

SEQ ID NO: 5703 - DNA, 201 bp, Homo sapiens
aatgagctgggcatggtggcatgcacctgtaatcccagctacacaggaggcataagaatagcttcaatctgggaggtagaggttgcagtgagccaagatcrcaccactgcactccagcctaggtgacagaatgtgactctgtcgagagaaagagagaaagaaagaaagagagagagagagagagaggaagaaagaaagaaa

SEQ ID NO: 5704 - DNA, 201 bp, Homo sapiens
acgttcctcattgatggtgagcgagccaactgccatgactgcccgttgatagaccacctggatgcaaggcaaaaaaaaaaaaaaaaaaaagagagagagaacaacagtactttacttttcctgctaacattcctgaggactgcaggccctttgtctgagtaagagcctaggggatgaaaagataacttacttcaccgatca

SEQ ID NO: 5705 - DNA, 201 bp, Homo sapiens
gctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagacta

SEQ ID NO: 5706 - DNA, 201 bp, Homo sapiens
caatacagtccaagtgctagagaaaagcagatgatagaaaacatagctcttccttgatttaaaaaaaaaaaacaccttttatgtaaaaacataaatttacraaacggttaaaaaaatcacaagaatttccttctttacaaactatttggcttaatgggtagtcacatttaaaatatgattcgattaattttaaatcagcat

SEQ ID NO: 5707 - DNA, 201 bp, Homo sapiens
aaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatct

SEQ ID NO: 5708 - DNA, 201 bp, Homo sapiens
catttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagta

SEQ ID NO: 5709 - DNA, 201 bp, Homo sapiens
ccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagt

SEQ ID NO: 5710 - DNA, 201 bp, Homo sapiens
tccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgag

SEQ ID NO: 5711 - DNA, 201 bp, Homo sapiens
atccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcga

SEQ ID NO: 5712 - DNA, 201 bp, Homo sapiens
acctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaa

SEQ ID NO: 5713 - DNA, 201 bp, Homo sapiens
ggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgccc

SEQ ID NO: 5714 - DNA, 201 bp, Homo sapiens
gggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgcc

SEQ ID NO: 5715 - DNA, 201 bp, Homo sapiens
tgggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctgc

SEQ ID NO: 5716 - DNA, 201 bp, Homo sapiens
ctgggaggtggaggttgcagcggggagagactgcaccattgcactccagcatgagcaacaagagcgaaactccgtctcaaaaaaaaaaaaaaaaaaaaaaaaaaagacttgtactccttcagctctagtttctgagtttaaagtaacaatgcaaagcatcccccacatgggagattgagtatagaatgaatctgccatctg

SEQ ID NO: 5717 - DNA, 201 bp, Homo sapiens
tgataaatgactcatcagtcaagataagtaatattttaatatgatatttttacaaataaaaaccaatgcaaaaaaaatgatgcaaaacaaatcaaaatttgaaataaagacaagatccgactgtacttgcccaaccttagtctcagccctgctggatcctctattattatgttaatcatggaattcttggcattaatttct

SEQ ID NO: 5718 - DNA, 201 bp, Homo sapiens
aggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctc

SEQ ID NO: 5719 - DNA, 201 bp, Homo sapiens
aaatttgttaaatgtaaaaagatgtaaagtccatcatcccaatcacctagcagcatctccgataacattttgatatatttctttttagtctgttttttttrcctttttttttttttccgtctctgagtttaaagaattatgatctcactttatttaactcctgccccccacagacatttttttctactttaaaaaaagttt

SEQ ID NO: 5720 - DNA, 201 bp, Homo sapiens
aaaaatatgacgaaattggtactaggttttgcataatggtgggccattagaaacggccttaattgtggaatattatgagaacagtcatattttttattttwtttacattgtgactcaaagcaggggctctggcgtaagattgatcccagacacgctgcttaatctctcaatgcctgtttcctcaaaggtggatgaaaatct

SEQ ID NO: 5721 - DNA, 201 bp, Homo sapiens
ctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgag

SEQ ID NO: 5722 - DNA, 201 bp, Homo sapiens
gctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttga

SEQ ID NO: 5723 - DNA, 201 bp, Homo sapiens
agctcacatctctcttacctgctctctgggcctcccagcctggactcgcacaagggcaccatcccactacccctcatacttccaatcagtgcagaccagakccaccccaaccccactatcatcactcacatgagcagcaggatggagctggcacagaagacaagcctcctacacctcctctgccaaatcttcaaatatcat

SEQ ID NO: 5724 - DNA, 201 bp, Homo sapiens
aataccaaatttcaccctgtgtgctttcagctcttgtcagtttattttgtgtggcttatttttttaccaataatattcactgtgaattgggcaaaaaagadggatggttaatatttatttttttagctgataataaatcctgagtgattttgtaagacagaggcagagagaagcagagaaggggagaggatagaagagagg

SEQ ID NO: 5725 - DNA, 201 bp, Homo sapiens
gctaagaagatttgagtcatctatggatttttagtcaataccaaatttcaccctgtgtgctttcagctcttgtcagtttattttgtgtggcttatttttttaccaataatattcactgtgaattgggcaaaaaagatggatggttaatatttatttttttagctgataataaatcctgagtgattttgtaagacagaggca

SEQ ID NO: 5726 - DNA, 201 bp, Homo sapiens
tattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtag

SEQ ID NO: 5727 - DNA, 201 bp, Homo sapiens
ccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcata

SEQ ID NO: 5728 - DNA, 201 bp, Homo sapiens
cccaggaggtgaaggttgcagtgagccaagatcatgccattgcactccagcctgggtgacaagagtgaaactccatctcaaaaaaaaaaaaaaaaaaaaaagtggtaggcatggcctgagcacgggaaacccagggtaatgtaagaggcgcagagaagaggccccctaattcagcctgcaatggtgcagtggagtggggga

SEQ ID NO: 5729 - DNA, 201 bp, Homo sapiens
gtgaatatatttccatgtgaatacacatagcacttttaaattcttttttgatacacttatttttattgaggtataacgtatgtgtaataaaatgcttgatraatttttacatatgtatatatccttgaaatcaccatgcagttcaaaatgtggaatgttatcatttccttagaaatcctatgcataccccagaaaataagc

SEQ ID NO: 5730 - DNA, 201 bp, Homo sapiens
ctactaaaaatacaaaaattggttgggtgtgatggcaagtgcctgtaatctcagctactcaggaggctgagacaggagaattgcttgaacccaggaggtgraggttgcagtgagccaagatcatgccattgcactccagcctgggtgacaagagtgaaactccatctcaaaaaaaaaaaaaaaaaaaaaagtggtaggcat

SEQ ID NO: 5731 - DNA, 201 bp, Homo sapiens
agaaggatgaagaggaggaggagggtggtggtgatggccatgatgatggtggtgatgatcgtggtaatgaggatgatggcaatggtcatgatgatgatgaygatgacggtgatggtggtggtgatgataatgataataatgatatcagaggcgtgtgaaccagaacactccatcttaaatagtagctgggtaaaatgaggc

SEQ ID NO: 5732 - DNA, 201 bp, Homo sapiens
ctcccccactccaagatctgtgagcatcattatgctgaatggtgctattaaaactctagagtccattgcaggaagtttccttattaacatgagagcagggyttgtggtcctctccaatctgttaacaatctagatgagtctttaaaattattgctggcaaaagttgcagtacaaaaggaacagagggaacctgatgaagta

SEQ ID NO: 5733 - DNA, 201 bp, Homo sapiens
gtgagttctccattgacttccaaggctcccccactccaagatctgtgagcatcattatgctgaatggtgctattaaaactctagagtccattgcaggaagkttccttattaacatgagagcagggtttgtggtcctctccaatctgttaacaatctagatgagtctttaaaattattgctggcaaaagttgcagtacaaaa

SEQ ID NO: 5734 - DNA, 201 bp, Homo sapiens
catgaacaaagagacttatgcagtgagttaagcaatatggactttatcaacaagtaatgggttattaataggaacatgacatttatatttcagaaaaaaawatttagcatctacaggaggatgagtgaatagaaaagcaggagggcattagaaggttgttataatcatttaaataagaaataactggacaggtgtggtggc

SEQ ID NO: 5735 - DNA, 201 bp, Homo sapiens
ataactccatgccatttagtcattgtgaggggcaaatgaaattaatataaggaccaaactccgaccattttcttctcttgcccaaagccctatctaagggrcctgaagagtcacatcctacagacaataaagtcttgtcagaggggttttattccatgctatataacatggcttagtttccaactttggcagaacatcaca

SEQ ID NO: 5736 - DNA, 201 bp, Homo sapiens
caagaaatgagggtgtctcaagaagtgacaaccgttttaagtcatttaaacataggtcagagtggagagagacaagcctagaaggccatgaacaaagagasttatgcagtgagttaagcaatatggactttatcaacaagtaatgggttattaataggaacatgacatttatatttcagaaaaaaaaatttagcatctaca

SEQ ID NO: 5737 - DNA, 201 bp, Homo sapiens
tacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataa

SEQ ID NO: 5738 - DNA, 201 bp, Homo sapiens
gtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagata

SEQ ID NO: 5739 - DNA, 201 bp, Homo sapiens
cagtcatgtttagttaaattcttccaattgttggaattgtttcaaaataacatgtcacttttattgtttaagccagaggtcactaatctttttttttttttttttatggtaaacggccaattagtaaatattttcagcactacaggccatacggtctctatcacaactactcaactctgcctttgtagcacaaaaacagcc

SEQ ID NO: 5740 - DNA, 201 bp, Homo sapiens
aagaccctgtttttctttccatagagggtaatagggtggtgtgcagggctgggttatgacttaggagagctctcagctcttcctttgatgacatcctcccsctccccaggtatggaggtgctcctctgacctcctctcccttttcccaagtctaaggcaccagatggggtgagacagtggccagggatgagtggaagagca

SEQ ID NO: 5741 - DNA, 201 bp, Homo sapiens
gcacagctaatttctctctcccttatagcttttgcccacaggtcctactcttccctgcgggacagtaactagtggctcttgtttctcctccacaggacagyccttcgtatgtttgaagactgctctctcatgccctctgcctttcttcctgagaccttcctggaatcatagctcttctctctgtgctcattctgtctgacc

SEQ ID NO: 5742 - DNA, 201 bp, Homo sapiens
tttccacagccttatttttcttagtcctccagagttttcaagagaaccttattccacagacaggaaaaataactaatgggtactaggcttaatacctgggygctgaaataatctgtactacaaacccttgggatatcagtttacctgtataacaaacttgcacatgaaccctcgaacttaatataaaagttttaaaaggat

SEQ ID NO: 5743 - DNA, 201 bp, Homo sapiens
gggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagaca

SEQ ID NO: 5744 - DNA, 201 bp, Homo sapiens
attcctccaggaaggaagcttagaagaaaaaatacttgctagacacatacagatgctgatttaatttttgtaatcccatgtgggtattgcctattcaaaasaaataaatatttttaaaaatgtaatcatagaaacacaatagagttgacacacagagaggtagaaggtaggtaaggatgaagtgaggattaggagctaaga

SEQ ID NO: 5745 - DNA, 201 bp, Homo sapiens
tggtcatcaaactgtcatcttccctggtagtagaatctccctgtctttccctgatgaggacacttgtgattatattgttgggtccacttggataatacagraaaatctccccatatcaagatgcttaacttaatcacattggcaaagccccttttgtcatgtaaggtaacatactcacaaggtcaaggaattagaatataa

SEQ ID NO: 5746 - DNA, 201 bp, Homo sapiens
caaactaacacaagaacagaaaaccaaacactgcatgttctcactcataagtgggagttgaacaattagaacacatggacacagaaaggggaacatcacayactgggcctgtcaggggttgggggctaggggagggatagcattaggagaaacacctaatgtaggtgacaggttgatgagcgcagcagaccaccatcacat

SEQ ID NO: 5747 - DNA, 201 bp, Homo sapiens
atctgatggttttataaagggcagttcccttgcacatgctctcttgcctgccaccatgtaagacatgcctttgttcctgctttaccttccaccatgattgwgaggcctccccagccatgtggaaatgtgagtccattaaacctctttttctttgtaaattacccagtcttgggtatttcttcatagcagtatgaaaataga

SEQ ID NO: 5748 - DNA, 201 bp, Homo sapiens
tttgggaggccaaggtggatggatcacttgaggtcaggagttcaagaccaacctggcaaacatggcaaaacctcatctctaccaaaaatacaaaaaaaaamccccaaaaaattagccaggtatggtggtgcacgtctgtagtcccagctactcctcgggaggctgaggcccaagaatcatttgaaccctagaggcagaggt

SEQ ID NO: 5749 - DNA, 201 bp, Homo sapiens
attatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctca

SEQ ID NO: 5750 - DNA, 201 bp, Homo sapiens
gcattaggacaaatgcctaatgcatgcggggcttaaaacctagatgatgggttgatgggtgcagcaaaccaccatggcacatgtatacctatgtaacaaamctgcacgttctgcacatgtatcccagaacttaaagtataataattaaaaacaaaaaagataaggacgtcaagttccctccatgttgcttcgaaagacatg

SEQ ID NO: 5751 - DNA, 201 bp, Homo sapiens
gggaagatcacacaccagggcctgtcagggggtagtgggcaaggggagggatagcattaggacaaatgcctaatgcatgcggggcttaaaacctagatgaygggttgatgggtgcagcaaaccaccatggcacatgtatacctatgtaacaaacctgcacgttctgcacatgtatcccagaacttaaagtataataattaa

SEQ ID NO: 5752 - DNA, 201 bp, Homo sapiens
taatatgtctatgtaacaaacctgcacacgcaccccctgaatctctctctctacacgcgcgcgcgcgcgcgcacacacacacacacacacacacacacacmcacacacggttgatggaaaatgaatgctgcctctagatactgactcaacagtctcaactatgttcttacattggcatttttttttttcacctgtctcctt

SEQ ID NO: 5753 - DNA, 201 bp, Homo sapiens
attagaggctcaaacttcagcattacataatatgtctatgtaacaaacctgcacacgcaccccctgaatctctctctctacacgcgcgcgcgcgcgcgcacacacacacacacacacacacacacacacacacacggttgatggaaaatgaatgctgcctctagatactgactcaacagtctcaactatgttcttacattg

SEQ ID NO: 5754 - DNA, 201 bp, Homo sapiens
cattagaggctcaaacttcagcattacataatatgtctatgtaacaaacctgcacacgcaccccctgaatctctctctctacacgcgcgcgcgcgcgcgcrcacacacacacacacacacacacacacacacacacggttgatggaaaatgaatgctgcctctagatactgactcaacagtctcaactatgttcttacatt

SEQ ID NO: 5755 - DNA, 201 bp, Homo sapiens
aacattagaggctcaaacttcagcattacataatatgtctatgtaacaaacctgcacacgcaccccctgaatctctctctctacacgcgcgcgcgcgcgcrcacacacacacacacacacacacacacacacacacacggttgatggaaaatgaatgctgcctctagatactgactcaacagtctcaactatgttcttaca

SEQ ID NO: 5756 - DNA, 201 bp, Homo sapiens
ctacttgggcaacaggaacattagaggctcaaacttcagcattacataatatgtctatgtaacaaacctgcacacgcaccccctgaatctctctctctacrcgcgcgcgcgcgcgcgcacacacacacacacacacacacacacacacacacacggttgatggaaaatgaatgctgcctctagatactgactcaacagtct

SEQ ID NO: 5757 - DNA, 201 bp, Homo sapiens
atatgcaaaaggctaaatctggacccctatcttttactatatacaaaaattaacccaagatggattaaagacttaaatgtaagacctcaaactataaaaaatcctagaagaaacctaggaaatactgttctggacattagcctaggcaaataatttatgactaagtcctcaaaagcaaatgcaacaaaaaaaaattgacaa

SEQ ID NO: 5758 - DNA, 201 bp, Homo sapiens
taaactcaggagacggaggttgcaatgagctgagatcacgccattgcactccaacccaggcaacagtgcaagacgctgtctcaaaaaaaaaaaaaaaaaaagaagaaaatgtttattttgtcagtattttatctttcaagatctagatatcaccttttccttcttccataaatactacaacctcacataggtattttctgt

SEQ ID NO: 5759 - DNA, 201 bp, Homo sapiens
ttgtcgattttattttatagtgtatttctgttttaacaatgtacaataaccaaaaggctcttttaaagaaataaaatgggccgagtgcggtggctcacacytgtaatcccagcaccttgaggggccaaggtgggcggatcatgaggtcaggagttcgagaccagtctggtcaacatagtgaaaccccgtctctactaaaaa

SEQ ID NO: 5760 - DNA, 201 bp, Homo sapiens
tatgacactccttcagctacaaacacacacataccagtatgttctccttctctcacagacacactcacatgtggacacacactcatgcatgcatgcgcgcrcacacacacacaccgagtaacttgattctccatgagactctgccagaaactaaactattgacaaaagtttcctgatgtgcccaactctctaggtgtgctt

SEQ ID NO: 5761 - DNA, 201 bp, Homo sapiens
ttagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgatt

SEQ ID NO: 5762 - DNA, 201 bp, Homo sapiens
cggagtttcactgcgttagccaggatagtctctatctcctgaccttgtgatccacccgccttggcctcccaaagtgctgggattacaggtgtgagccaccrcgcccagccaagatgttgttattttaatggctgaatagtattccattgtgtatacataccacattttcttcatctgttaattcagtggttgattcaatgt

SEQ ID NO: 5763 - DNA, 201 bp, Homo sapiens
agctaggactacaggcacccgccactatacccagctaattttttgtatttttagtagagacggagtttcactgcgttagccaggatagtctctatctcctsaccttgtgatccacccgccttggcctcccaaagtgctgggattacaggtgtgagccaccgcgcccagccaagatgttgttattttaatggctgaatagta

SEQ ID NO: 5764 - DNA, 201 bp, Homo sapiens
caatctctctaggctttgtattgcttccttccttcttctctcccctgcatctatcatttctttgcctctattgacttgtatgtatgtatgtatgtatgtadgtatgtatgtatgtatgtatacatgtacgtatgtatgtatttagagatggagtttcgctcttattacccaggctggagtgcaatggcacgatcttggctc

SEQ ID NO: 5765 - DNA, 201 bp, Homo sapiens
ttagctcccacttttaagtaataatatatgatatttggttatctgttcctgtgttagtttcctaaggataatggcctccagctccatccatgtccctgcamaggacatgatctcatccttttcttatggctgcatagtattctgtggagtatgtgtaccacattttcttgatccactctatcactgatgggcaaatattta

SEQ ID NO: 5766 - DNA, 201 bp, Homo sapiens
gtgtgtttttccactctatgtgtccatgtgttctcatcatttagctcccacttttaagtaataatatatgatatttggttatctgttcctgtgttagtttsctaaggataatggcctccagctccatccatgtccctgcacaggacatgatctcatccttttcttatggctgcatagtattctgtggagtatgtgtaccac

SEQ ID NO: 5767 - DNA, 201 bp, Homo sapiens
atgcagatttgttacacaggtaaacttgtgccatgggggtttgttgtacaggttatttcatcacccaggtattaagcctagtgcctattagttactttccmgactctcttcctcctcccaccctccaccctctgcaaggccccattgtgtgtttttccactctatgtgtccatgtgttctcatcatttagctcccactttt

SEQ ID NO: 5768 - DNA, 201 bp, Homo sapiens
gaagctggaaaccatcactctcagcaaactatcgcaaggacaaaaaaccaaacaccacatgttctcactcataggtgggaactgaacaatgagaacacacrgacacaggaaagggaacatcacacatcggggactgttgtggggtggggggcggggagggatagcattaggagatatacctaatgctaaatgacgagttaa

SEQ ID NO: 5769 - DNA, 201 bp, Homo sapiens
gaaaacctaggcaataccattcaggacataggcatggtcaaggacttcatatctaaaacaccaaaagcaatggcaacaaaagccaaaattcacaaatgggrtctaattaaactaaagagcttctgcacagcaaaagaaaccaccatcagagtgaacaggcaacctacagaatgggagaaaattttcgcaacctactcatct

SEQ ID NO: 5770 - DNA, 201 bp, Homo sapiens
tatacacttgagctaataacatttaccattcaagcgagtttgttattgttgttgtcatttacgtgcaatttaatggatgtaaaatactcagcactatagtrcttggtatatagcaagcattcaatatatgtatgactttagcacccaaaagactattagaaaagtacagtacttattcacgtactcgtttacttaatggct

SEQ ID NO: 5771 - DNA, 201 bp, Homo sapiens
agaggtatagagaagaatttctctgaatactgggattcaaactggggtcagggggctcctcctcctgctttcttttttccccattccccaatgtcctctawgtcaatccttctgtcctagacagagaaacttgtgccagaaaacacaggatatcctaaaataactccctacatgctaaaggaaaacgaagtgaacattttt

SEQ ID NO: 5772 - DNA, 201 bp, Homo sapiens
agcaagcacgggctatgtgcaagctgggctgcctatggacaggaagggatcattttcagaggcgtttcaaatcatcttcacgttcttgggtgattttttawaaaaaaaatcattaaatgttatacaactctcatttctctcgtccttcaatattactgcatttctctcatcattcaatattactgtcagttctggcagaaa

SEQ ID NO: 5773 - DNA, 201 bp, Homo sapiens
aagcaagcacgggctatgtgcaagctgggctgcctatggacaggaagggatcattttcagaggcgtttcaaatcatcttcacgttcttgggtgattttttwaaaaaaaaatcattaaatgttatacaactctcatttctctcgtccttcaatattactgcatttctctcatcattcaatattactgtcagttctggcagaa

SEQ ID NO: 5774 - DNA, 201 bp, Homo sapiens
tctgggccccttccaacattgcagttccatgaattttacctaattaaattaattaaagtgggtaatagatttaaagactttggataattattgttttccckacagtagcttttgcagaaatctaatattcttgaattgattaaccattttaaatcacatctcaacaagactgtgagctcctcaagggcagagatttttgtt

SEQ ID NO: 5775 - DNA, 201 bp, Homo sapiens
tccattccactggctgcttgggtcaggctgtaagaaggctggttagacaaaaggcacagacaggatgcagacagtggaggagtttctcccattacccatcyacccactgacaaggtggaagccaggggttttatatttgcaaaaaggaatgaaagaaaattcaactagatactgtccagcaaattacaagaaagaatgttt

SEQ ID NO: 5776 - DNA, 201 bp, Homo sapiens
attaaaagacagagtaatagagtttcaggagtcaaccgtcagagagatgcagaatctaaaagggaacaggcaaggataattgaggcagtgttgtgtgtgtrtgtctccaacttgcttccattccatttaaaagggaacaggcaaggataattgaggcagtgttgtgtgtgtgtgtctccaacttgcttccattccattcca

SEQ ID NO: 5777 - DNA, 201 bp, Homo sapiens
tggtgctatgaagtggtttgccaccaacagagagaataactcagaagggagaaattgcttgtctcactaaactgtatccacagtttggaggatactcaggrtagatccaagagtgcctcgtgttttgaaggcttttgatttgaggagtttggggtggaagtgagtgtccaacagaatttctggatgtgaaggaagataaac

SEQ ID NO: 5778 - DNA, 201 bp, Homo sapiens
aaaagatttccttctgccctttgcccaaacaatacctctttttagaggaaatcaacatggtaaagcagacttcaatttcaaaaaaaaaaaaaaaaaaaaaagagcaaatgcacatttctcattaccaattacagcctgttccaatcattttcaaattaatcatttcctgcctcgtggccctctttgactagcgtactgaac

SEQ ID NO: 5779 - DNA, 201 bp, Homo sapiens
atctttttttttttttttcctgaaaactttaaaatactgtggaacttttcattctctcctctaggttatttaccttgttttaatatttgcattcttttttstctctgtgctgcatttgggtaatttccaatagatgtattttcccgttaatttattcttttgttggtaatatttagctttatgttttaattttatttattt

SEQ ID NO: 5780 - DNA, 201 bp, Homo sapiens
aatatgtatatatattatatattatatacatatataatatatataacttagcacagttcctggttttgttttttggagttttgtctttttttttttttttwttttggtcattattatgtttttctgaccttgctttcccttacccctgcccccaatacccacccaagcttggaacaagacatgggaataaaagggcagaac

SEQ ID NO: 5781 - DNA, 201 bp, Homo sapiens
accactttcttgaaaaatcctctcttccaggacattgcttcctgctgcttccaccatacctccaatcacttctaggaattgcacttttgatcccataatgygacagacttgcacaatagcgcttcatgtctgcagagggattcatatgctacaagatacatttacatatgtggctttctttcatccttactgcaattgtga

SEQ ID NO: 5782 - DNA, 201 bp, Homo sapiens
acattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggc

SEQ ID NO: 5783 - DNA, 201 bp, Homo sapiens
ttaggtctaggagagctaaccttaatgttctgtttcaaaaactttgagaaagaggacaatttgagttaaagagaaaaaaccttctggcttttgtgcattcragttgatggatctcaatgagaggcacctgaatctcttcctcctgaaaggagagcagttaagaccaaccctcagatggagaggaaagcaaggtgaccttac

SEQ ID NO: 5784 - DNA, 201 bp, Homo sapiens
tcctttcccattggaccatcttatctaacgtagtgtctgcaccccatcactatcatgtcactatgtttttttcttcttcttgatatttattataatctgtkattattagtttgtgtgtctacatgttattttcacaactaaattctaaactgcctgatagaaaatctctatttgatttaccacattatctctggcagcagt

SEQ ID NO: 5785 - DNA, 201 bp, Homo sapiens
ctttttgggggatatgagacttcaagttccatcctctaccatatcaagtcattttttgggaaagagatttggtcctgacacttttctgataacacccattkagaaggtagtgcccactgaggaaagcccactcaaaatggcataacgtgtatgacataaaccctggctagagtgggatccttttaatgagttatagctaac

SEQ ID NO: 5786 - DNA, 201 bp, Homo sapiens
agattaaaatatttcattttgttttatccatcagttgaagtacataaaccatacttttctggtattacaagcaatatcagtgacccaaaaccattcatacratggtacaccaacgcagtataatgtattctttgtgtgtgtgtgattgagtctcgctctgtccctcaggctggagtgcagtggcacaatctcgactcactg

SEQ ID NO: 5787 - DNA, 201 bp, Homo sapiens
agcttaaatggattatcaaaaatgaaaacagtaaatccatagcgctctgaatgtaaggcagtgtccaaaatcctgttagtcaatatttcactgaagagaaygaaacatgaaagtttcactggatgccaacattacatataaatgaagacagtggaagaataagacaatgggcttggagttggtgtccacaaattggtttca

SEQ ID NO: 5788 - DNA, 201 bp, Homo sapiens
aagaataagacaatgggcttggagttggtgtccacaaattggtttcagtttacaatttgctttaagagataaagttatttttgtctctggaaaaatataakaaagttagttgactttaatataactgttttcccaggggggagatttctcaaacaactaaaagtagatctaccatttgatccagcaatttcactactgggt

SEQ ID NO: 5789 - DNA, 201 bp, Homo sapiens
cagttttcctccagagattcacgtttgtcttaaccttccctaatttgggacaaacccacttatatgggagtgccaagggggaattagtgatctgaatttcrtgatattcaacaagatagttacagtcaaaactcatttatgataaccaaacagttaatacaacactttcctttaaagacaaaaataatgctttactatgtt

SEQ ID NO: 5790 - DNA, 201 bp, Homo sapiens
catgaaggtgggcagatttgacagaacaattttttaagagacacgctcttgctctgttgcccaggctgggttgcagtgatgtgatcatggctcatggcagmctggacctcctggcctcaagtgatactcccactttggcctttcaaagtgctgggattacaggtgtgcgacaccatactcaagctggaaaacataattttg

SEQ ID NO: 5791 - DNA, 201 bp, Homo sapiens
cacatcctgtcagtgacttgtactcaaccactctgcttctgtcaacccagaccaccatagagactttactctcttgcctagaggctggatgacctgctgtsatccaccacccttagtgggggggtagtaggaggccacatctgtgtatatttacatgtgatgattagtgacctcaacactgtacagtcatgggatatgtgc

SEQ ID NO: 5792 - DNA, 201 bp, Homo sapiens
gatgccctttccctacctctgttcatttgtatcaccttcattctatgttccttcccttcttcccctatcacaggctcttccttcacctggtcaagatttcyggaagattagagagaagttttaggtgccccaggtttaagattcaaggtcacaggcatatagtggcattctttggtctccctggaaacctcagccagttta

SEQ ID NO: 5793 - DNA, 201 bp, Homo sapiens
gatgtattcaggatttcaacttcaaagaggctgacatttgtgacctcactgataaaattttctccaaaccaaaacaggccttcacaatacatttagcaatyacatattatatctttaaaatcctgatctcaaggactgagatctgggcacttgcatcttgtgtgataatagctgagactggagtttgaaacgaggaagtaa

SEQ ID NO: 5794 - DNA, 201 bp, Homo sapiens
tttcaaagggttgggcacgttcaggtgacagcattcctgccactcacttgattttgacgaacttccgacatggcacggtgttcctcacacacgtctcggtyagggggtctatgtcttccacgatgacgaatggggcctcctccagggtgacgatgctgagatggttgtcatccggctcacagtcggagaaggacttgtacc

SEQ ID NO: 5795 - DNA, 201 bp, Homo sapiens
agagacatccatccgtctcaagggcctttctgccacatatctcaacatatgcatctacttctgtgctaagacaaacgggcataaagagaaaacagaatatrgggcagttctccatcccagccgccctcatccccagaggaatcaacctgcatctctggaggcagtgcccaggcactgatacctttacagccccgcaggtgg

SEQ ID NO: 5796 - DNA, 201 bp, Homo sapiens
ctctctaagattacctcatcatatgggctggaaaatttttgctggctataaagaaacatttcctgtggctaattacaaaattgtccagcattgctgatacmtttctttttaagataggatggcgagtagagcaatttggttaaacacacacacacatgttcatttattcacgctatgatatgtaacaggctggggagaatg

SEQ ID NO: 5797 - DNA, 201 bp, Homo sapiens
tttctttttaagataggatggcgagtagagcaatttggttaaacacacacacacatgttcatttattcacgctatgatatgtaacaggctggggagaatgytgagcgcatcaaattcttcattcattcgacatagatttattgaagacctacgatgtcccagtgccagcctaggaataatgatggctaaaacagaatgact

SEQ ID NO: 5798 - DNA, 201 bp, Homo sapiens
gtaaattaaggcaaagactagcagaatctttggtgatgtcattgaccacatcacaacccccacaccatgggagtcaggcaaaagtttcagtccaacgctcrctcatggagagaaaagttgcaaaggtttatgagcccccagagtgcaataacttcctaaatcttctccaagttctactccctgttcctgacacatccaagt

SEQ ID NO: 5799 - DNA, 201 bp, Homo sapiens
gccaaacttctggttatatttatacacaaccaggacaggcaagcacgcttgtgtgtgtgtgtgtgtgtgtgtgtgtgtgctgtatacatgtacatgtatawgcacatatggatcccattgagttttcaggcatcaacttcattgctacagaacccctctcttctctcctttacatggcacaggacaagagggttcagaatc

SEQ ID NO: 5800 - DNA, 201 bp, Homo sapiens
gtatacatattcctatacatctatacatgaacctctacataaaagcacacttatatacaggtacattcatgcctacccacgctcacattataatcacataygctcacacccacacgtacaactacaaatacacacatacctaacacaaacacatatactcgaacctctacacacacacacacacacacacacacacacaca

SEQ ID NO: 5801 - DNA, 201 bp, Homo sapiens
gccatcattttcttcaggagttcatgtataatcttcagtcctccagagttcctttgttgccagatccctggggaaagataggagtcctatttctttggatyacttttaattctttgtgtgctcttaaaagtgatgggttcttgtaattagctaaaaagttaatagtgttttctctcttttggttctaccttggagtaatat

SEQ ID NO: 5802 - DNA, 201 bp, Homo sapiens
cattttcttcaggagttcatgtataatcttcagtcctccagagttcctttgttgccagatccctggggaaagataggagtcctatttctttggattacttktaattctttgtgtgctcttaaaagtgatgggttcttgtaattagctaaaaagttaatagtgttttctctcttttggttctaccttggagtaatataatgc

SEQ ID NO: 5803 - DNA, 201 bp, Homo sapiens
ccccaatatgcacagtcttccactttgggaaggggcaacattttctttccatgtggagcacaggaggtggggagaaagcagccagaggtggtcttacagtktgcttttactcatgacagttttacttcttccatttgcctgtgaattgactcttctgaggaccttgaattccaccacagaaaatacctctaacagcagagc

SEQ ID NO: 5804 - DNA, 201 bp, Homo sapiens
ctgaatgatattaagaagttttttttccctcagcaaacttgccaataagagttagaaagtggctaagagaggtagactgtgatcctgggctgacagctgaraaagccttttatttattgtgataatcaattcattcttaccagcctgaaaattatgactgaacatgactatagatatgacttctcttactctatggcaagt

SEQ ID NO: 5805 - DNA, 201 bp, Homo sapiens
taaggttacagaacctggaggtatcaatcagtggaacagcatttcatccccctcgcctgtgaaaagttattgcgttgtgagaggtgaaatgtctggaactyggtagcaggtctctgatgggcatttgttcttctgtatctggggcaaaataataaatttaagtttttgagatggacattttccttcttccaaatgaaaggg

SEQ ID NO: 5806 - DNA, 201 bp, Homo sapiens
aaatgctaacagccaaagggtgaaaggtgcaagaaatgcagagggcttcagaagtgagaggcagatctgatgagggaaggaagaaatcatgaaggagtgcratggaggggagttgtgcagtttgcaaaggacctgaaaagtcagagtggaaagaagggatgtgtaggatcagagaacagcatgcacaaaagcttagaagct

SEQ ID NO: 5807 - DNA, 201 bp, Homo sapiens
agtgaacataaaatgtggtaatgtacataaagtggttggctcaggacctgtgatggaatcacagtttaaaaactattaggcactttttttttggaatgatrcaaggaaaactaagctccattcgcttcccacttaaattctctatctcccacagcatggcacaattgcacttgctttgtagaatttgattgaagaaagtag

SEQ ID NO: 5808 - DNA, 201 bp, Homo sapiens
tggaatcacagtttaaaaactattaggcactttttttttggaatgatgcaaggaaaactaagctccattcgcttcccacttaaattctctatctcccacarcatggcacaattgcacttgctttgtagaatttgattgaagaaagtagcagaagttagtagtcaaagcatgggcttcggagtcagacaaatggggttcaga

SEQ ID NO: 5809 - DNA, 201 bp, Homo sapiens
atcttagtctcttcacctattaaaagcaggtaaatgtttctgctttccctgtatacagcatggatgtcaggatctgatacccaaaactaattgttgccctsctttcctatgttagatctgcctgtcctagtttcttcaaacacactttaattgtggaaagaaaacatatgccatcagctataatctgctggaccacataga

SEQ ID NO: 5810 - DNA, 201 bp, Homo sapiens
aatctgctggaccacatagaggccagcacggtaggaatcaacaggaattaggattcttccgattcaaattgtttgtttcaatgttaaagttaaagacaacrtaagtgagaggccattggtttctatgagtcattctacaactccctttaagggaatacgagttgattctcttgtttttccccaactttagatttttttctc

SEQ ID NO: 5811 - DNA, 201 bp, Homo sapiens
ctgtagctacagaggcaggctgacagagccacttgtagccagaagcagattgctggggggagcagctctctgttctgtccattttcttagggacagatgtyattcctgtctgttccatcagcaggcaaatggggaaataatagaacagagacaatggaaagaaagtgagaagcaggcccagacagcagccactgagctcca

SEQ ID NO: 5812 - DNA, 201 bp, Homo sapiens
gaaataaagaaaaataatgtttgtggttcagttactagaatggataagatgactgtcaccctttggatagctcttctttatcctttaggacttggtcctarcttaggtctttcaggaagttttttcacctccccagtgcccaggctggagtaggtgtcccagtgtgccatgtgcacctctcctgtttatgctcatttcaca

SEQ ID NO: 5813 - DNA, 201 bp, Homo sapiens
tctccattatctcaggtagcagagcatattacatatgtgtcaaagaaaatgctaaaccatcacagctatgcttgatgcactgctacctttctacccctacrtcctcatgtcctcacctgtttacccccacatccgcacgtcctcaccacctgcttctttgtttgatcaccaataaatagtgtgggcttccggagctcaggg

SEQ ID NO: 5814 - DNA, 201 bp, Homo sapiens
agctcagggcctttgcagcctccatacactagcgttggcctcctggacccaccttatatactcttaacctgtcttttcccattcctttgactctgccggaytttgtagcccccacagcctggtgttgggtctgatcaccccaacattccctaaaatcccggggatattttattagtcatctctgcttcgcctgtacctact

SEQ ID NO: 5815 - DNA, 201 bp, Homo sapiens
gattttgtagcccccacagcctggtgttgggtctgatcaccccaacattccctaaaatcccggggatattttattagtcatctctgcttcgcctgtacctrctacaggcctggcactgagtcagtaatcagtgaatgcttggtaaacagatcaatagtgggtaagtgggtgggttcaagagtgaatggatgcccatatggc

SEQ ID NO: 5816 - DNA, 201 bp, Homo sapiens
ttttgtagcccccacagcctggtgttgggtctgatcaccccaacattccctaaaatcccggggatattttattagtcatctctgcttcgcctgtacctacyacaggcctggcactgagtcagtaatcagtgaatgcttggtaaacagatcaatagtgggtaagtgggtgggttcaagagtgaatggatgcccatatggctg

SEQ ID NO: 5817 - DNA, 201 bp, Homo sapiens
taaagaatacgagttaagtccacacaaaagcctaggtattgtcatacccccaacttccactcaacttccaaggcagataccatccctgtgaatctccacawcctatatgaaaatttccatcattcatcctaggaactgtgcaaagtactggaacaagcactaaacttggagactcacaagacctaaatttgaatcctttct

SEQ ID NO: 5818 - DNA, 201 bp, Homo sapiens
aatcctttctcagctattaattttttaaaaatcatagaacatctctaagtttgcatgactcaaatatgaaatcagagactcacttcacagggttattatgyggctaaagtgaaataataagtacagaaggccatactgtaaggtttggtatagaataggtgctcaacaaatgcttactatttatttacgtcatattcagac

SEQ ID NO: 5819 - DNA, 201 bp, Homo sapiens
aagtacagaaggccatactgtaaggtttggtatagaataggtgctcaacaaatgcttactatttatttacgtcatattcagacaactactacagtcaatcyccttcctctacttgctttcaaacttattttagaaatattttatttttccccaaatggaagctcactttgaacctcaacataacataccaatcagatgaag

SEQ ID NO: 5820 - DNA, 201 bp, Homo sapiens
ctacccacccagagaccctggtggcactctaagttctgaaaggaatcagcattcaagggaatataattagaaaagaaaatttgccttaaagtccactgttwctttgttctctctctctcgtctccctcttcccccttctctctcccccttcctctccccagttccgtcttcctctctccctctcccccctctctctcccct

SEQ ID NO: 5821 - DNA, 201 bp, Homo sapiens
tgatgttacaactgcaacaacaacaacaacaacagcaacaacaaaagaaccagtgcaagacacacacacacacacacacacacgcacacacagttgcacasacacatgctttgggagatggcatcacttatttcagttgaatgtgttaatttgctagagatctactatattttcctcactgtgacctaacatattgtactg

SEQ ID NO: 5822 - DNA, 201 bp, Homo sapiens
agtttctcctaagcattgctactgagcagtatattccaaaggaagaaagaagcacaaaagctaagaagcaagaatcttgataacaggatgacctaaataamaccatttcagggttacacagagtaagtctatgccctaaagcagtagctttacatctttaatgggcatgagaatcactagggaggcttataaaacatgcag

SEQ ID NO: 5823 - DNA, 201 bp, Homo sapiens
agagtctttccattcattctccaaatccttattgagcctctgctattgaataccagagatataatggtaaaggagagactgaaaacacaccatgagctctmagtgctagccgtggccagaattcatggctttaccaatgggctgctattgtctttctaagcaaagagagttgtaatatgtttctccctgccggtagaatgt

SEQ ID NO: 5824 - DNA, 201 bp, Homo sapiens
cacacacacaacacacacacacacacacaaacacacacagaagcaaactgacactaacaacctgcatgttttcttgagatcttgaaactcactgggccctrctaggctaaatgtggtagtagtgatgggaaagagatggcaaggagagggagctaaaatacaataatttagataggagggagctatagcattctataatta

SEQ ID NO: 5825 - DNA, 201 bp, Homo sapiens
gcctggtaacagagtgagaccatgtctctaaaaaaaagttaaaaattacaaggtctgggagatgcaataaatgcctataccctgagttctaattagctggkttcaggtagaatcaattgcatccagtgagaggaaaggaagcagacacctttctaagggtaggaggaggaactccctaaatttctcctctagaatacctcc

SEQ ID NO: 5826 - DNA, 201 bp, Homo sapiens
caggcggacctccacttacatccttcttccatcacacaccagctgggagatcttaagctggtcactaaccagagagaaactctggttctctgaaccagaayttccatctctgaagcagggagaagaatacctactttagaagtgctattaaacaaatacctactcagatgactaaatgagataatgaatgtaaaattgtca

SEQ ID NO: 5827 - DNA, 201 bp, Homo sapiens
ggctccggtggatcaactgaaggatcaatacaagaggtgatcaataagcaatggatattgttattataattggtattcatgtcagggggttaaatatgaawgctcagtgaaaactgttagttaattgtgctgggtatcccgatctgaaggatttaaggttttgttgttttgttttgagacaaaaccttgctctgtcaccca

SEQ ID NO: 5828 - DNA, 201 bp, Homo sapiens
ctcccaggttcaagtgattctcctgcctcagcctcctgagtagctgggattacaggcaccaccaccatgccgggctaattttttgtatttcagtagagacragatttcatcatgttgcccaggttggtcttgaactcctgagctcaggcaatctgactgccttggcctcccaaagtgctaggattacaggcatgagccacc

SEQ ID NO: 5829 - DNA, 201 bp, Homo sapiens
aagatttgtgtgtgtatgtgtacgtttattaaaaaacaaacaaaaaaaacacacacacagtttttggccaggcgcgtggctcacgcctgtgatctcagcamtttgggaggctgaggcgggtggatcacttgaggtcaagagtctgagaccagcctggccaacatggtgcaactatctctaccaaaaatataaaaaattagc

SEQ ID NO: 5830 - DNA, 201 bp, Homo sapiens
ttatcattctgactaaagtattttctaatgtctttctgatttcttctttgacctataggtttagaagtgtgttgccatttccaaatatttggagattttcyagatatatttttgttactaatttttattttaatgctgttatgatcaaagaatgcaccctccattatttcaattcttctaaacacattgagacttttgttt

SEQ ID NO: 5831 - DNA, 201 bp, Homo sapiens
atttgctatatgtcaggactcagctagttggttcagggtaaataagaaaatgaacatgattcccaccctcaagaagtttagagtctaagggggaggatagwcatgaattgattaaacacagatttatgacaaatgatacaagggacgggagagtatgctataagaaagtgaaataggggtgaggcaaggctgaggaagtgc

SEQ ID NO: 5832 - DNA, 201 bp, Homo sapiens
tgagatcaggtgaggctgagaagatgaataggaacagaaagtgcaggattttagagaccatgttaaatgtctgtcttaaaaccgtgggaaggtgcaggcayggtggctcacacctgtaatcccagcactttgggaggctgaggtaggggaatcacctgaagtcaggagttcgagaccagcctgaccaacatggagaaaccc

SEQ ID NO: 5833 - DNA, 201 bp, Homo sapiens
cattcatctatccatcaatccatcaatacatttacctgtccattcatccatctatcaatacattcatcaatccattaatccatccatccatccatctatcygtcaatacattcattaatacgttcatccattcttccatccattaggcatgtttgagcatctcctatgtatcacaccctgtaccagaactatgccatgaaa

SEQ ID NO: 5834 - DNA, 201 bp, Homo sapiens
aagttgggggcaagtgggaaagtaacttgggagaggacgctagagacagacgcaggagtcagataagcaagtactatatagactgagtttagacttcatcytgtgtttatttggaatggaggcttgaaatgcaagtttgtaagaggcagatgggcaaacagatgaggctttgtagtaacgcaagcaaggaatagagacgac

SEQ ID NO: 5835 - DNA, 201 bp, Homo sapiens
agactgagtttagacttcatcttgtgtttatttggaatggaggcttgaaatgcaagtttgtaagaggcagatgggcaaacagatgaggctttgtagtaacscaagcaaggaatagagacgacggtcaaagaaagcaacaggtggaatgaagagattggacagataggcaggcaactgcaatggaatttcagtacaaaaact

SEQ ID NO: 5836 - DNA, 201 bp, Homo sapiens
ttgtagtaacgcaagcaaggaatagagacgacggtcaaagaaagcaacaggtggaatgaagagattggacagataggcaggcaactgcaatggaatttcartacaaaaactaccgacaaagaccaccaatggcctttacctcagctagcgaaaataagttaccagtcactctgtacctgctgccctaagttgataattagg

SEQ ID NO: 5837 - DNA, 201 bp, Homo sapiens
cccagccaaaacagtgattgttttaatcaagaaggtagcatacgcagttgagcacctttctttggatttacttaaaatctccttctttaatttcccatctmcatgttctccacttgttcccttttcttccatttggtagtaaaatcagatggaattagcagagtgattactgagacgcaaacactgttcttcagattatat

SEQ ID NO: 5838 - DNA, 201 bp, Homo sapiens
taaaaatacacacagaattttgaagacttcgtatttttcaaaagagtaaaaggtctcataaataattttaggttgatttcatgttggagtagtttaggcawgttgggttaaataaaatatattattaaaattaattttatctgcttctcttcacttttttaatgggctaccagaaaatttaagttacatgtgacttgcatt

SEQ ID NO: 5839 - DNA, 201 bp, Homo sapiens
tttttaactggtagactgtaatcatggaagcagggacctcatctgccttgcttagtattatatttctagtgctaaacagggtgtgcgccacagagctggtkctgaacatgtgcagaatgaataaaagaataacttgctgcttctatgttgttgaggtttcatgacatcgaggaaagagaataggctttacagtgagacagt

SEQ ID NO: 5840 - DNA, 201 bp, Homo sapiens
ataaaagcagggattttgcctggtttttccttctgctgctttttctcccttgaagaacctagaatactacctggtataaagtagatgctcaatgcaaattygtggaatgaacaaaagtctcaactctctgtctttttgttttctttcgtttttccttttgatgatgagccctactttgtctctctgtccagtgggtgtcta

SEQ ID NO: 5841 - DNA, 201 bp, Homo sapiens
tcatcaatatcctcttttcttctgccttagtaacagaaattctatttttagaggggcacagaacctccaataataaagcttacatttctagcttccctagyagctaggcatgaccctatgacaattttctggataataggaagacagaaggtatgatatgcataacttataggaagtactgtaaaagaaggaggtgagccc

SEQ ID NO: 5842 - DNA, 201 bp, Homo sapiens
gaacctccaataataaagcttacatttctagcttccctagtagctaggcatgaccctatgacaattttctggataataggaagacagaaggtatgatatgyataacttataggaagtactgtaaaagaaggaggtgagcccgtctttgttccttcctccttccttctagttgcaatgcagatatgatggctggagcagtag

SEQ ID NO: 5843 - DNA, 201 bp, Homo sapiens
aagctacttttatgttttagaatttctgccatttaaaaaaataattttagctgagttaagcagtcaactggttatttgaaccaaaatctttcagatttcawaggctttgaattaaggcgcaccagcactcatttaacctccctacacctcagttgccctctctgaaaaatgggggggtggtaccacacacttctttatttt

SEQ ID NO: 5844 - DNA, 201 bp, Homo sapiens
tagaatttctgccatttaaaaaaataattttagctgagttaagcagtcaactggttatttgaaccaaaatctttcagatttcataggctttgaattaaggygcaccagcactcatttaacctccctacacctcagttgccctctctgaaaaatgggggggtggtaccacacacttctttatttttccaactctacgatatt

SEQ ID NO: 5845 - DNA, 201 bp, Homo sapiens
atcgcgtgccaccatgcccagctaatttttttgtatttttagtagagacggggtttcactgtgttagccaggatggtctcaatctcctgacctcatgatcygccacctcggcctcccaaagtgctgggattacaggcgtgagtcaccgtgcccggcctctcttggttttcttaatccattcctcatgtgacagcacttagc

SEQ ID NO: 5846 - DNA, 201 bp, Homo sapiens
cacctcggcctcccaaagtgctgggattacaggcgtgagtcaccgtgcccggcctctcttggttttcttaatccattcctcatgtgacagcacttagcaayacattgtctcctgctattctctgaggattccactttcacacatttggtcccaccaggagcaaaggtcagatcttcccttctgtcatttatgtttatccag

SEQ ID NO: 5847 - DNA, 201 bp, Homo sapiens
gcctcccaaagtgctgggattacaggcgtgagtcaccgtgcccggcctctcttggttttcttaatccattcctcatgtgacagcacttagcaacacattgyctcctgctattctctgaggattccactttcacacatttggtcccaccaggagcaaaggtcagatcttcccttctgtcatttatgtttatccagcagactt

SEQ ID NO: 5848 - DNA, 201 bp, Homo sapiens
atccgcccgcctcagcctccgaaagtgctgggattacaggcgtgagccaccactcccggccaactatacagaattcttaataaggcaagctgaagctgacrgcaatttacaagtcagggaaataagaatcaactggtcaaggaacacatcaaaactgggaggacttgaatcaagtccaccacccttaataatagccacctt

SEQ ID NO: 5849 - DNA, 201 bp, Homo sapiens
ctacatgacaggtttgttgtgagaattagattgattaataaatagaatttagcacagtatgccagacacactctaggcacttgataaatgctaattactgyagatgtgataatacctttggttgttgttaattaatcaacatctgtacttccttcctgggattattgagagtgctgcaacaatttctcatctgccaattat

SEQ ID NO: 5850 - DNA, 201 bp, Homo sapiens
gaggggggatggatagcactaggagatatacctaatgtaaatgacgagttaatgggtgcagcacaccaacatggcacatgtatacatatgtaacaaacctrcacgttgtgcacatataccctagaacttaaagtaaaaataaaaataaaaataaaaaaagttaaaaaaatgtgtgtgtgtgtgttcattttaactgataac

SEQ ID NO: 5851 - DNA, 201 bp, Homo sapiens
attgattttaattttccttctttttttttttttttttttgagacaaagtctcactctgtcacccaggctagagcgcagtggcatgatgttggcttgctgcmacctccacctcccaggttcatgcaattctccctgcctcagcctcctgagtagctgggattacaggggcctgccaccacatccagctgatttttgtatttt

SEQ ID NO: 5852 - DNA, 201 bp, Homo sapiens
atcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatc

SEQ ID NO: 5853 - DNA, 201 bp, Homo sapiens
gatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatat

SEQ ID NO: 5854 - DNA, 201 bp, Homo sapiens
agatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccata

SEQ ID NO: 5855 - DNA, 201 bp, Homo sapiens
atgacaacctgtaggggcaggcacccaggacacaagcctcttccagaccagctctccaatttgaccccagatccctaccctcagacctgtggatgaagctrtccctcctctgcattcccatggtcccgtgaatacaatcatactgcacttgcattatgagtctctccagctagattctgaaacaaattgataacagatgca

SEQ ID NO: 5856 - DNA, 201 bp, Homo sapiens
gaggagaggaaggcttagattgtgaactcaattctgctcctccatgagccagccttccctctacagctcatcttcagctgtgggggatgacaacctgtagkggcaggcacccaggacacaagcctcttccagaccagctctccaatttgaccccagatccctaccctcagacctgtggatgaagctgtccctcctctgcat

SEQ ID NO: 5857 - DNA, 201 bp, Homo sapiens
ccccttctgccatgattgtaaatttccggaggcctcccagccacactgaactgtgagtcaattaaacctttttcctttataaattacccagtcttgggtaygtcttcattagcagtgtgagaacgaactaatacaacttaactatttgatgaagggaaaaatggacacacttatcttttaagtcattttaaattatttcgc

SEQ ID NO: 5858 - DNA, 201 bp, Homo sapiens
tgttggcttccccttctgccatgattgtaaatttccggaggcctcccagccacactgaactgtgagtcaattaaacctttttcctttataaattacccagwcttgggtatgtcttcattagcagtgtgagaacgaactaatacaacttaactatttgatgaagggaaaaatggacacacttatcttttaagtcattttaaa

SEQ ID NO: 5859 - DNA, 201 bp, Homo sapiens
gcacacacagcccagcagaacacacgtgcagagcacaaatacagtagaacttcctagagcattgcttttacttgtgatatggtttggctgtgtccccacayaaatctcatcttgaattgtagttcccatcatcctcacgtgttgtgggagggacctggtgggaggtaatttaatcatgagaatggttacccccatgctgtt

SEQ ID NO: 5860 - DNA, 201 bp, Homo sapiens
aaagtggccaaaatgttgtgaaggtgccatggaaggaaacaaaacttaagaaattcttctgatcaaaaaaacagaggttgtggagtcaggagacctgagtycagggcccagctctgttacctgcctaccagcagtgtcaccaaaaataagcttctgtgattccctgggcttcactttcctcctctctacaatgagggtggt

SEQ ID NO: 5861 - DNA, 201 bp, Homo sapiens
ctttaaaatgtttagaatggcagattctatgttatgtgtattatatcacaataaaaaattagtcaaagtggccaaaatgttgtgaaggtgccatggaaggraacaaaacttaagaaattcttctgatcaaaaaaacagaggttgtggagtcaggagacctgagttcagggcccagctctgttacctgcctaccagcagtgt

SEQ ID NO: 5862 - DNA, 201 bp, Homo sapiens
accattcacaatagctaacagatggaaacagcacaaatgcccatcaatggttgaatagataaattaaatatagtatatccatacaatggaatattattcarccatgaaaaggaataaagtactgattcatgctacgacatggatggaccttgaaaacattatgctaagtgaaagatgccagatgcaaaaggtcacataaca

SEQ ID NO: 5863 - DNA, 201 bp, Homo sapiens
ccagagacgggtaatttatagaggaagaggtttaattgactcacagttctgcatggctggggaggcctcagaaaacttacaatcatggcagaagatgaagrggaagcaaataccttcttcacggggagacaggaaagagtgtgagcatgcaggaaagactaccatctataaaactatcagatctcatgagaattcactcac

SEQ ID NO: 5864 - DNA, 201 bp, Homo sapiens
atgaggaggatcaccccaaaatacaagcgtagcttctaccttaaaaacagaaatgaaaacccttatgtgacctcgtgtccctctgtagataattctccatktctctctgttcccttttatagcaaaaatgatctagagagttggctataaccaccctgcctacttctgtgctattctttcctctgcgaactctggtcaggt

SEQ ID NO: 5865 - DNA, 201 bp, Homo sapiens
atggtggtacacacctgtggccccagctactcaggagcctgaggtgggaggatctcttgagcctggtagggcagagcttgcagtgagctgagattgcaccrctgctctccagcctgggtaacacagtgaggccctgtctcaaaaaaaaaaaaaaagaagaagaagaagaagtgtatacagggtccaaccatagcaaaatca

SEQ ID NO: 5866 - DNA, 201 bp, Homo sapiens
taagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcag

SEQ ID NO: 5867 - DNA, 201 bp, Homo sapiens
ataatgtgaaagaattaattgtagaagtgtactgtaatcccagcactttgggaggccgaggtaagcagatcatttgagctcaggagttcgagaccaggctwgggcaacatggtgaaacaccgtctctactaaaaatacaaaaaaaaaaaaaaaaaaaaaaaatagccaggcatgcaggcatggtggtacacacctgtggcc

SEQ ID NO: 5868 - DNA, 201 bp, Homo sapiens
gataatgtgaaagaattaattgtagaagtgtactgtaatcccagcactttgggaggccgaggtaagcagatcatttgagctcaggagttcgagaccaggcytgggcaacatggtgaaacaccgtctctactaaaaatacaaaaaaaaaaaaaaaaaaaaaaaatagccaggcatgcaggcatggtggtacacacctgtggc

SEQ ID NO: 5869 - DNA, 201 bp, Homo sapiens
atgataatgtgaaagaattaattgtagaagtgtactgtaatcccagcactttgggaggccgaggtaagcagatcatttgagctcaggagttcgagaccagscttgggcaacatggtgaaacaccgtctctactaaaaatacaaaaaaaaaaaaaaaaaaaaaaaatagccaggcatgcaggcatggtggtacacacctgtg

SEQ ID NO: 5870 - DNA, 201 bp, Homo sapiens
tgcatatccactcatccatttattcaacattttttttttgagatggagtctcgctctgtcgcccagactggagtgcagtggtgcgatctcggctcactgcracctccacctcccgggttcaagcaattctcctgcctcagcctcctgagtagctgggattacaggcgtgtgctaccacgcccgactaatttttatattttt

SEQ ID NO: 5871 - DNA, 201 bp, Homo sapiens
gcctttaatctcagcattttgggagaccaaggcaagtggatctcttgagcccaggagtttgagaccagcctgggcaaaatggtgaaaccccatctctacaraaaaacacaaaaatgagccaggcatggtggcacacacctgtagtaccaactactagggaggctgaggcaggaggattgcttgagctcaggagatggaggt

SEQ ID NO: 5872 - DNA, 201 bp, Homo sapiens
tgggtgcagcaaaccaacaggggacatgtatacctatgtaacaaacctgcacattgtgcacatgtaccctagaacttcgagtataataataataaaaaaaraatttagggagtgtaatggccttccttcattttatcttctctgttcccttctgtccaaattgccaatgtttatgctggtaggaaatttcaaaaaccttat

SEQ ID NO: 5873 - DNA, 201 bp, Homo sapiens
aaatcccatctcttctaaaaatacaaaaattagccgggcgtggtggtgcatgcctgtaatcctagctactcaggaacctgaggcaggagaatcgcttgaamccgggaggcagaggttgcagcgagctgagattgtgccactgcactccagcctgggcaacagaatgagcagaacaagacaccgtctcaaaaaaaaaaaaaa

SEQ ID NO: 5874 - DNA, 201 bp, Homo sapiens
acatagtgaaatcccatctcttctaaaaatacaaaaattagccgggcgtggtggtgcatgcctgtaatcctagctactcaggaacctgaggcaggagaatygcttgaacccgggaggcagaggttgcagcgagctgagattgtgccactgcactccagcctgggcaacagaatgagcagaacaagacaccgtctcaaaaaa

SEQ ID NO: 5875 - DNA, 201 bp, Homo sapiens
gagatgtgaaatagtctgggcttggtggctcgcgcctgtaatcccagcactttgggagactcaggcaggcagatcacttgaagtcaggaattcaaggccascctggccaacatagtgaaatcccatctcttctaaaaatacaaaaattagccgggcgtggtggtgcatgcctgtaatcctagctactcaggaacctgaggc

SEQ ID NO: 5876 - DNA, 201 bp, Homo sapiens
cctgacccaccatggatcttgtattctcttcactaatatccctctgcctagagtggcaaaacaggaagagtaattcgccattattattagcatgttattaytgttattattactactactgttattattttacttatgagcgcttatgatgtgtcaggcactgcactaagcattttaccaccattattctcctctaagctc

SEQ ID NO: 5877 - DNA, 201 bp, Homo sapiens
tcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctca

SEQ ID NO: 5878 - DNA, 201 bp, Homo sapiens
tactgaattttcattttgcttttcttaattataagaataatgcaaagtcccatcaacaacatttttgtgtgagttgatggatttctttatatatatatatwttttttttttgagataggatctcgctctgtcgcccaggctggaatgcagtggcacaatcagagctcactgcagcctcaaattcctaggctcaagtgatcc

SEQ ID NO: 5879 - DNA, 201 bp, Homo sapiens
cttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgat

SEQ ID NO: 5880 - DNA, 201 bp, Homo sapiens
agaggcatgcggctgtcagatgtctcccagaaagtttcactttgattagttagttcctgatgcttatttcctaaaaggctctttttgtcccccaccccccmaaaaaatggggagcattaaaattttaaaaaaggaattagatgaatatcctgctaaatgtaacttggcaagatgaaaggaagcagcaaagaaacatgaaaa

SEQ ID NO: 5881 - DNA, 201 bp, Homo sapiens
atgagctattttctcccaaatcctgtaattgcctggagcacgtgatctttttgaaggtcattagaggcatgcggctgtcagatgtctcccagaaagtttcrctttgattagttagttcctgatgcttatttcctaaaaggctctttttgtcccccaccccccaaaaaaatggggagcattaaaattttaaaaaaggaatta

SEQ ID NO: 5882 - DNA, 201 bp, Homo sapiens
aggttcggctattcagaatgagctattttctcccaaatcctgtaattgcctggagcacgtgatctttttgaaggtcattagaggcatgcggctgtcagatstctcccagaaagtttcactttgattagttagttcctgatgcttatttcctaaaaggctctttttgtcccccaccccccaaaaaaatggggagcattaaaa

SEQ ID NO: 5883 - DNA, 201 bp, Homo sapiens
attgctactgggttcctgaatactcttttcacaaaggcttcacgtcagatgaacttcaagcaccaagcagcagggatcccactgaagtttattcagcgccmttctgggcactaccagctgtgaaactggtaacctattgacaaataggttatttttccagctgcacccatattcaagagcttgaccaacaaagtcccctga

SEQ ID NO: 5884 - DNA, 201 bp, Homo sapiens
gattgctactgggttcctgaatactcttttcacaaaggcttcacgtcagatgaacttcaagcaccaagcagcagggatcccactgaagtttattcagcgcmcttctgggcactaccagctgtgaaactggtaacctattgacaaataggttatttttccagctgcacccatattcaagagcttgaccaacaaagtcccctg

SEQ ID NO: 5885 - DNA, 201 bp, Homo sapiens
aagattgctactgggttcctgaatactcttttcacaaaggcttcacgtcagatgaacttcaagcaccaagcagcagggatcccactgaagtttattcagcrcccttctgggcactaccagctgtgaaactggtaacctattgacaaataggttatttttccagctgcacccatattcaagagcttgaccaacaaagtcccc

SEQ ID NO: 5886 - DNA, 201 bp, Homo sapiens
ctcctgctcaaaatgtccatagtgccaaggttaaatcttgatattataacctaaggttcccatcccaacttgaccaattaatcattttataactttctccrttctcctatttaacctactgggctttaaagccagtggccctttttcttagcttcctcattcatgaaacagttttctggggaggccctagaattttacctc

SEQ ID NO: 5887 - DNA, 201 bp, Homo sapiens
agagtccagggatgttgctatatatcttacaatgcacagaacagcccctcccacagcaaagaattctcctgctcaaaatgtccatagtgccaaggttaaakcttgatattataacctaaggttcccatcccaacttgaccaattaatcattttataactttctccgttctcctatttaacctactgggctttaaagccagt

SEQ ID NO: 5888 - DNA, 201 bp, Homo sapiens
gtgaatagggctgcagaatacatatgtatgcatatatctttatataattatttatattcctttggggatatactccataatgagactgctgggttgattgrtaattctgttttaagttcttttaggaatcatcacactgctttccacaatggctgaacaaatttacattcaactgggggagatttttaccaccaggaaatg

SEQ ID NO: 5889 - DNA, 201 bp, Homo sapiens
catgtatttgctattgtgaatagggctgcagaatacatatgtatgcatatatctttatataattatttatattcctttggggatatactccataatgagaytgctgggttgattgataattctgttttaagttcttttaggaatcatcacactgctttccacaatggctgaacaaatttacattcaactgggggagatttt

SEQ ID NO: 5890 - DNA, 201 bp, Homo sapiens
cccccaggagctcttatctttagagacgcatattgaaaagtatagagatgaaatgataggatgttgggaatttgctccaaaataatctactgtgggtggcrataaaatgaattaagattgtccatgagttgataaatgctgaagctggatggtgagtataggagagttatctctgcttatgattagagttacctctatttt

SEQ ID NO: 5891 - DNA, 201 bp, Homo sapiens
ccccccaggaaatggtgctttcctggctctgcctctggctcttcccgggccgctgccccctcagccatgtggcacttctgagctcctgacctaggccaagrggaggtctctgcccccttccccggtcctgggctacccttgggtcctggctccttaggccattcccctgtccctggccccggggaggaggctgccctgctc

SEQ ID NO: 5892 - DNA, 201 bp, Homo sapiens
agcacaccagcatggcacatgtatacatatgtaactaacctgcacattgtgcacatgtaccctaaaacttaaagtataataataataaaattaaaaaaaawtttattttttttgtgggtacatagtaggtgtatatatttatggggtacatgagatgttttaatacaggcatgcaatgtgaaataatcacatcatggaaaa

SEQ ID NO: 5893 - DNA, 201 bp, Homo sapiens
tcaggaaacatcctttctgagaaaacatttaggctgagaagctaattaagaaataacagagaaaactaatgaaacccaaagctgattctctttaaaaaaamaaaaaaaaacaaaattgataaacctaggtagactgatcaagaagaaaagagactatcagaaataaagtctggtgcattactacagactttcagatattaa

SEQ ID NO: 5894 - DNA, 201 bp, Homo sapiens
ataacaagatatatccatgtaggaagatggatgaggaaagcagggtggatctgtctcccccaaaggaaaccacaaggcataaacagcagcagtccccagargacaatgtacacacaacctctttcctccaactctggtgttgaaactgccctgagctgactttaaatccactgcaggtagttgcatgaggagtacttacag

SEQ ID NO: 5895 - DNA, 201 bp, Homo sapiens
tatgcaaaggtatatgtatatgcacatacatgcatacatgtgtatagatatatgtacagtatagcctgccagctatgttaaaagaagttttttgcaaagcyaccttttgtgtatggaactgtgtgtgaaaaaagacttatagaactgtgagaaacttggataaaatgaggcatgcgtacttccccatctgaaatagccaag

SEQ ID NO: 5896 - DNA, 201 bp, Homo sapiens
cctcggtgacaaggcaagactctatctccaaaaataataattctaaataaagcaaaataaaatgtatgcataaacatatatatgcaaaggtatatgtatawgcacatacatgcatacatgtgtatagatatatgtacagtatagcctgccagctatgttaaaagaagttttttgcaaagccaccttttgtgtatggaactg

SEQ ID NO: 5897 - DNA, 201 bp, Homo sapiens
ggcttgaacccaggaggtgggggttgcagacagctaagatcgtgccactgcacgccagcctcggtgacaaggcaagactctatctccaaaaataataattytaaataaagcaaaataaaatgtatgcataaacatatatatgcaaaggtatatgtatatgcacatacatgcatacatgtgtatagatatatgtacagtata

SEQ ID NO: 5898 - DNA, 201 bp, Homo sapiens
gtcctgattccctaggcaaaaagtgcaaagcataccgaaaaataaatatccagccttaaaaaatcagtacaacaatcccttggctcccatcaacatcgtaraccccactgtgtgcaggggccgcagtcgacggcagggtatgaggagaaacaggacaggtttccatgtcccttgtgagcgcagagtgtaggaggaagattg

SEQ ID NO: 5899 - DNA, 201 bp, Homo sapiens
tttcccaggtacttatgccctctcaataaacttcttgtgcccctaactccatctcagcatctgtttcctggaagatccaactggctcaccttggagagaamagaaactaaaagccacaacatgaagcgtatacaagaaccaggtaagttaagtaactcagagctatctcttgtcccaaaggatgaaaacctccgagcgccg

SEQ ID NO: 5900 - DNA, 201 bp, Homo sapiens
gaataaaagactacaaattggattaaatgtatactgctcgggtgatgggtgcaccaaaatctcagaaatcatcactgaactactcatgtaaccaaataccwactgtcccccctccccccccaaaaaaaaacctatggaaattttagaaaaggaaaaataaataaataaaactagtattgatttgggttatttcagtttgtg

SEQ ID NO: 5901 - DNA, 201 bp, Homo sapiens
caggtaactaatagtgttcttctttttcaattttttttaaattgtggtaaaacacacacacacacacacacacacacacacacacacacacacacacacamtttactctcttggccggtcagcatagacttccagccccacatcacctttcccaaatgtcttccaaggggcaaagtccagacacaacagtgaaagtgtgga

SEQ ID NO: 5902 - DNA, 201 bp, Homo sapiens
ttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgt

SEQ ID NO: 5903 - DNA, 201 bp, Homo sapiens
cttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcg

SEQ ID NO: 5904 - DNA, 201 bp, Homo sapiens
tcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagc

SEQ ID NO: 5905 - DNA, 201 bp, Homo sapiens
ttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaag

SEQ ID NO: 5906 - DNA, 201 bp, Homo sapiens
ctagggtgccacagtgacactgccatcagcttctgggccacaggaatgctcaacagatgtggataatgagtatggaggagcaatgatgccaaaaataattrttccttgggccttctagatcttctcacttcccctgaggagagattgtgcattctgcctacccaggaggacaggcaagattgcaaacacataagatgtttg

SEQ ID NO: 5907 - DNA, 201 bp, Homo sapiens
actagcaccagacattctcccacatgggcttcctttaataataataaaatagaaaaatcttcaaaacctaactggcccattttcttttcctgtcattctcttttttaaaattaaaagccaacatgggtacccagggctgacttgatcacagcatgattaaatgcacttcctctagaagttagggaaaagaggactcagtga

SEQ ID NO: 5908 - DNA, 201 bp, Homo sapiens
aactagcaccagacattctcccacatgggcttcctttaataataataaaatagaaaaatcttcaaaacctaactggcccattttcttttcctgtcattctcttttttaaaattaaaagccaacatgggtacccagggctgacttgatcacagcatgattaaatgcacttcctctagaagttagggaaaagaggactcagtg

SEQ ID NO: 5909 - DNA, 201 bp, Homo sapiens
tacctagatttggagcctccaaaacattgtatggccacactccatctctgcctacgatggaattatgagagagctttggaaaatggctgttccaaaagtgrtagtcttaacacaaagatcaggaagaatatttgatttggattaccacccacagcaggcagaattctaagatgttcccaaagtgatagtcttaatccacag

SEQ ID NO: 5910 - DNA, 201 bp, Homo sapiens
cccaccgccacgtctggctagtttttgtattgttagtagagatggggtttcaccatgttggccaagctggtctcaaactcctgacctcaaatgattcactygccttggcctaccaaaatgctgggattacaggtgtgagccaccgtgcccagtcaagatcccgtaattcttgagcattcctgaaacctagggaaagatgga

SEQ ID NO: 5911 - DNA, 201 bp, Homo sapiens
aatgtgacaaaaatattaacatttgttaaatctgaattgtcagtacatggttgtttgttattttattctctgtacttatcagcatgtctgaaatattccascattgataaatcctggttttgaaagagaaaaagaaaagatttaaacacaataataggatgacttctctgagactccttagttcactgcagatatccagat

SEQ ID NO: 5912 - DNA, 201 bp, Homo sapiens
ttgcagtgagctgagatcacgccattgcactccagcccaggcaacagagcgagactctatctcaaaaaaaaaaaaaaaaaaaaaaaaaaaaaaaaaaaaargaaaaaagaaagaaagaaagaaaaaagaaaaaaaaaacagtagttggaaaaatatagtactgtttataaaaagcataaaacatactaataccattatacc

SEQ ID NO: 5913 - DNA, 201 bp, Homo sapiens
ccaatctaatacatccataaatggatatatttgaatatggagtgacaataagaagttaaaatttaattttaaaaaaccgaacagaataaagaaacaaagcyaaaaaaaggaaaatatcctacgtggataaagcagaaaccaaaagtaaaccaagcgaaaaaaaagaagccaaataaaactataagctgatcttcagaggaa

SEQ ID NO: 5914 - DNA, 201 bp, Homo sapiens
atgtgccactttaagctaagaagttcatggtaatttgttatggcagcaataggaaagtaagagacccattattcagatgatgaagctaagactcgagagcrtgtcccaggccccccatgtagttaggtggtaggatgatgtagatgtaagtgcagtcagcttaactccacactcttcctcttgtcctctgtacaaagtcaa

SEQ ID NO: 5915 - DNA, 201 bp, Homo sapiens
agtgcctcactctgtagcccaggcaggaatacggtggcgcaatctcggctcactgcaacctctgcctcccaggtcccggttcaagcaattctcccgcctcmgtctcgccaccatgcccagctaatttttgtatttttagtaaatacggggtttcacaatgttggccaggctggtcttgaagtcctgacctcgtgatccacc

SEQ ID NO: 5916 - DNA, 201 bp, Homo sapiens
tatatatatacacacacacatatatatatacacatacgtgtgtgtgtgtgtgtgtatatatatatatatatagagagagagagagagagagagagagagasagagacagagacagagacagagagtgcctcactctgtagcccaggcaggaatacggtggcgcaatctcggctcactgcaacctctgcctcccaggtcccg

SEQ ID NO: 5917 - DNA, 201 bp, Homo sapiens
gtatatatatacacacacacatatatatatacacatacgtgtgtgtgtgtgtgtgtatatatatatatatatagagagagagagagagagagagagagagrcagagacagagacagagacagagagtgcctcactctgtagcccaggcaggaatacggtggcgcaatctcggctcactgcaacctctgcctcccaggtccc

SEQ ID NO: 5918 - DNA, 201 bp, Homo sapiens
tatatgtatatatatacacacacacatatatatatacacatacgtgtgtgtgtgtgtgtgtatatatatatatatatagagagagagagagagagagagasagagacagagacagagacagagacagagagtgcctcactctgtagcccaggcaggaatacggtggcgcaatctcggctcactgcaacctctgcctcccag

SEQ ID NO: 5919 - DNA, 201 bp, Homo sapiens
atgtgtgtatatatacacacatatatatgtatatatatacacacacacatatatatatacacatacgtgtgtgtgtgtgtgtgtatatatatatatatatwgagagagagagagagagagagagagagacagagacagagacagagacagagagtgcctcactctgtagcccaggcaggaatacggtggcgcaatctcggc

SEQ ID NO: 5920 - DNA, 201 bp, Homo sapiens
acacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagagagagacagagacagagacagagacagagagtgcct

SEQ ID NO: 5921 - DNA, 201 bp, Homo sapiens
cacacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagagagagacagagacagagacagagacagagagtgcc

SEQ ID NO: 5922 - DNA, 201 bp, Homo sapiens
aattcccaagcatggagtcaatttaatacatttcgagagtttactctacaaaagccaacatctttccagacttggggcaggaggttctctctacccaggasataaatccaaagactgtacagctaatacttggacgtgtctagcatcatgctcagtggtttacctgaatcatctctaattctcacagcaaccattttgcag

SEQ ID NO: 5923 - DNA, 201 bp, Homo sapiens
ttcccaagcatggagtcaatttaatacatttcgagagtttactctacaaaagccaacatctttccagacttggggcaggaggttctctctacccaggagakaaatccaaagactgtacagctaatacttggacgtgtctagcatcatgctcagtggtttacctgaatcatctctaattctcacagcaaccattttgcagac

SEQ ID NO: 5924 - DNA, 201 bp, Homo sapiens
gaaatctgcagcttgtaaaaaataagcccaagatgcaaaccctggtttttctgcctccaaagcccatatggcttccacaacaccaacctaccacttagacrcaatagaagaataccagatctcaagagaagtaggagcctgcatcactacagttgatgtcaggggcaggaatcaagagtgaagaaaaggagatgtcaagat

SEQ ID NO: 5925 - DNA, 201 bp, Homo sapiens
tctgcagcttgtaaaaaataagcccaagatgcaaaccctggtttttctgcctccaaagcccatatggcttccacaacaccaacctaccacttagacgcaayagaagaataccagatctcaagagaagtaggagcctgcatcactacagttgatgtcaggggcaggaatcaagagtgaagaaaaggagatgtcaagatgtct

SEQ ID NO: 5926 - DNA, 201 bp, Homo sapiens
tttttcttagtcctccagagttttcaagagaaccttattccacagacaggaaaaataactaatgggtactaggcttaatacctgggtgctgaaataatctktactacaaacccttgggatatcagtttacctgtataacaaacttgcacatgaaccctcgaacttaatataaaagttttaaaaggataacatttggaacct

SEQ ID NO: 5927 - DNA, 201 bp, Homo sapiens
tggttggtgagacagacaaatagattttatgatttcagaacaatgtagtaaatgttaaagtattacagaatgctatggaataatggagagatgagaggctyattcaccctgggaaataaaggaagcctttctggagaagacaaagagttgtgtagatagtcatttgagaggcaagactggggggaaggggagaggctagaa

SEQ ID NO: 5928 - DNA, 201 bp, Homo sapiens
ggtgctaactgatccatcagatgaagggtctgcaaaatatctcaagtaccgatcttaggttttacaatagtgatgttatccccaggagcaatttggggagstttagagtcttgcagccttcaactgcatgactcctaaaccataatttctcatcctctggctttaggcaatccccaggcaggaagggtgtttgttttggga

SEQ ID NO: 5929 - DNA, 201 bp, Homo sapiens
ggcattgacaataattgcctggatccattagttcattaacgtttgcaatgtagggatattccaattctactattccttcttcatttattacccggaactaygccaaaaagagaaatcttcctttgtcagctatttggcctgaggaagaactgatacaagaagggcagaatacagtaaacgcatgcttcttcccccatgtat

SEQ ID NO: 5930 - DNA, 201 bp, Homo sapiens
gcgctattcacatacacgctgggaggaagctgcccccgcaccgctctttctcccttctcctcctgctcccacacgccattgcttgacaccacaggtcaccrctttatttgtaataccaacctcgaggaaaacacctcgtgtgaaaagctaagtgccaaatccaggcttgtctgtgttgaccagacccactcacctctcctc

SEQ ID NO: 5931 - DNA, 201 bp, Homo sapiens
gcatggtggcacacacctgtaatcccagctactctggaggctgaggcaggagaatcacttgatcctaggaggtagaggttgcagtgggccgagatcgcgcygttgcactccagcctgggtgaatgagccagactctgtctcaaaaagaaaaacttcctggcatggagtgagggctacctaaacaactgagaccaggaggca

SEQ ID NO: 5932 - DNA, 201 bp, Homo sapiens
acaagaaccaggtctgcttttctctcacttcctcccaccccaaaacaatgcagaacttgaaatcaggtgctttcagattcaggtgaacgaacctcaggaasaactgcacttccagtcccctctctttctcaatcacagaaacgatcaagttctctcctattccacctgcctgttctcaagtggaccctcccgtggagatgg

SEQ ID NO: 5933 - DNA, 201 bp, Homo sapiens
aggagaagaaatggcaccaatattggaaccatgaagtcctgggtttaaattgtggctctattatctactacctgggtgcatctatcaggtaggattcaccyggttgcaagtgacagaaaattcaaaccatcttaaacaatagagatacataagcttctgtgactggaatgaccagtggcaaagatggcttcaggagttttc

SEQ ID NO: 5934 - DNA, 201 bp, Homo sapiens
agcccctccctagcctttctactgcgggcgctgttgccaagtcctaggtgcacgtgggcagtgggccgcacacgctcataggcacgcgcgcttttctgcgyacttcctcagactgctgtagcggtgcccacggccagccggagtcctcacatgtcctcaggtggtgcacacgcatgaactgcggcaggtgcacagccctgc

SEQ ID NO: 5935 - DNA, 201 bp, Homo sapiens
ccaacgaggggagggagggttgaggggaaggctgcagtctgcagtgctcacaagcccccctatgcgcccaggggggctagacaagaggggggaagctgaakcccgatgcccacgacgcccccagtgcggatcctcagcccctgtggctgatagcgggagctccactccagggtgcacaggagaatgggagccccaggttgg

SEQ ID NO: 5936 - DNA, 201 bp, Homo sapiens
gccggagtcctcacatgtcctcaggtggtgcacacgcatgaactgcggcaggtgcacagccctgcgtacctgcaaataccagcacggtcgtgcacgcgtgycctgacgcgcgcctctcgggacggacgctgctggagccgggggaagttgaggcgaactccaagaggcctcgacgttcctgggtaagcgccgcggagcgcg

SEQ ID NO: 5937 - DNA, 201 bp, Homo sapiens
gctctgcagcagggctctaacggggcggaggagagaaggagaggcagggtcagcccaccaacgaggggagggagggttgaggggaaggctgcagtctgcaktgctcacaagcccccctatgcgcccaggggggctagacaagaggggggaagctgaagcccgatgcccacgacgcccccagtgcggatcctcagcccctgt

SEQ ID NO: 5938 - DNA, 201 bp, Homo sapiens
gcgaccgggagctgctgagcgagggaggtagggagagaaagaggaggtaacgagggtgggggggcgctggctgagtttgtgacgagccagcagtaggagakggggagggaaggacgcgggctcccgcggtcccggttccccgagggaggtggatctttcccacgcagcgaccctcttgtgatcctgccgcttcctccctct

SEQ ID NO: 5939 - DNA, 201 bp, Homo sapiens
ctccagagttgaggcccttaatcacagttctacactgctcattatctgaggaataaagcgtggattaaatcagtgaacatcaggcaaaaccatgcaaaatkgggataggagtgatcattctaaatctcaacagctgaaccataatgatgggccacaaggaacaatgacacttctcagaaacctaaaatttaacttaaatgt

SEQ ID NO: 5940 - DNA, 201 bp, Homo sapiens
caaatactttactacgttaaatgacacattggaaattttcaagacaatttcttaagcaagtaatacgggttccatccggctccatcatttgccattcactygacaaatgtcataacgccactgcacaccccaccagagcaaatattttcttccaaccttaaaataacatctacaaattaattcagtctgtcaaggggaact

SEQ ID NO: 5941 - DNA, 201 bp, Homo sapiens
aatgtgtgttctgttgttgggtggagtgttccacaagcaaatattaggtcaacttggttgtgacattgttaaaatcatctgtatctttactaactttgctygttctagcaattattaagagtattgaaatctcctactataattatgaatttatttccccttgcagttgcatcagttttgcttcattattttgaagctata

SEQ ID NO: 5942 - DNA, 201 bp, Homo sapiens
tgtgaaaagctatacgggtcaagagacttctggttgttcatcaatatcctcttttcttctgccttagtaacagaaattctatttttagaggggcacagaamctccaataataaagcttacatttctagcttccctagtagctaggcatgaccctatgacaattttctggataataggaagacagaaggtatgatatgcata

SEQ ID NO: 5943 - DNA, 201 bp, Homo sapiens
gacttgtacctgggccacacggcgtgcctcaggctcagcgtatggttctcccacttgcccacctgcagcacaaacacaaagacacagctgtgctttcttcygccgctgatttctggagaggcaaatcctttccctgccagagacatccatccgtctcaagggcctttctgccacatatctcaacatatgcatctacttctg

SEQ ID NO: 5944 - DNA, 201 bp, Homo sapiens
cacaggctacccgtgttgccttgagaaactggctcaaccccttaagcctccgtgtcctaggctgtaaaacaggaaaagcaatttccaccaacttcatagaycagatgagctcatgtacagtagctgtttactgattatttattgcattccgatcatttcttccacattatctcattcagtctttaacgaaaccccatgaag

SEQ ID NO: 5945 - DNA, 201 bp, Homo sapiens
acttagaagtaagagccaaagcctacccggaacctcccagtctcacaccaccttttccaattcagcttttcccagatttctccattgggttgtgccaaacsctcatggatccagaaatttcactttcagtatggttactgtttccagtctatcactcctttagaaaaactcaagaaggaagaagggatccgtggtaatatt

SEQ ID NO: 5946 - DNA, 201 bp, Homo sapiens
atgtctccaagaccaactctgaaagtcccaacaacaatcaggagtatcgaatcccctcctccatttttgaaccaatggaccctttcattcttcttctctcmaacccctcttaagtctctattctttatttctctggaaatgtcttttctcatcttcctcttgccctttcctgattccttttctcttcttactcttaagtga

SEQ ID NO: 5947 - DNA, 201 bp, Homo sapiens
tggcacgtatcaccaacgtttttccctaccatttgttggtttctgttaattttctttatgttattgctggaactccctgaaacgaccacaaagcaaccatytgattctgccaaaaatattgtctttgaaatatggtttctagaacgtctgtgagtcacctgctcacatgtccaagatgtctcagaaatccttctgctttta

SEQ ID NO: 5948 - DNA, 201 bp, Homo sapiens
gcaaacaggagaagaagccaacataactggcaacttagccttgataactctttgtttatccgggcaagcggaaaagggcaggattccttggtgcttgggtrgagagcttttccatagcctcagatacagacaggggcactgaaattatggggtacaagaggtttttccaggtggtccaggtgagacggagctgggagatgg

SEQ ID NO: 5949 - DNA, 201 bp, Homo sapiens
tagaaagccagaatagtctccagagacagatgaagtgaaattgcaagcttctgactctcacaactcaacccatcagcttaggttgttaaaaaagcgaggtmttgcagtgcactatattgtcatagtctgagaagggccgtgtgcgtgcccttgtgtgttccaaaacctaggccacgatgtatagggaaaaaagagcacagg

SEQ ID NO: 5950 - DNA, 201 bp, Homo sapiens
cattttggtgtcttggagactgcatcctaccatgatctcatctatgaagcaacaggaaaggaatggagtctccagtgagattggatcagcagtttcattasaggggctggcagagaacacttttgctcttcctcctggtccctaagccttcctgaaacccagggactggaaagggatcctaaccaaatctgcagctattgg

SEQ ID NO: 5951 - DNA, 201 bp, Homo sapiens
tatcattttggtgtcttggagactgcatcctaccatgatctcatctatgaagcaacaggaaaggaatggagtctccagtgagattggatcagcagtttcaytagaggggctggcagagaacacttttgctcttcctcctggtccctaagccttcctgaaacccagggactggaaagggatcctaaccaaatctgcagctat

SEQ ID NO: 5952 - DNA, 201 bp, Homo sapiens
tggcacacatggaaggagagtgctggcccctggctgcgtcctcacctctgtgctcagggctgtgagtgaggatggcagacacaacaatctatacccacccyagacctgcggcatctcttaatctgtgctccacaagatcagcgtctgatcctggggccgcgggctgtctggggaacatgcagttctttagtgtctggatat

SEQ ID NO: 5953 - DNA, 201 bp, Homo sapiens
gactctgccaggccctgggcttttgcagaaagcgaaggtggaagggagatggttattagccactgtctctgcaaacgacaagccatctgcaccccgttacytaagcatagacctctgtgggtgccaaacttcagagcccagaaagttggaagggattccgagcttggatccctcaggctaggctattcttggaagccgagc

SEQ ID NO: 5954 - DNA, 201 bp, Homo sapiens
tatatattataatgtaataatagaaataaagtacacaataaatggaatgcacttgaatcattccaaaaccatcagcccaaccccggtctgtggaaaaactktcttccacgaaactggtccctggtgccaaaaagattgaggaccactgctgtagagacagtgaatcataatctgagagtttacagaggagcacagccctgc

SEQ ID NO: 5955 - DNA, 201 bp, Homo sapiens
gtgaggtgatgacgccaaggatcaagctgatggtggctccagcaggcatgacattgaaacaggcaaatgagatccttcagcctagcaagggaagctgcctrtggtcaatgatcgccatgagctagtggccatcgtctcccacaccaacctgaagaagaatcgagactacattctggcctccaaggattcccacaagcagct

SEQ ID NO: 5956 - DNA, 201 bp, Homo sapiens
agtgatggaaatgaaaaggaaatgagcacatttctcaggagagctattttctatcacatggaaaactgggcagtgtggatttactctttgtgtttggccargacttaaccaaatgaagcagatcctcaggaagctgactgtggggatttggacaatggtacaccagacaccagcagatctgccagttcatttacccaactt

SEQ ID NO: 5957 - DNA, 201 bp, Homo sapiens
gaaggaggggtccaaaccagtctattcactcccagtcataatgaaacttccccaaacacataaatcacccaaggtcccagtcatctaataacacctctgayctcccagtgtatgctatgcttataatgtttgtgattcttgcacttacattttccaaagccctcatcccctttcctttgagtgggtccccctatatcctca

SEQ ID NO: 5958 - DNA, 201 bp, Homo sapiens
gtttatttttgaacattctgtagtgaggcaagggaagaagaaatccatcacatggaatatcaccctccatgttatcatcttacatctttggcacaaactcwcggaagtaaaggtaatagtgtgaaatacctcctttctcacttaaaaatggaatgaatgatctagatcttcaacaataggctcatttttccaatttccaat

SEQ ID NO: 5959 - DNA, 201 bp, Homo sapiens
tcttcccagtcttcctgccagaagattccagtgtccacatgatttctctccacttctttggagggtcccttccactgatagcttaaagtgtcagcaagagyttcctttcactgaaccacagttatttccttgaagcttcaacccactagctctagttctctactgtaagcaaaggagactaattctactacaatttccgga

SEQ ID NO: 5960 - DNA, 201 bp, Homo sapiens
ctcctccagggtgacgatgctgagatggttgtcatccggctcacagtcggagaaggacttgtacctgggccacacggcgtgcctcaggctcagcgtatggktctcccacttgcccacctgcagcacaaacacaaagacacagctgtgctttcttccgccgctgatttctggagaggcaaatcctttccctgccagagacat

SEQ ID NO: 5961 - DNA, 201 bp, Homo sapiens
aaaatggcacttactttatattcatagaatttctggggcagttcttctcaaactttaacatgcacgtgaatcgccgagggatcttgttaagaggcagattstagctcggtcagtctggatgggacctgagattctacattcaggctcccagaggatgtcaaagctgctggtgcatggaccacactttgaatgatgagatct

SEQ ID NO: 5962 - DNA, 201 bp, Homo sapiens
atcattttggtgtcttggagactgcatcctaccatgatctcatctatgaagcaacaggaaaggaatggagtctccagtgagattggatcagcagtttcatyagaggggctggcagagaacacttttgctcttcctcctggtccctaagccttcctgaaacccagggactggaaagggatcctaaccaaatctgcagctatt

SEQ ID NO: 5963 - DNA, 201 bp, Homo sapiens
acagaagagacagaaacatgtaaatgaacacatacaagttaaagttgtggtacagctaatgacatgagggctcctatggaaaaggttagcaggactgtcasgaagccctctcaaaggaaatgccccaaaagccaagttgtgaagaagtcatcgtcaaccagtgcagaatagtgggaagagcattccaggcatagggaacca

SEQ ID NO: 5964 - DNA, 201 bp, Homo sapiens
gtgctggtggcattcagcatccaagaacacttagagccaagtttgtgctgtctttttaacacgactaataccatcagtggaattaatagaaaaatgaaagycggcactctaattccagtaatgaaatcacaggcgcacagctcccacctttaggagcctcacaaatgatgcatgtcctctgaagccattcagctggcgtca

SEQ ID NO: 5965 - DNA, 201 bp, Homo sapiens
ggtatatacctggaaacgggattgctgggttgaatatttctgtctttaggtcttcgagaaattgccacattgtcttccacaacagctgcactaatctacaytcccaccaacagtgtataagcctcgatcagaatcacccaaaaggcttgttaaaacacagactgacaatccctgcccctcactttctgattcagtaggatg

SEQ ID NO: 5966 - DNA, 201 bp, Homo sapiens
gtacagctaatgacatgagggctcctatggaaaaggttagcaggactgtcacgaagccctctcaaaggaaatgccccaaaagccaagttgtgaagaagtcrtcgtcaaccagtgcagaatagtgggaagagcattccaggcatagggaaccatgaggacaaagcccctagggttggaaagaacaaggaggaaaatgacagc

SEQ ID NO: 5967 - DNA, 201 bp, Homo sapiens
tagtttgcaagatactgaagtcgcacgttgtttctaagaacactgatgctctaaatctccagcttttgacttcaggaaaatggcacttactttatattcayagaatttctggggcagttcttctcaaactttaacatgcacgtgaatcgccgagggatcttgttaagaggcagattctagctcggtcagtctggatgggac

SEQ ID NO: 5968 - DNA, 201 bp, Homo sapiens
tcacacatcaatcatttgcagacattcctgagcatctactatatcccagactccagaacagatcctgcaaatacagagaggacagaagcccctgtactcasgagctcatagccaggtcctggaaggatgtctgtaattattgcttgcttatcatctattcttctcattttcctctagttcgtcctgccccttcctcctttg

SEQ ID NO: 5969 - DNA, 201 bp, Homo sapiens
aaagtgtcttctgtaaaatcaggaatattaaacatgaagaaaatgtccccctttcctgtacttttttttgcctgaaactctatgtacagaaacggttgggkgtaaggtcatgaacataccttcccttgcaagcagcccctggtaccacgcccagcccatgagcaacaatatcctaactgcaccagctctttgcctgagatt

SEQ ID NO: 5970 - DNA, 201 bp, Homo sapiens
ggagtggccctctttctgtccccactgaatccatttatctatggaaaattgggagagagagtctacaagaagagcactatacctccccaccccaattgcayacacttttttttttttcttttcagacagagtttcgctcttgttgcccaggctggagtgcaatggcacaatcttggctcaccgcaacctccgccttccagg

SEQ ID NO: 5971 - DNA, 201 bp, Homo sapiens
gtctcacagctaataagtggcagaaaaagctgaaatttgattccaaagcctgtggatgtactgcagtatctccctatccacagggaatatgttccaagatscccagtggatgcctgaaactgcagatagtacagaactgtgtatgtatcatgtttcttcttacacagacatacatacctatgataaagttcatgaattagg

SEQ ID NO: 5972 - DNA, 201 bp, Homo sapiens
tggaaagacatggttgtgtggttggatgtgtgtatttactgtttaaggaccaagtttacaccagtactcgtgcgttctgctccacaatttcaacacgtccwccctctcactccccgcctagagattgctccttctgcactctcttaatgagactgtcgttgtacatttttaaaaattttattctcaaaagccccagggagt

SEQ ID NO: 5973 - DNA, 201 bp, Homo sapiens
tgttatgaggattcaagattttgtatatgagtctaaaacactatataacattattgtaataattattaattatgtctaattaggagggtaataaagcaaartgatcccatgaccccacagatcctcccaacagtcaaaagcttcatgacatgagtccttggaaaaaaagaagagaaagttgcattaaacatcacccaactt

SEQ ID NO: 5974 - DNA, 201 bp, Homo sapiens
ttaacctctcatgactaaggatcacctaaccactttgaaccagctggcacaagagccagtggaaccagctcacataatgagcttctaatccaaatgagcasaaaaaaatgtatgtaacgtggcgtgcatttccaagttcactcaatcacctgtgcctatgctgccaaattattcaagatctccaagtggcagatgtgcgtg

SEQ ID NO: 5975 - DNA, 201 bp, Homo sapiens
ctgggtagtatttataacactgttaaaatagcaccaaatgcgtcaccattaacctctcatgactaaggatcacctaaccactttgaaccagctggcacaasagccagtggaaccagctcacataatgagcttctaatccaaatgagcagaaaaaaatgtatgtaacgtggcgtgcatttccaagttcactcaatcacctgt

SEQ ID NO: 5976 - DNA, 201 bp, Homo sapiens
aatctggaaatgctgggtagtatttataacactgttaaaatagcaccaaatgcgtcaccattaacctctcatgactaaggatcacctaaccactttgaacyagctggcacaagagccagtggaaccagctcacataatgagcttctaatccaaatgagcagaaaaaaatgtatgtaacgtggcgtgcatttccaagttcac

SEQ ID NO: 5977 - DNA, 201 bp, Homo sapiens
ctcaggctgctcttggaacctggggtgaggaatctggaaatgctgggtagtatttataacactgttaaaatagcaccaaatgcgtcaccattaacctctcrtgactaaggatcacctaaccactttgaaccagctggcacaagagccagtggaaccagctcacataatgagcttctaatccaaatgagcagaaaaaaatgt

SEQ ID NO: 5978 - DNA, 201 bp, Homo sapiens
gctatgtctaaaacttgaggtaggttaggacaaagcttttttctgtaaatatgactctcctcctcccaactccacagagcatacctgaaactttgacccarctggccaaagatttcaactagaagcagggtgtatagagtagggtctaagatgcatgtcctaattctactttattgggagttattggaattctgaatgacc

SEQ ID NO: 5979 - DNA, 201 bp, Homo sapiens
gatgaagcttctatggtgcaaagcctgtaatccatgtgccaccctgggcatccaactctattcagggagcacacctgagtcaagggtgactccttaaggasaggaccctatatgctgtcttttgtaatacaaccgctatgtctaaaacttgaggtaggttaggacaaagcttttttctgtaaatatgactctcctcctccc

SEQ ID NO: 5980 - DNA, 201 bp, Homo sapiens
cctcagttctcagagtatttgtttccttttctgtaaaagtgaggtcataacagccatgtcactgggtaattatagggatcacactaaatgacgtctaatgrgatacacaacgtgataaaggccagcagagtgcttggcacattatgggtgtctgctaaactatggtaggggtagcagtagttgtcatggttttatataatt

SEQ ID NO: 5981 - DNA, 201 bp, Homo sapiens
atagcctgagttagaattcaattttgtggctttcaacctcaggtaagtatcctcagttctcagagtatttgtttccttttctgtaaaagtgaggtcataayagccatgtcactgggtaattatagggatcacactaaatgacgtctaatgagatacacaacgtgataaaggccagcagagtgcttggcacattatgggtgt

SEQ ID NO: 5982 - DNA, 201 bp, Homo sapiens
agaggcaatattgcaagaattggatagcctgagttagaattcaattttgtggctttcaacctcaggtaagtatcctcagttctcagagtatttgtttcctyttctgtaaaagtgaggtcataacagccatgtcactgggtaattatagggatcacactaaatgacgtctaatgagatacacaacgtgataaaggccagcag

SEQ ID NO: 5983 - DNA, 201 bp, Homo sapiens
ttgattccagtacaacaactgccaagaggcaatattgcaagaattggatagcctgagttagaattcaattttgtggctttcaacctcaggtaagtatcctyagttctcagagtatttgtttccttttctgtaaaagtgaggtcataacagccatgtcactgggtaattatagggatcacactaaatgacgtctaatgagat

SEQ ID NO: 5984 - DNA, 201 bp, Homo sapiens
gcataggtctctaggatcctgcacactaaatatttgattccagtacaacaactgccaagaggcaatattgcaagaattggatagcctgagttagaattcarttttgtggctttcaacctcaggtaagtatcctcagttctcagagtatttgtttccttttctgtaaaagtgaggtcataacagccatgtcactgggtaatt

SEQ ID NO: 5985 - DNA, 201 bp, Homo sapiens
atggggaaaagagtctttccattcattctccaaatccttattgagcctctgctattgaataccagagatataatggtaaaggagagactgaaaacacaccrtgagctctcagtgctagccgtggccagaattcatggctttaccaatgggctgctattgtctttctaagcaaagagagttgtaatatgtttctccctgccg

SEQ ID NO: 5986 - DNA, 201 bp, Homo sapiens
tacaaaacatacaaaaaaattaggcaggtgtggtggcacacacctgtagtcccagctacttgaggggcagaggctggataattgctcaagcccaggaggtmgaggcctgcagtgagccactccagggagtgcagcggcatgaacatggctcgctgtggccttgacctatgggctcaagcaattatctggcctcagtcccca

SEQ ID NO: 5987 - DNA, 201 bp, Homo sapiens
gtttttataattaaagcactgacagccttcactactgatatatgaacgccacccatctctaccataaggtactgtagaaacaaaatggactttgcagtctrgcagacctgagctagaatctagactttgccatatacttgctttgtaaccttaggcaaatcagcaatcatcttagagcctcagtttcttcatatgtaactg

SEQ ID NO: 5988 - DNA, 201 bp, Homo sapiens
attcatgacagcctcattttgacaaccaactcctggttccagccctgccccacatcaactcatgaatcacacagaactaatcacaggcttctgagtacatygagcttttctctcagtgccaggtttcaacacgctactcaccctgcccagaaaaccccttcccactctctgcctggcactctcctatgtgtccttcagaac

SEQ ID NO: 5989 - DNA, 201 bp, Homo sapiens
ataccatgggacaagactgaagaagcccttggatattgggctacaatccctttgtgcacattggaatttggttgcatttaagttgaaattggcaattggcyttgggaaatccctctgactcaacacctggggataatattggtgatttcatccacatatggctaggacttagtactccttacatattttgaaattgtccta

SEQ ID NO: 5990 - DNA, 201 bp, Homo sapiens
ctgaggaccttgaattccaccacagaaaatacctctaacagcagagctgcactgagctctactttgcaggcttgatgttgaattccactgctaccaacacrgacatccaaaaggcgatcagaacagcagatcaggcagagaaaatcaactgttcaaatgtgaaccatgtgtcaattaggtaatttgggggtttcaaccaag

SEQ ID NO: 5991 - DNA, 201 bp, Homo sapiens
aatcagctattagagccttaattaaattcctctcagttgaaatttcagaattgcctaattgttacacagctcacattggagaagtagattttttttcctcycgtaataactgctctcaagataatctagtatctttatggataacagcatcaactgtcttagaacccagtactgatctggtaattcatagaaacgtgtttt

SEQ ID NO: 5992 - DNA, 201 bp, Homo sapiens
atgcagactcctgtatctctggagtgttggaatcagtagatctgggataaggtgtgggatcctgacttttcaaccagcgtcctagagtcattctgctccgwgtggtctaaggaccccattttaaggagcaccaggaggggaagacctatgactaacatacaggattaaataaagcataagaacaagatggaaatctttctt

SEQ ID NO: 5993 - DNA, 201 bp, Homo sapiens
tgcctgtttactcatcttctctccttggagacaagacaatagaaattgcaaaactaaaaatcagacaggaaatttattaaaaccaacaacagaagcagagytcaggctgcctgtgctctagtctggctggacccagttagctcattgggtggtttcataaccatggggaaacaggctttaaaacaaacacattgagcttgc

SEQ ID NO: 5994 - DNA, 201 bp, Homo sapiens
tcaagttcaatggccagaatggaaaaagatttatagaagtcaccatggatatatgtccatatataacctgcctgaagatggaagcttctttgcctactccmatttttttttaattatggaaatgttcaaatgtatttaagagtagaatcatataatgaacctccgtattcccaatgtccagcttcaataattagtactcat

SEQ ID NO: 5995 - DNA, 201 bp, Homo sapiens
gtttgttcacaatcattagctgtactcttctcctatttttcagatgagtaaactgaagttgaaaaggggaagtggctttcccaaggacacactgtgagtasatgacagcaaaagcagaaagtgtccttaattatagcagttatcatgacaagaactaacacttattgagtaattactatttgctaagcactatcctaaagg

SEQ ID NO: 5996 - DNA, 201 bp, Homo sapiens
aaggactctgctgcagtagtcttgttttagtaaattaagtacctatcagtgccctgaagggttgctattctaagataccacacacgtgaatgcacacacaygctccagaacaaagaaacatcgttaaagcaacatctatagtgtctaaggagtgacccagaaatagtttagataactctctattacatcttctaatggctt

SEQ ID NO: 5997 - DNA, 201 bp, Homo sapiens
aaggtggggtttctgtgctagcaccagaagacacaaactggaggcagcaatcccactgcagttgatgtgacagaagcccctggagaagagttcaccaaaaygtgaaaggggagtccagcagctgcgtgctaagggggtgtggctctcagctcaattctagcctgaccttcttatagatggctgagagaaccctagaggcta

SEQ ID NO: 5998 - DNA, 201 bp, Homo sapiens
tcattccaaaccagaatgagcactgtgggaatgagtttttcagaaatcatagacttaacttctgaataaatgctctcccagcccctgctgagatgccaaasacattccaaaggcacagactgaaaggacagaatgctcacagccaaaactaccgggatttctatgcagaaatctgggctttgatgctttagaggggcctct

SEQ ID NO: 5999 - DNA, 201 bp, Homo sapiens
ggtgtataccaacagaaatgcgctcactcattaacaaaagaagcattattcataatggccccaaaataggacattacccaaatgtccatcaagattaggasagagacatccatgtgtgctgcattccagcaatgagaatgaaagcactgaaattacatgcaacaatcttgcaaacacaatgttgagccaaagacgacaaaa

SEQ ID NO: 6000 - DNA, 201 bp, Homo sapiens
tcagagttataccaacattgatgaattttcacaaaggaagcatttttcaaagcaaactcccttaagctaatttaattcctcgatcgatgtcttgcatagcrtagttaaattgtttccaacttttttggaaacatttttactggggtcaattcttttgtgtttaaattttataaatatttgcttcattgatcaggatttgga

SEQ ID NO: 6001 - DNA, 201 bp, Homo sapiens
ttaggaagatcctcacgtgattcttgctcatggtaaagctgaatgagctctgctgcagttcactttactcattggagcctcattttcctgctttgtgcaakggagataataagatttactccagaatattatataaaggcttactaggatattatatgtgatgtgcttggcatagtgctgaaccatagatgagaggaccta

SEQ ID NO: 6002 - DNA, 201 bp, Homo sapiens
tccaccctagacccactgaaacagtctttgttttaggaagatcctcacgtgattcttgctcatggtaaagctgaatgagctctgctgcagttcactttacycattggagcctcattttcctgctttgtgcaagggagataataagatttactccagaatattatataaaggcttactaggatattatatgtgatgtgcttg

SEQ ID NO: 6003 - DNA, 201 bp, Homo sapiens
gctggtagcctcagcatcacctggcagcttgttagaaatgctgggtctcaggctccaccctagacccactgaaacagtctttgttttaggaagatcctcasgtgattcttgctcatggtaaagctgaatgagctctgctgcagttcactttactcattggagcctcattttcctgctttgtgcaagggagataataagatt

SEQ ID NO: 6004 - DNA, 201 bp, Homo sapiens
atgatcagaattggactcagatgaactagagccaattgttacctctataaaagtctgaacagggtgttgtccattggctggtagcctcagcatcacctggsagcttgttagaaatgctgggtctcaggctccaccctagacccactgaaacagtctttgttttaggaagatcctcacgtgattcttgctcatggtaaagct

SEQ ID NO: 6005 - DNA, 201 bp, Homo sapiens
ctccactgagtcctgcagtaagggaacagcaacaggggtggacatggatagcgtatgccctcgaggaatctataatgcagtgcactcaagtggcccagggsacatggagaggccaacaatggcatctaatgtgtgccaggcatggactagcttctttatgtttattttcatatttaatccttaaagaattctgattttaaa

SEQ ID NO: 6006 - DNA, 201 bp, Homo sapiens
cttacagaaagtcgaaaaggagcacttgcaaattggagaaactacctgcactgctggcaggaatgtaaattggtttacattttcagaacactggttcaaaktatctactaaagttgagtagacgcgctctattacccagcaatttcattcctaggtatatttccaaaccaataagtgcctttgtgcacaagaaaggtacaa

SEQ ID NO: 6007 - DNA, 201 bp, Homo sapiens
tgggcacccaccccacatgttcctcaagggtcttgcttgcagggagctcagtgatataagcacagattgcaaaactaagccttccctttatcaccctcagwgttcccagtgccttgctcaaatgagaaagaaaaaaaaaaaatcaacctgccaatctggtctttcctgcagtaaatgaaaactagctctgttcctgcatag

SEQ ID NO: 6008 - DNA, 201 bp, Homo sapiens
taatcatttgaaaaaattgcatctagcaacatgcatcaaagtaattagtttaagaaattacttctttgccagcacttattttaaataactattgatataawaagtgacagcgaagatttagatatcagaagctacttatattctgggccaatgtacccttaaaagttgatttctctcctgctttctctcagacaactgctg

SEQ ID NO: 6009 - DNA, 201 bp, Homo sapiens
caaataaaataatcatttgaaaaaattgcatctagcaacatgcatcaaagtaattagtttaagaaattacttctttgccagcacttattttaaataactaytgatataaaaagtgacagcgaagatttagatatcagaagctacttatattctgggccaatgtacccttaaaagttgatttctctcctgctttctctcaga

SEQ ID NO: 6010 - DNA, 201 bp, Homo sapiens
acaacatgggaacctgccaacattccacaagtgcttccatgcatgctcttgtatctttagaaggttctcagaagccctccaataaaatctcccatctcatygttcttaactatgattcatgctaatcaatgagccagtcaccatggccagtgaatcagaattgcatggattggcttaagcctgagtcacatggcctgcttt

SEQ ID NO: 6011 - DNA, 201 bp, Homo sapiens
taatctccccatttcaagagccttaacttaatcacagttgtaaaatctcttttgccaaattaggcaacacatccactggttccaagcattagggcatggayacatttggtgagtccttctcgtaccacatgtgaagaacatgcatgtgttaaccactgcggctatttctacactactcctactattacagagaaagaaagt

SEQ ID NO: 6012 - DNA, 201 bp, Homo sapiens
ggcgtcacttgtagatatatccctccgagggaagccactatccatccggtggccagcctgacaccacatcgcgtgacaaatgacatctgagaaccaagtcktaccaggcaaaggctgccacatgagtggaatacaaaatagttttctgcatgtgttcagttcactgctgtaaataagattcactggagacctgaaacagga

SEQ ID NO: 6013 - DNA, 201 bp, Homo sapiens
gagccaagtttgtgctgtctttttaacacgactaataccatcagtggaattaatagaaaaatgaaagccggcactctaattccagtaatgaaatcacaggygcacagctcccacctttaggagcctcacaaatgatgcatgtcctctgaagccattcagctggcgtcacttgtagatatatccctccgagggaagccacta

SEQ ID NO: 6014 - DNA, 201 bp, Homo sapiens
ataaaatgctcagaaatgaaagctatgcctttctggaacccaggcaccaggcattcaggtgtgaacaaagctatccatgcagtccgggaggggagccagasagaagcaagcatgtgcgaccagcattaaaggggcagctgcagtcagtcctctctggagccctgtccttgttcttcccaacacagccttgtgcgtatgctg

SEQ ID NO: 6015 - DNA, 201 bp, Homo sapiens
tagattttatgatttcagaacaatgtagtaaatgttaaagtattacagaatgctatggaataatggagagatgagaggctcattcaccctgggaaataaargaagcctttctggagaagacaaagagttgtgtagatagtcatttgagaggcaagactggggggaaggggagaggctagaaggctatttcaggaattctat

SEQ ID NO: 6016 - DNA, 201 bp, Homo sapiens
cttatacacactacagttcaagaatcacactctaggtagagccaaccttgacgtcaaagaaatctcgagttcttgttctgcaccaagcattgggatcgctratacagaaaaaagcagctcaaattcaatgtttgagtaagcacttgacttcagccttcaggatacaacctgctaggcctccaggtgaataatttaacttgt

SEQ ID NO: 6017 - DNA, 201 bp, Homo sapiens
ccaccatccaccctggctttaaaatctttagtggtttctttctgctcttatagcaaagatgcaacacccaaatgtggcctgagggtctcagcacggttctkctctgacctccttcactcttaccctccaagcaccagggtcttctcaggcaatttttttcagaccagacatttgctatgatccctccggccacagggccta

SEQ ID NO: 6018 - DNA, 201 bp, Homo sapiens
tcaccaccatccaccctggctttaaaatctttagtggtttctttctgctcttatagcaaagatgcaacacccaaatgtggcctgagggtctcagcacggtyctgctctgacctccttcactcttaccctccaagcaccagggtcttctcaggcaatttttttcagaccagacatttgctatgatccctccggccacagggc

SEQ ID NO: 6019 - DNA, 201 bp, Homo sapiens
cagagagcccgtagacagtggtgcacaataattacccatggaatggtgaatgtttcttagcaactgtaacttactgcctgcactcctctcccctgcagccrgttctccacgtggccaccagaggatgcttctggaaggtaaatctcatgttcaccaccatccaccctggctttaaaatctttagtggtttctttctgctct

SEQ ID NO: 6020 - DNA, 201 bp, Homo sapiens
agagctcaccattacaattaaactctgagcacaaatggaattaggagcataaacaaggggtggaaaagggagagattttaacagaaaaaaatgatggtttstttttttctccgaagtgacatagaaaaagaaattgaatgtcagcctctgaaaagtgtccaaattactatttgaaaggagaaaaacacaatcaaataaggt

SEQ ID NO: 6021 - DNA, 201 bp, Homo sapiens
actcaatatctgagtcagacggcctgcattagactcttggcttccacaggtaccggctctttgatcatggtccaggtactctactttaatctatccaactrctcatccattcatgtatttatttttctatttaacaaaattacataaaatagactgtccttcaggtactatactagagtttaaaaaaattaactcatgtaa

SEQ ID NO: 6022 - DNA, 201 bp, Homo sapiens
atacactcaggtattaatacactcaatatctgagtcagacggcctgcattagactcttggcttccacaggtaccggctctttgatcatggtccaggtactstactttaatctatccaactgctcatccattcatgtatttatttttctatttaacaaaattacataaaatagactgtccttcaggtactatactagagttt

SEQ ID NO: 6023 - DNA, 201 bp, Homo sapiens
caagaaagtagccacccggtgtactgaccctgctgatggagaagagcaacccaggccggtcggagcacacgcccgtgaaacagaagcgcagcttccagtaraagaggtgctcccagatgaaggtgatgaggctaagggccatggcggcagccagcatgtagaatacgcccgccatgttgtcaatgtccagctggctgctca

SEQ ID NO: 6024 - DNA, 201 bp, Homo sapiens
cccctcctgcacttcgccgctgggctccctcccgctttccctctccctctctagcctgatccctctcccgctctccctccggtcgagtctccctcctcccyggcccaaggagccctgatctccctctgggacgtacctgtagcccgagaaggtcgaggatgcagtggggcgcgctgcgcgcacgagcatctcggccgcctc

SEQ ID NO: 6025 - DNA, 201 bp, Homo sapiens
ctgactgtttcaaagcagcatgaagtttggattttcttttcaatgggatgtcttccaactttaaaatgttggcaaagaattagaagttgaaagatcaaggrtgggggatgcaggacaaacaaaagacaccaattaataaccttataatgtctcatttatgtgatgacttatcagaggctaccaactctctattacaaacca

SEQ ID NO: 6026 - DNA, 201 bp, Homo sapiens
ttctgtattctccagctatcctgaatttcttgtctcttctcccctccaggcacaaaaatgataaggaaactttgcttgggaagaatttcgcagaggcacgwtcgtggagccaggttttggggtttcgggtttcaaagtgcataccaccccagggttctcaaacagaggcacacacagcccagcagaacacacgtgcagagc

SEQ ID NO: 6027 - DNA, 201 bp, Homo sapiens
gtttaagaaacaaaacttgatctcaatatattgtggacaaatgctcaatcgaacagaaagctcactgttaatttgctcttcctccttctgtattctccagmtatcctgaatttcttgtctcttctcccctccaggcacaaaaatgataaggaaactttgcttgggaagaatttcgcagaggcacgttcgtggagccaggtt

SEQ ID NO: 6028 - DNA, 201 bp, Homo sapiens
gctgttttaatgaattcttctaaccggttgcaccgccccaaattgaccgtaaaagttaacagatttgtttaagaaacaaaacttgatctcaatatattgtkgacaaatgctcaatcgaacagaaagctcactgttaatttgctcttcctccttctgtattctccagctatcctgaatttcttgtctcttctcccctccagg

SEQ ID NO: 6029 - DNA, 201 bp, Homo sapiens
aagatacactataaaggtattattttagatagataatatatattattttatagatagctaaatgatacacaaatatattattctttgtgagagagaatatsaaagctcaaattccatcccagatcgcctaactcaaagctccacatttttgcaatacaaactatcgttctcattatgtggaacccacccaaagaaggccag

SEQ ID NO: 6030 - DNA, 201 bp, Homo sapiens
acccacgtatactgggcactgaggggaggaagatgaaaatggctacagcaagggtatagaagaggaataaattcacagtcatgtggggaggccattctgtytgtcttctggcataaaaaaagactgagtgcataggaggcagaaggcgattgcttcaagcctaagaaatggaaaaggcaccttggagaacttgacacttaa

SEQ ID NO: 6031 - DNA, 201 bp, Homo sapiens
aagcacattccaagatgcaactaatgagggaagagaaataaggaaagaaagtatgtttgacagaggcagtgtggctatagctttctccacttctgattgaygacaagatggtttctcctgcaagtaggcacagatttgctctttcaacccacgtatactgggcactgaggggaggaagatgaaaatggctacagcaagggt

SEQ ID NO: 6032 - DNA, 201 bp, Homo sapiens
tccccctccccacctacaccacaacaaccagccatgctccatctggtcccacaagtgaggcgatatggcgcagaagtcgtagccaaccctcggtgggcacrttgcatgaacgagaaataagcctttattgttataagccattaagatacaggggctgtttgtgcagcagggcctcatccatcctagctgatccagctttcc

SEQ ID NO: 6033 - DNA, 201 bp, Homo sapiens
tcaactccatggatcccatgtgccaatcttcccccagctccactattgaaattctatacatccactgagtccagtccgttttccccccaaccatcactcastctgacctggttcattctccaggagcctcagctgatttttctctagcttgatcacccttcttggtttcatgttcagttcaccattgcctttattgataaa

SEQ ID NO: 6034 - DNA, 201 bp, Homo sapiens
ttatttttgccaaagttagcatttaacgtggacataatgatggttcaactccatggatcccatgtgccaatcttcccccagctccactattgaaattctayacatccactgagtccagtccgttttccccccaaccatcactcactctgacctggttcattctccaggagcctcagctgatttttctctagcttgatcacc

SEQ ID NO: 6035 - DNA, 201 bp, Homo sapiens
atccattaacttagtctctaccaaggcctccgagttcgaggcattaaaggctccccaagtggaattaccagcgtgttataaacgaaagaatctgagtcacmaaaacagcccagcctctgtctgacctccgaccctcctcatctgacactacagcttttcccaaggcagctgcaggtgagatattcattcaaaccagcagga

SEQ ID NO: 6036 - DNA, 201 bp, Homo sapiens
tttggctgcatagcaaccactactgccatcaatgccctcggggaatgctcactcttcctgtccgccatcttgatgagtctattaaatgcacttgcttgatmgagagctgagatgcaacatgcaagctgtgtccaacaggctttttaattttgagtagcatgccctcagagtcctgcctagtcccctcaacctctcaagttt

SEQ ID NO: 6037 - DNA, 201 bp, Homo sapiens
tctctgcgtcttccccatctcaacaaatgtcaactccatccagcacgttaactataccatattaaaactctaactaaaaataaagctaacatatgacccarcaatcctactgctaggcacatatccaaaagaaaggaaatcagtatatcaaagagatatctgcactcctatgtttattgcagcactattcacaatagccaa

SEQ ID NO: 6038 - DNA, 201 bp, Homo sapiens
tttccttaaactgactccattttaaatgaattttttattacgaaaattaccaaatataaaagagtggagcattctgtgaccttaaatactatctaaatgcygacagctgcacccacaacccaggctctctcctgagctccgtgttcacagatctagccaacctgtttgatatctgcttccacttgaatgtgaaatgatttg

SEQ ID NO: 6039 - DNA, 201 bp, Homo sapiens
aaaacattttctactggccatttgtagaaaagtatgacctaagttatcagttaatcatatttccttaaactgactccattttaaatgaattttttattacraaaattaccaaatataaaagagtggagcattctgtgaccttaaatactatctaaatgccgacagctgcacccacaacccaggctctctcctgagctccgt

SEQ ID NO: 6040 - DNA, 201 bp, Homo sapiens
actacgtgcgtgacttacttttttaaaacagggtctcgctctgttgcccaggctggaatgcagtggcacgatcagagctcactgcagcctcaaatttctgkgctcaagtgatcgtcctacctcagcttcctatgtagctgggactgcaggtgtaagccatgacacctggtgaagtcattttagtttttagtagagacaaag

SEQ ID NO: 6041 - DNA, 201 bp, Homo sapiens
caagggaggcctgatgcaactggagagtcatagaaattctggctcccagctattaacaatagtatttcttaccatggcagtttcaatgcacatatgtgcaygagtgtgtctgtgcatacctgagcacgctcttatttcatccccgtaaccaatctttattcatttaacagatatttattaagcacctactatgtgcatcac

SEQ ID NO: 6042 - DNA, 201 bp, Homo sapiens
tctgcttttataaaccttgtcttttggcctacagcaccagtctacactttttaccagctctgaggaccttctgagtcacactctgaagtcctgacctcacyataaacaaagagccttttctgggggagttggagctgccctaagccagtgaaagccaatgctcatacgcttgccctatccaactgctttcattagctccat

SEQ ID NO: 6043 - DNA, 201 bp, Homo sapiens
attcattcattcatgatatttataagttggcccgtgtgtcaggtgttgtacaagacagagcagaggccccactctcaaggagcaaccatttcacagaagaracagaaacatgtaaatgaacacatacaagttaaagttgtggtacagctaatgacatgagggctcctatggaaaaggttagcaggactgtcacgaagccct

SEQ ID NO: 6044 - DNA, 201 bp, Homo sapiens
actccacattaaaacacacaggaaaacagatcttctctctggaagacacctgcaatctctttgtttcctttcttatattaggtcttccgcatggtcaaggmaagagacccactccagttagttcaagagaaactgtttattgtaaggacacatgcagattgctaccagaagccttcatattctctccccactcccctgccc

SEQ ID NO: 6045 - DNA, 201 bp, Homo sapiens
ctgttcaccaaccaggaacaccattacatcagcaggaagcaaacttctactatgttataccactgatatttgagggcttatttgttatagcatctaccatyatcctttgaattacgaagctaagggaaaaaaagcccattggctttaaaacccagcagagttcagtaggaggaggaagatggagaaagttataaagtaatc

SEQ ID NO: 6046 - DNA, 201 bp, Homo sapiens
ctctacaagcacctgttttgcaattttcaggttaacaagtaaaatcttccttgagtgtatacctctaagcctgtgaacaatatttctcatccattcatccsctctgaaaatattttacatgcccaatcctctggtaggtaattaggatatagaaattgggcacaatctatgtcttccagtcctggtatggcggagaagaaa

SEQ ID NO: 6047 - DNA, 201 bp, Homo sapiens
ccgatacttgcgacatcaatgtactgctgtgggtacagctctacaagcacctgttttgcaattttcaggttaacaagtaaaatcttccttgagtgtatacytctaagcctgtgaacaatatttctcatccattcatcccctctgaaaatattttacatgcccaatcctctggtaggtaattaggatatagaaattgggcac

SEQ ID NO: 6048 - DNA, 201 bp, Homo sapiens
ttattctctggttcatttaattttttgagtttgcagcccttgctgtgcatgttccttccctgcttaaaatgtgctgctttcaatgctctgttgcaattgtrtataaagtaaaagtaaactagcctggagagacagtcttaagacggctctcctttgtgtagaatacatggactttgttgaccactcttttgcatgatctaa

SEQ ID NO: 6049 - DNA, 201 bp, Homo sapiens
ccaccttcgggcacaacctctctccataactgagtggtccacagatttgcactacgggttccccagctcctttccagggagagaggaggagaggtcctgarggctctgcagcccctcgctgagcatcccctacagagtcgggcctgctccctgggccaggctgcctgggggcgccccccagcccagccagccaggctctca

SEQ ID NO: 6050 - DNA, 201 bp, Homo sapiens
cccacaacaacttcctgattctcccatggttcatagatttcatagctgatgaggtagacctaacttcagccctgacccggaagatcatgctgaagacaccrctgatctcttcccctatggacactgagacagaggccgacatggccatcgcgatggctctgatgggaggtattggtttcattcaccacaactgcaccccag

SEQ ID NO: 6051 - DNA, 201 bp, Homo sapiens
tcggcgccaactgccgcacccacaacaacttcctgattctcccatggttcatagatttcatagctgatgaggtagacctaacttcagccctgacccggaakatcatgctgaagacaccactgatctcttcccctatggacactgagacagaggccgacatggccatcgcgatggctctgatgggaggtattggtttcattc

SEQ ID NO: 6052 - DNA, 201 bp, Homo sapiens
ccttgcggcagcatggcggaccatctgatcagtggcggcaccggctacgtgccccaggactggctcaccgtgcagcagctcttcctcggcgccaactgcckcacccacaacaacttcctgattctcccatggttcatagatttcatagctgatgaggtagacctaacttcagccctgacccggaagatcatgctgaagaca

SEQ ID NO: 6053 - DNA, 201 bp, Homo sapiens
gccttgcggcagcatggcggaccatctgatcagtggcggcaccggctacgtgccccaggactggctcaccgtgcagcagctcttcctcggcgccaactgcygcacccacaacaacttcctgattctcccatggttcatagatttcatagctgatgaggtagacctaacttcagccctgacccggaagatcatgctgaagac

SEQ ID NO: 6054 - DNA, 201 bp, Homo sapiens
cattaaaaattatgcttacagttcccaggcccacagcgtcagcagcagcggcagcagcggcaggcggccgcgcgggtgtttgtcgcttcgcggggccttgmggcagcatggcggaccatctgatcagtggcggcaccggctacgtgccccaggactggctcaccgtgcagcagctcttcctcggcgccaactgccgcaccc

SEQ ID NO: 6055 - DNA, 201 bp, Homo sapiens
accactatgggcattaaaaattatgcttacagttcccaggcccacagcgtcagcagcagcggcagcagcggcaggcggccgcgcgggtgtttgtcgcttcrcggggccttgcggcagcatggcggaccatctgatcagtggcggcaccggctacgtgccccaggactggctcaccgtgcagcagctcttcctcggcgccaa

SEQ ID NO: 6056 - DNA, 201 bp, Homo sapiens
cactaagtggttaaataaccaccactatgggcattaaaaattatgcttacagttcccaggcccacagcgtcagcagcagcggcagcagcggcaggcggccrcgcgggtgtttgtcgcttcgcggggccttgcggcagcatggcggaccatctgatcagtggcggcaccggctacgtgccccaggactggctcaccgtgcag

SEQ ID NO: 6057 - DNA, 201 bp, Homo sapiens
atgaaaatgaccaaggcacccaacactaagtggttaaataaccaccactatgggcattaaaaattatgcttacagttcccaggcccacagcgtcagcagcwgcggcagcagcggcaggcggccgcgcgggtgtttgtcgcttcgcggggccttgcggcagcatggcggaccatctgatcagtggcggcaccggctacgtgc

SEQ ID NO: 6058 - DNA, 201 bp, Homo sapiens
ttttaaagaagagaaaattgagtgtattagtccattttcatgctgctgataaagacataactgaaactgggaagaaaaagaggtttaatggacttacagtwccacatggctgggaaggcctcacaatcatggtggaaagcaagaaggtgcaagtcaagtcttacatggatggcagcaggcaaagacagagagcttgtgcag

SEQ ID NO: 6059 - DNA, 201 bp, Homo sapiens
caggacatggagggattcatgaagggagagaaggaaggcagggaagctgggctgtgcaataagcagcaagcctgggtgttatttcagcctcccgagaacaygccagaatagacattgccattacctccattttcagaggaagaaactaagacaaatgaatcagacagaagacatgatgttcatctcataaatggacatgtg

SEQ ID NO: 6060 - DNA, 201 bp, Homo sapiens
aaaaaaggagaataaggcaggaattcaaaatactcttatgaacagaaaggcaacaggtagagcaggacatggagggattcatgaagggagagaaggaaggyagggaagctgggctgtgcaataagcagcaagcctgggtgttatttcagcctcccgagaacatgccagaatagacattgccattacctccattttcagagg

SEQ ID NO: 6061 - DNA, 201 bp, Homo sapiens
ctttggggaagttggctccttcacttctagagaaaaaaggagaataaggcaggaattcaaaatactcttatgaacagaaaggcaacaggtagagcaggacrtggagggattcatgaagggagagaaggaaggcagggaagctgggctgtgcaataagcagcaagcctgggtgttatttcagcctcccgagaacatgccaga

SEQ ID NO: 6062 - DNA, 201 bp, Homo sapiens
agggtgaggggtgtgagggaaatggtggcagcaagaagttgagcctgggcatctgggaggatggtggtgccatgccctggaggaggaccagtttgaagaargaatatcataggagtccaataaatactactagaatgaatgacttaataatcagtatgtaagttacattcattcccctctgcttctggctttccatctgat

SEQ ID NO: 6063 - DNA, 201 bp, Homo sapiens
aaaccagtttgaagaaactattcgacgtattcattctgtcatctgttcattcatctgttattgaacctttcaaggtaaaagattagaggattctggccagsagagaaaagagaaaagtggatggatatgaacactatgtagaaggtgtagtcacagggtgaggggtgtgagggaaatggtggcagcaagaagttgagcctg

SEQ ID NO: 6064 - DNA, 201 bp, Homo sapiens
tccttttaacaagctcagtttatcaatgtccttcttaaaatacagaactcacacatgagcataaccgaagatacaatatttgtgaagggactgtgaaaacragagtaggcagaggcaaagggttgttattttttctctaggactaaataaaaatataaatgctatttctcttaacacaaaccagtttgaagaaactattcg

SEQ ID NO: 6065 - DNA, 201 bp, Homo sapiens
ctttttttttaaggacaaagaaagtaaatatgggaaaatgtaaacttgtccaaagacatacatctagtcatgagaaagctgaaacccaaaacagctaagcygatgtatcacagcctctgaatcaccatcactgaaagaaacaacacacttggggatgggggagtggctctccttgcacaagctgggatgcaatttgcagac

SEQ ID NO: 6066 - DNA, 201 bp, Homo sapiens
atgaatgatccttgacatcaagaagctcaaagactagctggaaagatactaatatagcaattccttttattttctctaataggagacccactcgcaactaygaggaatagatactatcagcagcaacagcaactttttttttaaggacaaagaaagtaaatatgggaaaatgtaaacttgtccaaagacatacatctagtc

SEQ ID NO: 6067 - DNA, 201 bp, Homo sapiens
atttgggataccaattataaacttgggacaagagcctaatctcccagcaaggaaaacctgggctgtcagtctactttaccaatccctgccttggaaattgytatatatctcaggctacaagaaagtagagggagacaagagaaaaagcatccctcacacaaccttcagatcttccgctggagagatagccccactctagga

SEQ ID NO: 6068 - DNA, 201 bp, Homo sapiens
ctcttgtcccaaaggatgaaaacctccgagcgccgtggaagagaacagtctgattaagttggctcaaactgccaggaagctttctgagcaacagcagatgytggggcttcgagaaagattgctctctgcttttggccagaatccctggggtcatttaggtggtgatgttgccagttcttctcccctctggccaacacctct

SEQ ID NO: 6069 - DNA, 201 bp, Homo sapiens
atgaacagcaggtgcaaagggcccatgtcagacaggtgaaggggggacatgagggcaactgcaagaaggccaatattacttttgcaaggagcaggtgagasgtggggctccagaggtagccgaggtcagccatgaagtgcttggaaggccacagagacaaattttattcctatcaccatagcaacgggaagccatgaaacc

SEQ ID NO: 6070 - DNA, 201 bp, Homo sapiens
tcagctaactagtgttcccctggctcaaagaaaatgtggaagttggtggtttttcacaaggatgatactatctggagctgctgtcctctgagagtaggacrggtcagaagagatctgcacctgctctgttaaggtagtcttgccatctctaagggtttgatttgctggcttgtttactggagtcagaaacagaataaaggt

SEQ ID NO: 6071 - DNA, 201 bp, Homo sapiens
aagctttataaaataagcacaacaatgaatgttaaatatgtaaccaccataagtgttaccaacgagaagcatatggtgggttccaggagggcagttgatayaggttatggtttaggaacgatttttctaaggagtaatgatgaggttgaggtctggagaatgtctaagaattatgagagagtttggggtatgtgtgcttct

SEQ ID NO: 6072 - DNA, 201 bp, Homo sapiens
tgggggatgtgcctgtgtgctccacgggtgtcctcttgaatgttataacctctacatgaagcaaaatcctatgtcctgcacacagtaggcactcagaaagygtttgttgaattggatgacacctgagtttgtgcttctggacattctaaatacttttttatgcaaatctccagctttccttcccatggagactcacagcac

SEQ ID NO: 6073 - DNA, 201 bp, Homo sapiens
cagcagtgagccgagatcatgccactgcactccagcctggacaacagagtgagaccctgtctaacaacaacaacaaaaggcattcagttgtaaaaattaamtaagttgacaaatatcaaaggcttagaacctggtgacatgtcttcagcacacagtaaacactcaatgactatttatattctttactgagcacctactaag

SEQ ID NO: 6074 - DNA, 201 bp, Homo sapiens
gcctataatcccagctacttgggggttgaagaaggagggtcgcctggacccaggaggtcaaggcagcagtgagccgagatcatgccactgcactccagcckggacaacagagtgagaccctgtctaacaacaacaacaaaaggcattcagttgtaaaaattaaataagttgacaaatatcaaaggcttagaacctggtgac

SEQ ID NO: 6075 - DNA, 201 bp, Homo sapiens
cttcccctgctactcctgtctgcatcctggactgaacttaccaaacacgctcatagagctgcttctctttacaatgttcttttctgcacctcaccccccayccctactctcctacctgacgaatttatctttcaagacatgctttataaagtcaccttctctaagaagtcttcttgaattctttctatgaagagtccttag

SEQ ID NO: 6076 - DNA, 201 bp, Homo sapiens
ctcttcccctgctactcctgtctgcatcctggactgaacttaccaaacacgctcatagagctgcttctctttacaatgttcttttctgcacctcacccccsacccctactctcctacctgacgaatttatctttcaagacatgctttataaagtcaccttctctaagaagtcttcttgaattctttctatgaagagtcctt

SEQ ID NO: 6077 - DNA, 201 bp, Homo sapiens
ctagaggtttcctttcatgaagataaagtttctagctggaactggctgtttttgcagggaagcacacatgagacgagctttttggagtctctccaatacckgcctgtttcataaatggcacagtctccaaatctgatgctcactggaccagggtcaggctatggaactgattaaaataagtaggaacctccaaggccctat

SEQ ID NO: 6078 - DNA, 201 bp, Homo sapiens
tgtttgcagagtcccaactgcagaagagagtgacatgccataaacaggtcaaatgtcgttaatataaatatctaccatggggcaatttccgaggctcttayatgcttcgtcctgaggttagcatgaggcaactgcactcactgctacgccttcccacacttattctaagggacagccagctaggatggagtgggagctgat

SEQ ID NO: 6079 - DNA, 201 bp, Homo sapiens
actaagaaagcaggaaagagcttggcacaggctgggaagaagcgacagaaagaaggttgctatgataacgcaatggtgtaatcagtgtgatttttatgtgyttgtatcagagaaccctgggtgcaattcctgtatgaagaattgcatgagcactttgtatgagaatgagcaagttaccctctgtgcaatgctgctctcagc

SEQ ID NO: 6080 - DNA, 201 bp, Homo sapiens
tgtttgttgcttacaagctacccagtttatgacattttgctatagcagcccaaacagactaagaaagcaggaaagagcttggcacaggctgggaagaagcsacagaaagaaggttgctatgataacgcaatggtgtaatcagtgtgatttttatgtgcttgtatcagagaaccctgggtgcaattcctgtatgaagaattg

SEQ ID NO: 6081 - DNA, 201 bp, Homo sapiens
atgtttgttgcttacaagctacccagtttatgacattttgctatagcagcccaaacagactaagaaagcaggaaagagcttggcacaggctgggaagaagygacagaaagaaggttgctatgataacgcaatggtgtaatcagtgtgatttttatgtgcttgtatcagagaaccctgggtgcaattcctgtatgaagaatt

SEQ ID NO: 6082 - DNA, 201 bp, Homo sapiens
aagcagagtccagggggaggcaaattgagatgcaggagggaaggagataagagcaatagggaatcctcagagcacctggcaggcccccagcccctgggggmaggagaagccaggccacgtagtcatgtccccatggagaatgcagctgctcctctgtgctctgccctcggttgctactgccctgcgaggcaaactcgaggc

SEQ ID NO: 6083 - DNA, 201 bp, Homo sapiens
cagcaagctgtgcatgaccacctttcccaatgcagtgaaggatagatcccacgtcttgggcttaggcagttaggtggatggtgagtgcaattactaaagaragaaagacctgggaaggaacagttaagggtggggagcaagaggaagacaatcaagaaatgctcagtacctgtgggttccctcttgcctatccacccctcc

SEQ ID NO: 6084 - DNA, 201 bp, Homo sapiens
ggccactcatacagccatacagggtccagcaagctgtgcatgaccacctttcccaatgcagtgaaggatagatcccacgtcttgggcttaggcagttaggyggatggtgagtgcaattactaaagagagaaagacctgggaaggaacagttaagggtggggagcaagaggaagacaatcaagaaatgctcagtacctgtgg

SEQ ID NO: 6085 - DNA, 201 bp, Homo sapiens
tcccttgcaatgcgtcagtcccccacagccagtggatctgctctgcagtcaacccaggcagtgcagctgcacacacccacctcgtgctgcagtagaaggamccagatccctttccaccagggacagatatagtagcaggtttggccaggggccattagatgcacacacttgagcagaacaaagtacatcaagcccagaaca

SEQ ID NO: 6086 - DNA, 201 bp, Homo sapiens
cactgggtggtcaggctgggcagccaaggttaaaaggctaagtgtcatccagggaagagaccatcacacgatttgaggttgctgagaacagacaacacacrcaccaggctcaagtggtagagcaagaggagacagactacacaagatgcagtcccttgcaatgcgtcagtcccccacagccagtggatctgctctgcagtc

SEQ ID NO: 6087 - DNA, 201 bp, Homo sapiens
aaggagaataattatacattgcactagactctggtggggatgagagaaagagaatgttccaccattcactgggtggtcaggctgggcagccaaggttaaarggctaagtgtcatccagggaagagaccatcacacgatttgaggttgctgagaacagacaacacacacaccaggctcaagtggtagagcaagaggagacag

SEQ ID NO: 6088 - DNA, 201 bp, Homo sapiens
tggcaagaggagagggataagacaggtgggtaaggaccccgcagttcatgagaaggcacctaggttctagccaccaagatgtcatgagaagcccttaaagrctattcagaagagaagtgacctgatccaatttaccctggctgcaaaggaaaggatgaagtaggggaggagtagaggtagaagcagggagaccagtggagg

SEQ ID NO: 6089 - DNA, 201 bp, Homo sapiens
aaagagacccatgtttccacccaggatctatcactctgagaccttaggatgagtgactgaagcatcttaagctgcccctcccagtgtttgctaaatgtcayggcagagggttaacctcccaggagattgagaaggttaaatgagataccacgtgtgcagaggccagcatggtgcccagctcagcagtaggcacttgggaaa

SEQ ID NO: 6090 - DNA, 201 bp, Homo sapiens
cctgaagacagatgtatgctgcaaaatagcagttccatacaaatgcaagagggcgtcaaagtcaacagggacaaaactatgggctatttcatgttcctcaytgagtaagacctcactcacaatcacttattctgattataaaaatgatgacctacaaagagacccatgtttccacccaggatctatcactctgagacctta

SEQ ID NO: 6091 - DNA, 201 bp, Homo sapiens
cacggtcagtgcattcatccaaacggacgaatccccatgcctcatcaattgttacactttttcaatgtcacctacctaagaaaatcagaatacaccgtaasgtggagaatccatatgcagataaatgaaagaggagagtcaggaccatgcaaaaaattacagggaaatttagcaaagtctggtgataacatagactctcca

SEQ ID NO: 6092 - DNA, 201 bp, Homo sapiens
ctagactatggggaaatctccattgtttcagggcaagattgatattcagctggttgtttatggctggcaagcattcacacggtcagtgcattcatccaaayggacgaatccccatgcctcatcaattgttacactttttcaatgtcacctacctaagaaaatcagaatacaccgtaacgtggagaatccatatgcagataa

SEQ ID NO: 6093 - DNA, 201 bp, Homo sapiens
gatggacagcttcactccatgttaacccagcgactccatcaaacctatgcttgtttctactgttcatgcctctacattgatgtttctcaagcttttatgayccaggtctccttgataaacatttttaacctcacattttcctctaatgctatttgaaatggcaagagaaattaatatggtgactaaaacatatcaagagat

SEQ ID NO: 6094 - DNA, 201 bp, Homo sapiens
agcaacatgcaggggccctgcatcaacaggtacttgaatgctggtgaatgcgtcccaggcacctcacttcgttcgcccattttggtgcatcagaacaacgwtgtcactggtctaacctcatcttcactccctggggactgaggtcttgcctgattcccaaagccctgcaccagagatcctcaaacattttcaactaggact

SEQ ID NO: 6095 - DNA, 201 bp, Homo sapiens
ttcagaatcaggggctgactcttctatttttcaaacaacccccaaaactagccacagcaacatgcaggggccctgcatcaacaggtacttgaatgctggtraatgcgtcccaggcacctcacttcgttcgcccattttggtgcatcagaacaacgttgtcactggtctaacctcatcttcactccctggggactgaggtct

SEQ ID NO: 6096 - DNA, 201 bp, Homo sapiens
cagcaaccataagcctcccacccaaaaatctattctctccttctttaacatgagaaggaaataaaattcttacttaagccattgataatctggattttctrtcataaaccaccaaactgaatccaattgatttagtatcccgtgaatatttgttgaatgaataaataattctcaagcaaatcagaggatctaaattacatg

SEQ ID NO: 6097 - DNA, 201 bp, Homo sapiens
tgaactgggatgagatggaaacccaggtccggtacttgctgacttctccactgatgtacataccttctttatggattgcgagtatccacttctacctaagrcaggagttgataagctttctctgtaaaaggtcaaataggaaacacttcagattacaactactcacccctgctgttgtagtaaaaagcagccctagacagt

SEQ ID NO: 6098 - DNA, 201 bp, Homo sapiens
ggatcagatagggtaatggccggaccaaagtcacataaaaaatgaatggctgaactgggatgagatggaaacccaggtccggtacttgctgacttctccaytgatgtacataccttctttatggattgcgagtatccacttctacctaaggcaggagttgataagctttctctgtaaaaggtcaaataggaaacacttcag

SEQ ID NO: 6099 - DNA, 201 bp, Homo sapiens
tcacagtgatgaatagaacatgttggaaagtggctcagagagtaggaattaaagaatgccagctccagtaaatgtcacatatcaatcaaaagtgaagaaakggagttccctccaaaagtggcagaggggacaccttcataaacagaacataaaggccaatcgaactcagcagcaaaatgggacgtattcagccagagcctg

SEQ ID NO: 6100 - DNA, 201 bp, Homo sapiens
tctgaaaaagactcccaaacccacagtgaagtcagtctggggcagagagaggtggtgtgatattatatatgtcattataaactctaagtgcctcttttccraactcttagaaggttagtagtggcaaaggcaacaaaaaagtcacagtgatgaatagaacatgttggaaagtggctcagagagtaggaattaaagaatgcc

SEQ ID NO: 6101 - DNA, 201 bp, Homo sapiens
aggctaccggagcagacccgggaacaaagtcctcacagcccaatcctctatactagaaagagaaggaaaatcaataggtactaggcacgaaccacatgccrgggtctgtgcttcacgttttctgatgttgcctcagttctgtcccacacattatctgtttagcccctactgtgacctatcttatagataagaaaattaagg

SEQ ID NO: 6102 - DNA, 201 bp, Homo sapiens
gcaagtgcaggattcagctacccctggctttgactggtggtagaaatgggtaggttgatgatatattttggaggtaaaatcaaatttgttctaaaaatttytgaagttcagaagcaaataataactttagaaaggagcccatgcctcagacaacagagcgtcttaaacaacagaggaaggacttttgactttctcctgtag

SEQ ID NO: 6103 - DNA, 201 bp, Homo sapiens
ccaaagaaaggaaaagatcctacgtggataaagcagaaacctccacacaagagctgtattattagttggtgcaaaagtaatcgtggtttgtaatggcaagraccacaaatacttttgcaccaatctaatacatccataaatggatatatttgaatatggagtgacaataagaagttaaaatttaattttaaaaaaccgaac

SEQ ID NO: 6104 - DNA, 201 bp, Homo sapiens
gagtgacgaatgaagcagagtcactggtatcttttgagcaggtggtgacaagttcataggagttttaggagggcaaatgttgcactaaggtggattgccckggggagaaaatggagccaggattagaccactttgcctagtctacatcctgccacctgctgttacaacgtccttctgttgtcagggtcactcatgaaatgc

SEQ ID NO: 6105 - DNA, 201 bp, Homo sapiens
gtgagtgacgaatgaagcagagtcactggtatcttttgagcaggtggtgacaagttcataggagttttaggagggcaaatgttgcactaaggtggattgcyctggggagaaaatggagccaggattagaccactttgcctagtctacatcctgccacctgctgttacaacgtccttctgttgtcagggtcactcatgaaat

SEQ ID NO: 6106 - DNA, 201 bp, Homo sapiens
taggccctgtccttaaggaatcgccatctgccccaggggacatgaatgatgcttctagccagggagaggggtgggctaagatattccgccttcaggttgcwgggagggtaagtgtgaccagggctggctggcggtaaagacctcccggaaaatgtaggtcctgtgctggatataaagaaaagatctgttgaggcaggaagc

SEQ ID NO: 6107 - DNA, 201 bp, Homo sapiens
gtcttgtttgtgctgagagatctcaaactacctcttttactgaagacttcaagggggaaactacagaattataatggcctggaaggaaatgtctctgaaasacaaggatagtggccagtagacaatggcacacatgcccaaaacattgtcatcaggaaattcaagaggtcattaaattctactgtaggaggaaattaacac

SEQ ID NO: 6108 - DNA, 201 bp, Homo sapiens
gtagtaactcaaagtagtttttaaagtgctccaagtatacaaagctggaaggaattaattctgccttgcatgtgtgtgtctgagggggtgtatcagggacyggaccattcgaattgaatattgccgaattcacacaacttggcaaagagaaagggtattccagggagagagaactgcatgtacaagagcaaggaggtagaa

SEQ ID NO: 6109 - DNA, 201 bp, Homo sapiens
cctcctgcatgggtctcagagtctgatggaaagggcagtcgtaagtgagtagtaataaaacattgggaagaaaaactccatgggtgcagggcattgccttktcacaggagtatccccagagccaagatcaatggctgacccatagtaggcacttaataaatatttgttgagtgaatgaatgagtagtaactcaaagtagtt

SEQ ID NO: 6110 - DNA, 201 bp, Homo sapiens
actgtttttcctctccatggaattctaagctcaaataactgcagtcagttgtaaaagtgcacagacaggaacaagacacctcctgcatgggtctcagagtytgatggaaagggcagtcgtaagtgagtagtaataaaacattgggaagaaaaactccatgggtgcagggcattgccttttcacaggagtatccccagagcc

SEQ ID NO: 6111 - DNA, 201 bp, Homo sapiens
tatttatagctgctccccattgcttgcattaccacctgagctccacctcctgtcagataagtggcagcattagaatctcataggagcaccaaccctattgygaactgcacatacgagggatctagatggcatgctccttatgagaatctaatgcctgttgatctatcactacctcccatcaaccccagatgggaccatcta

SEQ ID NO: 6112 - DNA, 201 bp, Homo sapiens
tggccgagaagacttcacagaagtgattgaggatcttgatatggggagattatcctgaagtccctggtttggcccaatgtaatcagaagtattcttctaasagggaggtagaaagggcagagggagacaaggacttgaagatgctacacttctagccttgaagatgaaggaagaagccaggagccaaggaacaaatacagg

SEQ ID NO: 6113 - DNA, 201 bp, Homo sapiens
gccacaaggggctcaaaatgtctcaacccataaaagacttctctccccatttcctctctccatctcaaccttggagggtttctgttcctaatgctattctwcatggcagctgggatcagtgcaagctccagggccaagttctacaagcctccttcctgctgacgtggaggaaggagccgagggagagatctctctggcccc

SEQ ID NO: 6114 - DNA, 201 bp, Homo sapiens
cctgccctcaagtaatttatatccttctataaatgatcatttattttataacataaaacaaccacaaccattatttggtagcagatagatctaggtcccastctccgctagcttgtggatgttactgtctcgatctcagtttcttcatccagaaaatcggggtgataaagtctacctctctagatcattttcagaattcag

SEQ ID NO: 6115 - DNA, 201 bp, Homo sapiens
tacaatttagatattatcacccctactttacagatgaggaaactgaggcttgatgccgttaaataacttttcctaggtcacatagctagtgagaggcaccrctaggattcagtacaggcctttgaactcaaagttgacattcgttccaacccaccaggctgatgatcaaagtggcacgctaagaaagcaccccaggatttg

SEQ ID NO: 6116 - DNA, 201 bp, Homo sapiens
agatgacatcaacaaaggcaatgtggttgccttctctcttttggatcactcactctgaggaagttggctgccatgacatgagggacttcaagcagccccayggagaggttctcaaaatcaataaatgaggccccctgccagcagcctcggaaacaagccatccatgccagccagtcctccagcctcagtccagcctttaga

SEQ ID NO: 6117 - DNA, 201 bp, Homo sapiens
caactctcttctcatgaatggagtgggggacaaaagacagtgtgatttctgagatgacatcaacaaaggcaatgtggttgccttctctcttttggatcacycactctgaggaagttggctgccatgacatgagggacttcaagcagccccacggagaggttctcaaaatcaataaatgaggccccctgccagcagcctcgg

SEQ ID NO: 6118 - DNA, 201 bp, Homo sapiens
acacagacacccaaaatggtaaccaacagtcgtgaaagatgtgttaattaattcgatggtggtaatcatttcacagtctacacactcatcaaaacatcacwttgtacaccttgaatacaaaccactttatttgtcagttaaacctcaataaagctgggaggaaaaaaacagtataccaaagaaatgaaaagatgggccagg

SEQ ID NO: 6119 - DNA, 201 bp, Homo sapiens
aatgaataagttctgaggatggtgactacagttagtaatatcatactatacacttgaaatttgtgaagcgattagatcttaattatactcacaccacatayacagacacccaaaatggtaaccaacagtcgtgaaagatgtgttaattaattcgatggtggtaatcatttcacagtctacacactcatcaaaacatcacat

SEQ ID NO: 6120 - DNA, 201 bp, Homo sapiens
gatctatcactcctaaagagatgacattctggctgtggctagaagaacccaatcatgtaaatttcattttatttcttaaaaaatgttatgggtacatagtrggtgtatatatttatggagtacatgagatattttggtacaggcatttaatgcataataatcgcatcagggtaaaatgaggtttccatcacctcaagcatt

SEQ ID NO: 6121 - DNA, 201 bp, Homo sapiens
ccctggtgaagaaaaggtgaggaacttcagaagaattcaggcccaaatctctttcaaagatttggaaactgggttcccaaaaagagagttgacacatccarggtcggagtgatagtgacacagtcaagactagaatccaagtcttccctgactctcaatctagtaaatttttctattataattcaaataggtagcctatgg

SEQ ID NO: 6122 - DNA, 201 bp, Homo sapiens
cttctctagagatggaagccggagaagcctggagaagcctggggaagccagaaggccctgaacccctgacaaaaagcctaaggatcctcacccagcaatgytgaccacgaccattaaaacatgaagcccacccccaaagaggaaaatccttgccctttaatgaagctgccaaaaacctccaaatttaacagtttgcactgt

SEQ ID NO: 6123 - DNA, 201 bp, Homo sapiens
agattttgagcaagaagcaaagatgcttgtgcaaaggagagtaattcgaagacctttggtagtcctggcaagagatgttgagtgttggatcacagagctgstgatggaaatggggagatgtatttcgactgatgttggtcaagttacttctttctgcacctccatttcctcatctgtaaactgggagtaataagcccactc

SEQ ID NO: 6124 - DNA, 201 bp, Homo sapiens
gcatgagctaccacacccagcctgctgactgtaatttctgatgaccaaaaacttcactgatcactctggaagttatttagtattactatgtggtaaatacygtgctaaacagtacttttcatgcggcacctcaatgaatatgacaatctctagaacattggtcctcaaagcacagcccctagaccaagaacatcaacatca

SEQ ID NO: 6125 - DNA, 201 bp, Homo sapiens
tcactcttttcctaatgctgacaacattaaaagacagagtaatagagtttcaggagtcaaccgtcagagagatgcagaatctaaaagggaacaggcaaggrtaattgaggcagtgttgtgtgtgtgtgtctccaacttgcttccattccatttaaaagggaacaggcaaggataattgaggcagtgttgtgtgtgtgtgtc

SEQ ID NO: 6126 - DNA, 201 bp, Homo sapiens
agtttctgggtttgcttctgccatggttccaggaattttcaatgtatgagtttttgtatggaaaaatttttactttgattactacaccatttaagtagcayacatttgaactcacatgctcatttgggctttaatttcttactgacagcttcaaacagatggtaaacctccttgcattttcttcactttgatggacagaga

SEQ ID NO: 6127 - DNA, 201 bp, Homo sapiens
ttaagttctttctcagggtttcactaagcatactccaggctagagacagctccaggctggatattgcaccaaatgaattcacacatacactccctcacccmctagaagttcatatccctggacagctggtagcagtcattccagttaacagcatttctgaatgcagagaaaaccaggcaacaaatacttaatgagcatttc

SEQ ID NO: 6128 - DNA, 201 bp, Homo sapiens
ttcataactcaagaagtcaatccaaaacacataaatggtcatgccaggtgtcatcaatgaaggccaaataacttcccttcaatactaattcataactctcytgggataagactttttttgccccctcatttgtgctatagatctacttgagctcttctacttgatttccagtgcagtaacttctccatgtcctacttccct

SEQ ID NO: 6129 - DNA, 201 bp, Homo sapiens
tgtgtagcatgtgcaggtttgttacataggtatacacgtgccatggtggttggctgcccctatcaatctgtcatctatattttaagccccgcatgcattasgtatttgtcctaatgctctccctcctcttgccccccacccctgacaggccccagtgtgtgatgttcctctccctatgttcatgtattctcattgttcaac

SEQ ID NO: 6130 - DNA, 201 bp, Homo sapiens
gctacaccagcacactccctagctcacgatattttaagtggatgaataaatgaatgagcaaaaaaagagcaccctacctctaactggatcccccagctgtraactctctcacattttttctctagcaaattccctcttttttgctgtttctttctcctcttttctgttctattctctttcttcatcccctatgctttaaaa

SEQ ID NO: 6131 - DNA, 201 bp, Homo sapiens
aatagattgtgaaaaagaatcaacagagtgatatggggaaaggggaggttcacctggtgttggtacccatgatgaacacattatgcagcaggatggggaaycataatacatggaagagggattcagacaaaggccctgtaacaggagaagaacttgggcatcagaagaacaggaggacagtccatgttgctggagtgaaca

SEQ ID NO: 6132 - DNA, 201 bp, Homo sapiens
tcatccctccacccatttaccctttcactcatccacctttccacccttgatccattcaaccctacatctttccactcatccattcaaataatcattcaccyttctctttatacaacaactcctttaccaatccatcctcttccccttccagccaggctggtcctcccttcccattctacacctacccattaagccaccttc

SEQ ID NO: 6133 - DNA, 201 bp, Homo sapiens
aacagtggtgaaaatcttagctaaaggcattcaaattcatttaaatgtaaatgaaataaaaccgatctactggctgctcatttggactgtctgttctaaaygaactgaaaaatattcatgttccttcctctcgcaaaaacctaggcttccttctataccagtacagttcacgggactgcatcccttctggggcagagcgat

SEQ ID NO: 6134 - DNA, 201 bp, Homo sapiens
ccagggtctcacagaccctaggccaggggctttcaaacttgagtgtgcatgggcatcacccactggagtcaccgaccaggagatctcaggggaagcccaaraatctgcattcccaagtgatgctgatgctgctggtccagggaccacactttgagaaccactgcactggatgatcgatttttttttttttttttttgagat

SEQ ID NO: 6135 - DNA, 201 bp, Homo sapiens
ctaagatgcaaatgcttttcttgtccccatattacacctgagggagccgacgtggagttcagtgactcacccaaggtccgaagtctaaaaaagtacagatyaggttcgaacccatgcaacctggccccagtgcccatgctcttaaccgtgatgccactgcctcccagggggccctggccactcctgaactggacagattct

SEQ ID NO: 6136 - DNA, 201 bp, Homo sapiens
acaggcaatacactaatacagatgaaaatacgttatatgtcaagtgctgataaagtcccgtatttatgctggaatttgggtgaatcatgtcaatttgctgrtaagtgaccactttgatccataaagaaggtgattttgaaaggcttagccaaatacatactcagacaaaatgatgtacaagaaacagcaattcctccagga

SEQ ID NO: 6137 - DNA, 201 bp, Homo sapiens
cttcaaagaggctgacatttgtgacctcattgataaaattttctccaaaccaaaacaggccttatttttatatgttttatatatatataaaaatatatatkttatatatttttaacatgaaaatatatggtttatatatttttaatatataaaaatatattggtttctatattttaatatatgaaaatgttttatatattt

SEQ ID NO: 6138 - DNA, 201 bp, Homo sapiens
tgggaggatggtggtgccatgccctggaggaggaccagtttgaagaaggaatatcataggagtccaataaatactactagaatgaatgacttaataatcartatgtaagttacattcattcccctctgcttctggctttccatctgattagatcaaaagcactcttgcatatggaaagcttgcacgagcacaattttacgt

SEQ ID NO: 6139 - DNA, 201 bp, Homo sapiens
aacacattatgcagcaggatggggaatcataatacatggaagagggattcagacaaaggccctgtaacaggagaagaacttgggcatcagaagaacaggargacagtccatgttgctggagtgaacatagcaataggagacagaggaaatggcgacaaagatggagcagctgcagatgtgctgggccccacagactatggg

SEQ ID NO: 6140 - DNA, 201 bp, Homo sapiens
ggtaatttatagattcaatgccatccccatcaagctaccaatgactttcttcacagaattggaaaaaactactttaaagttcatatggaaccaaaaaagarcccacaatgccaagttaatcctcagccaaaagaacaaagctggaggcatcacgctacctgacttcaaactatgctacaaggctacagtaaccaaaacagc

SEQ ID NO: 6141 - DNA, 201 bp, Homo sapiens
aagtaagtgctcggtaaaatgttagttgtactttgtcaactactgtagtaatcaatagggacaaaacggtgagtgaaaactaatacagttcctgcccctaygaagccgatgatccccgaggagaaatatacattaatcacataccctggaggttaaagatatattcagtactccttgattttggtgatggtatcacagatg

SEQ ID NO: 6142 - DNA, 201 bp, Homo sapiens
atatttgtgaattttctgcatttttgttatacttcaaaagtttaaagaaatcattccaaaccagaatgagcactgtgggaatgagtttttcagaaatcatrgacttaacttctgaataaatgctctcccagcccctgctgagatgccaaagacattccaaaggcacagactgaaaggacagaatgctcacagccaaaacta

SEQ ID NO: 6143 - DNA, 201 bp, Homo sapiens
accagcatgcactgagaaaaggccatatgagcacacagagagaagacagctgtctgcaaaccagtaagagagcccttactcaaacccaaccacgccagctycctgatcttggacttccagcttttagaaccatgaaaaaaataaatttttgttgtttaagacacccagtctatgatattttgtcatggaagcctgagctca

SEQ ID NO: 6144 - DNA, 201 bp, Homo sapiens
aaatgttagttgtactttgtcaactactgtagtaatcaatagggacaaaacggtgagtgaaaactaatacagttcctgcccctacgaagccgatgatcccygaggagaaatatacattaatcacataccctggaggttaaagatatattcagtactccttgattttggtgatggtatcacagatgtatgcatatgtctaga

SEQ ID NO: 6145 - DNA, 201 bp, Homo sapiens
taagaaaggcagagaccctgtactagtctgttcttgcattgctataaagaaatacctcagactgggtaatttataaagaaaagacgtttaattggctcacmgttctgcaggctttacaggaaacatggtactggcatctgcctggcttctggggaggcctcaggaagcttacagtcatggtggaaggtgaagggggagcag

SEQ ID NO: 6146 - DNA, 201 bp, Homo sapiens
gaattgaactgactttgttggtgagtgttttgtttcttccacgagaacagatattccttcagaatcaggggctgactcttctatttttcaaacaacccccraaactagccacagcaacatgcaggggccctgcatcaacaggtacttgaatgctggtgaatgcgtcccaggcacctcacttcgttcgcccattttggtgca

SEQ ID NO: 6147 - DNA, 201 bp, Homo sapiens
taattgattcacccatacatatatccaagcaaccaaccattcatccctccacccatttaccctttcactcatccacctttccacccttgatccattcaacyctacatctttccactcatccattcaaataatcattcacccttctctttatacaacaactcctttaccaatccatcctcttccccttccagccaggctggt

SEQ ID NO: 6148 - DNA, 201 bp, Homo sapiens
actgaatttggaccccagtccaatgactggtgtcctgaagaggagaaaacacaggaacacacacaaggagaaggccacataaatatggaaacagagactasaatgatgtacctacaagccaaagaacgccaagggttgatggcaaccaccagaagttagaagatgcaggggagggtcttcccttagcatccttggaaagag

SEQ ID NO: 6149 - DNA, 201 bp, Homo sapiens
ttatcagattctgttgttttctgtactattcttttttcaatattaaaaaaagaattcttattcctaagtttgtctttagataaatttcccccaccttgatmagactgtatggtgtttgaggagagaaattatatcttaattcatctatgtatcccaggggctagcacagagtctgttggttggaagcaatgatagacagag

SEQ ID NO: 6150 - DNA, 201 bp, Homo sapiens
ctatcttacacacacaccctctttaggaaaactcctgggttcacagttgttaataacttatacttggtaaatatgtggtaaattcatagtcaagtctgtcmtactacctagaccatgaagttttcttgatgccacactgccctcttcccaatggccatatttctcccaaggtaatcctttggtaagagggttttggtctga

SEQ ID NO: 6151 - DNA, 201 bp, Homo sapiens
gtacagtaatagcacacagcccagctcccagtacatggggagctgagaacacattcagtgaaggtataagtaagcaggtgaatggatggacagacgaatgsatggatggatggacggacggatgaatagattggatggatagatggatgaatggatggacagatggatggatggatggtcaaataggacaaatggatggac

SEQ ID NO: 6152 - DNA, 201 bp, Homo sapiens
ctcttgactttgagtttgatcacgtgacttagtttggccaattacgtgagggagacgtgccagtgtgccggttttggcttttgcccagggtgtctaagacygtagggaagagattgtctgggaaactctgcccaagacatcaccagagagcccacgtagtgtggtttctctccttgtatcaatgagaatgaaacccaaaga

SEQ ID NO: 6153 - DNA, 201 bp, Homo sapiens
cggctaaaaatatgaggtttctttttgtggttttggaactgttctagaattagggagtggtgatggttgcacaatatagtcaatatactaaaaagcattgractgtgaactttaacatgataaattttatgtgaattatatctcaaaaacatttaaacgtaagactaggtatcacttattgaccaatttctccttgctggc

SEQ ID NO: 6154 - DNA, 201 bp, Homo sapiens
gggtgtttcagcatctccataccaacagctagaacagattcctctcctaaccctctgtgccgtatcaaccagctggtctagtctgactcacaaatggctayagcctggtggtaaacggaactttgttaaccatttgcaaaaaattccaggcaactggggagatggaacaaaaatgccccccaaagctgcctcaatatcatt

SEQ ID NO: 6155 - DNA, 201 bp, Homo sapiens
ttaaaaaaaaaaaaaaaaacaaaattgataaacctaggtagactgatcaagaagaaaagagactatcagaaataaagtctggtgcattactacagactttmagatattaaaaggattaaaaaacccttatgcctataaatttgacaacctagatgaaatggacaaattcctggaaagatacaaattaccaaagctttttca

SEQ ID NO: 6156 - DNA, 201 bp, Homo sapiens
tgatcagaaggggaaatctagtgtgttaaaattgataaaccagcttaagtaatacctacataaaagaaccatgcctagcacatggctgaatgttgaatacygttgcatggaaatttgggatttctagttagaggctttataaaggtagaatcatgcagacacatatacctggaaatattcggaacattctattagcagaaa

SEQ ID NO: 6157 - DNA, 201 bp, Homo sapiens
agggaacagaaggaaagtcagaacagctgaagtttaaggagcaagagagagtggtgagacatgagttaggacaggaagcagaggccacatcacacaatgartgccctgtagtcaggatagggagtctgtatctaattcctaggtcaactgtattgcaaacaactcctctgctaaatgtgccaccagtgtctcccaataggg

SEQ ID NO: 6158 - DNA, 201 bp, Homo sapiens
gaaggtgtagtcacagggtgaggggtgtgagggaaatggtggcagcaagaagttgagcctgggcatctgggaggatggtggtgccatgccctggaggaggrccagtttgaagaaggaatatcataggagtccaataaatactactagaatgaatgacttaataatcagtatgtaagttacattcattcccctctgcttctg

SEQ ID NO: 6159 - DNA, 201 bp, Homo sapiens
aacaagcatctattgtctgctctgtgccatcccctatggtaggcactgggacgaaaagaatgaatgatccttgacatcaagaagctcaaagactagctggraagatactaatatagcaattccttttattttctctaataggagacccactcgcaactatgaggaatagatactatcagcagcaacagcaacttttttttt

SEQ ID NO: 6160 - DNA, 201 bp, Homo sapiens
ttgtaactcttgtaagatgcttttcagttcacatctttttaaatgattgtctgtccacactgttcactccatctgtgcagctttatgttatttgaaggcayagtgcccccctgctggattcactttataacaatcagttctcccaccaggatgattagcgcccagaaagtgtaagtaaatatttgtggagaaaactgattt

SEQ ID NO: 6161 - DNA, 201 bp, Homo sapiens
attaaatgtatactgctcgggtgatgggtgcaccaaaatctcagaaatcatcactgaactactcatgtaaccaaatacctactgtcccccctccccccccmaaaaaaaacctatggaaattttagaaaaggaaaaataaataaataaaactagtattgatttgggttatttcagtttgtgttctccaaatagttgttaaaa

SEQ ID NO: 6162 - DNA, 201 bp, Homo sapiens
acgtttcttgtctccaaggtaaactcaggcctggatcagacagctctgcttttagccatccacgtgaaccaggataaggtatttctctctctaagcctctktttcctcatctgcaaaatgcggttgtggtaagggctgaataccattgtggtgatggttccacaggtatatgcctacatcagcactcatccagctgtgcgg

SEQ ID NO: 6163 - DNA, 201 bp, Homo sapiens
ctcttgttaaggaaatgtttcaggcccaaggccactcatacagccatacagggtccagcaagctgtgcatgaccacctttcccaatgcagtgaaggatagrtcccacgtcttgggcttaggcagttaggtggatggtgagtgcaattactaaagagagaaagacctgggaaggaacagttaagggtggggagcaagaggaa

SEQ ID NO: 6164 - DNA, 201 bp, Homo sapiens
tttttaaagcaaatattgaaacccccagtatgactaagaaaaagaaagcagattggaaccaaatactttactacgttaaatgacacattggaaattttcargacaatttcttaagcaagtaatacgggttccatccggctccatcatttgccattcacttgacaaatgtcataacgccactgcacaccccaccagagcaaa

SEQ ID NO: 6165 - DNA, 201 bp, Homo sapiens
ttcttttctcttctttatcctttattattaccacctccttctccttttttccccctctaatttctccctcatatatctctatccctttttccttccccacmctatttgtctttctttcttcttgttctcatcttcatcttctcccttctcttaggagaactggacaaccaactttaagtcttctttttttttttttttttt

SEQ ID NO: 6166 - DNA, 201 bp, Homo sapiens
acacatagacctgaggtagaaaacaaataatcagaggagaaggcaagagaaaggtgaagccaccttaggtagaatggtcaggaaacatcctttctgagaaracatttaggctgagaagctaattaagaaataacagagaaaactaatgaaacccaaagctgattctctttaaaaaaaaaaaaaaaaacaaaattgataaac

SEQ ID NO: 6167 - DNA, 201 bp, Homo sapiens
gtaccattgctcttgcagcctgcaggtcccaaaggaaattgtgtcattttatcttgcctagctccaaaaggagcagcctctgtcagaagatctcaatcatsataggcacatcccaggtgtgtgtcctgcttctcatcaggcctccccatcttactagaccactaggttcagccctgacttgtaggaggggctgggcctcca

SEQ ID NO: 6168 - DNA, 201 bp, Homo sapiens
gaagcagctttatttctgcaataaaaaggagtgtcttgggctttcccataacacttgctaggggcaggccctggtggtaaacattatcgtcgaaatgtccrtttcaaaaatatcccagtgttctcaaagaaatgtctccaaacagctctgaatgctcaagttccagaagaaattgcttcttctccctttgggagtctgtat

SEQ ID NO: 6169 - DNA, 201 bp, Homo sapiens
gaggcctcaccagaagccaagctgaagccagcaccatgcttcctgtatagcctgcagaaccgtgagccaattaaacctctcttctttacaaattacctaaygttgggtatttctttcttctttttttcttttttttcttttcttttttattgggggggacagagtctcactctattgcccaggctgtagtgcagtgttgtg

SEQ ID NO: 6170 - DNA, 201 bp, Homo sapiens
gtgtcctaagtggccaatcagaaaatctcttctccatgcacacattgattcatctaaaggaaggcatgaaattcatgtgaggctcatcatactctttgagrgggggatagatgtggatgcttggatagaaggagttgcagacttaccatcatgtgggggtgtgagcctatcagtgaagccattgcagtgaaaagtagagcc

SEQ ID NO: 6171 - DNA, 201 bp, Homo sapiens
attccttgtgtgtttgtttgtgtgtgagtctattcaatgtagttagaactgggttttagttactagtcacagtgaagagttctgatgacacagtgacaccrcctttaaatccatccagggaactgaatgacttaagggctcctgggcagcccaaatacaagcacctccatctatatgtcttctcattttctactctttctt

SEQ ID NO: 6172 - DNA, 201 bp, Homo sapiens
aacaatagcatataaaattagatttttatttatttatttttattattatactttaagttctagggtacatgtgcacaacgtgcaggtttgttacatatgtrtacatgtgctgtgttggtttgctgcaattagatgtttttaaccaaagagttttcaccatttttcaaatcctaattaatgaagttcttccaaggcaaaaaa

SEQ ID NO: 6173 - DNA, 201 bp, Homo sapiens
cccaaagtgctaggattacaggcgtgagccaccgtgctcagaccctttggagtctgggaggacacaaaaatgggtcttctcactatgactcatcagattcycagaacatcttcctttcggtgttgcctcaaaccaagccaggtttgtaagcctgtaaggagggcagtctgatataagaaacatcatctcgattcttttcag

SEQ ID NO: 6174 - DNA, 201 bp, Homo sapiens
tgagggcccaacttcattaattccaccatcttgactcaaagccatgtgaggcaagtccaccctcccagatgcagcagtgagaaactcattcctttctctcytccctgtggtgacccaacacccatgttgttttaaagacaaatttaaaaactctcaaaaggacaaaacaaaggcccaataaatctgacaaataagaaaaaa

SEQ ID NO: 6175 - DNA, 201 bp, Homo sapiens
tgtgacctctgttctcacgatctcagagggtcactgaactatttgccgaagtgaaaaaatacttttgatggtggtggtgataggaaatagtacaagattckggacacaaatagattgaatttgggagataaatattccttatttaaatgtcagaatattccatttctgtataatgctgagaagtcacaaaaccaaaataaa

SEQ ID NO: 6176 - DNA, 201 bp, Homo sapiens
taatgctgagaagtcacaaaaccaaaataaaaatagggctaggcttaaatgtatccagttagaggcagggacaggctgtctttggcataaatgtttcaccrccaccttccaactgagatttctgctccatggatgaaacttgagtattgttaagttcattgctacttgtcacattgcaggatttcacaggccacgtgatta

SEQ ID NO: 6177 - DNA, 201 bp, Homo sapiens
aaaaatagggctaggcttaaatgtatccagttagaggcagggacaggctgtctttggcataaatgtttcaccgccaccttccaactgagatttctgctccrtggatgaaacttgagtattgttaagttcattgctacttgtcacattgcaggatttcacaggccacgtgattagtcgcacaagttggatggagttggggga

SEQ ID NO: 6178 - DNA, 201 bp, Homo sapiens
aatcacttgaacctgggaggtggaggttgcagggagctgagatcgcgccattgcactccagcctgggcaacaagagtgaaactgtctcaaaaacaacaacmacaaaaaacccaactacaacttgtgcagcttcccaaccagtgtctctttcagaagaaaaattaaaaagaggattggacaataaaagattggacaactcta

SEQ ID NO: 6179 - DNA, 201 bp, Homo sapiens
aaggatagcaataacttcagatcccgtgctgttttgagagccactggctaaactgggtttccagtactacagcagctaacaaccctgccctaatgaccaaygaggggaagtaaatctgggtgtttacacgtgcctttcacaggatgcttcttttacctagtagacaacctcatgcctagttttcctatccatgaccagggg

SEQ ID NO: 6180 - DNA, 201 bp, Homo sapiens
ctgttttgagagccactggctaaactgggtttccagtactacagcagctaacaaccctgccctaatgaccaacgaggggaagtaaatctgggtgtttacaygtgcctttcacaggatgcttcttttacctagtagacaacctcatgcctagttttcctatccatgaccaggggatctctcccaggaggaacttatttataa

SEQ ID NO: 6181 - DNA, 201 bp, Homo sapiens
caaggtaacctatgctgtgttgctcagttctacatgccaagaaatagctcctcttttcagcaagtaaaattatctcactgcttttcagtttcttttttatygaagtgttgtcaacaagttccttgaagctgtaaaatccagaagcgaaatggatcacttccatttgatctgtattccccattgcttagtatacacaaggag

SEQ ID NO: 6182 - DNA, 201 bp, Homo sapiens
agctcctcttttcagcaagtaaaattatctcactgcttttcagtttcttttttatcgaagtgttgtcaacaagttccttgaagctgtaaaatccagaagcraaatggatcacttccatttgatctgtattccccattgcttagtatacacaaggagcttaatgggcatcggagacttagttgtggaatgaagagagaagga

SEQ ID NO: 6183 - DNA, 201 bp, Homo sapiens
caaaataaggcaatgttgatgttggggcaagaatctggatctctaaatgactggtggcaacagccaaccacacagccactgatgaagacacctagagttcwgttgcacaagccagctttacctcttacagaaagtcgaaaaggagcacttgcaaattggagaaactacctgcactgctggcaggaatgtaaattggtttac

SEQ ID NO: 6184 - DNA, 201 bp, Homo sapiens
tagtacaggtataagtgttcttttactttgggggttaagtgaggtaataataaggaaagttgaagaaaacagactttctaaaccagaggagagaaaaatayaaacttttttaagcgtgatatttctttacaaaaagagaaaatttctttaaggataaggggaaaccagtcatgtttagttaaattcttccaattgttggaa

SEQ ID NO: 6185 - DNA, 201 bp, Homo sapiens
atgtcacttttattgtttaagccagaggtcactaatctttttttttttttttttatggtaaacggccaattagtaaatattttcagcactacaggccatayggtctctatcacaactactcaactctgcctttgtagcacaaaaacagccatagacaatgcgtaatacaggaatgagtgtggttgtgttccagtaaaactt

SEQ ID NO: 6186 - DNA, 201 bp, Homo sapiens
atactagccaaatatcaaaatgtgtagcatttggaaaataatgtaatggtttctggtttaataaagatgatgacattttatgcaaaaaattaaaataattrtgaaagcagatagtatagttacataagaatgcttaaaatgtaataataagtgaaaaatcatggactataaaagtatatataaccaataattataattaaa

SEQ ID NO: 6187 - DNA, 201 bp, Homo sapiens
gatgatgacattttatgcaaaaaattaaaataattgtgaaagcagatagtatagttacataagaatgcttaaaatgtaataataagtgaaaaatcatggamtataaaagtatatataaccaataattataattaaagaaatgtgtctgcaagtaacagggatcaggagataatacataaattaaaaacaattatgttaaag

SEQ ID NO: 6188 - DNA, 201 bp, Homo sapiens
tagactgagagggatttggggccactgtttatccatgccataaattttgcacaagcctatgtgacatcaatgtttgacttaccaacaagccattcattatrtcttatttccactttgatggttctcttgacatttgactttctctggtttgagcaattcactgcttgtcaggcatgggcctggcatgctgaccttgtacta

SEQ ID NO: 6189 - DNA, 201 bp, Homo sapiens
gaagccctgagagaaagagaatgaataaaactcagggcaaagattcaatatcatggaccccaactgagtgattggatggcaactgatatgtgtactcaacrtctgccaatcacaggataaaatgtttctaaatggtaaatattgttactttaaagagtgattcttaaaccttatggatggagctgaagaccattattctca

SEQ ID NO: 6190 - DNA, 201 bp, Homo sapiens
attggatggcaactgatatgtgtactcaacgtctgccaatcacaggataaaatgtttctaaatggtaaatattgttactttaaagagtgattcttaaaccktatggatggagctgaagaccattattctcagtaaactaacaaaggaacagaaaaccaaataccccatgttctcactttcaagggagagctaaaggatgag

SEQ ID NO: 6191 - DNA, 201 bp, Homo sapiens
ccccaaactggcagggttgaatgatctcaaaaattaggctgggcctgctcccacggtgctggggcctgaggcatggacgagtctccttcaccatgaacaayggaaaaaaagtgtaggtcattttctctcccaccctaaacttctgtcgcaaagtgattttgcccagtaccttctgcagggtaatgatgctgtttcattagt

SEQ ID NO: 6192 - DNA, 201 bp, Homo sapiens
agactctaagaaattaatttgccccaggtcacaccactaggaaactgcagaaccttcatcttacttatttcacttctcttgctttgctaaatgccacaagygtagagataagggagttcacaggcagggtatctagcttagaggtctttatgggagtattcacagaggagcgcagaggctgaaggatggatgagatgtcat

SEQ ID NO: 6193 - DNA, 201 bp, Homo sapiens
cctttctgtgcttctgccatggccaggaaaagagcttccccaggtagctgctaccttttcagcccgagacacagcagaaacacgtgtggagcagagaccayaccactgattcgtacgcttgtggcaggaagcagaggcactatccccaccccaggcagagcttctccactcaacctgcactaccatgaggaaaataaatgc

SEQ ID NO: 6194 - DNA, 201 bp, Homo sapiens
ctatccccaccccaggcagagcttctccactcaacctgcactaccatgaggaaaataaatgcttactgttgtacgcctctaagatctcacagcaaaaagckgaccaacacagccacaaatcattattacacagcagagaacatggccagtgatctgaggaaggtacaaatgccctatggagaattcaaagactcacatgtt

SEQ ID NO: 6195 - DNA, 201 bp, Homo sapiens
tgcttactgttgtacgcctctaagatctcacagcaaaaagctgaccaacacagccacaaatcattattacacagcagagaacatggccagtgatctgaggraggtacaaatgccctatggagaattcaaagactcacatgttctcatttgggagttaaatataaaacacatttagaatgcctgatggcactgtgagaatct

SEQ ID NO: 6196 - DNA, 201 bp, Homo sapiens
gatggcactgtgagaatctaggatttaactctgtgaatagaaagaagataagaagccacaagtaattgtgcacttcattcgaattcacactaaccctatgmactagctaacctctgcctattttgatattgcatttcactgtagtggtaactagatttttctctcccacctgtagcctggcataacacgttctgtaatcat

SEQ ID NO: 6197 - DNA, 201 bp, Homo sapiens
cactaaccctatgcactagctaacctctgcctattttgatattgcatttcactgtagtggtaactagatttttctctcccacctgtagcctggcataacaygttctgtaatcatctctgaatatagcctccactatttgaacggggcttctgccctctggcttgagcctttctatcctcctcataccgagctcatttttgg

SEQ ID NO: 6198 - DNA, 201 bp, Homo sapiens
tagcctggcataacacgttctgtaatcatctctgaatatagcctccactatttgaacggggcttctgccctctggcttgagcctttctatcctcctcatascgagctcatttttggtgttaacctgctatctgagctgactttgcttttcctatttcctccgtgttggcaattgaaaggaaaccaacctgccattccaagc

SEQ ID NO: 6199 - DNA, 201 bp, Homo sapiens
cggccagcctctagaggccatgccaggaaaccccgggctatagtgagatcaccagctatgaagtagaaagggcagacaggaggaaatgcttctggtgacayagctggcccaagcggctttacagttctataaatgccacagtctcattagactgcaatagagattgcctttccttcattcctccacgggataagaacatga

SEQ ID NO: 6200 - DNA, 201 bp, Homo sapiens
gtgtgtatgaaggggaaaggaactaaataggaatattttttcctcccaaaagaaatacatgtgctgcttatttatcatacagaaattattgcagaattttwaaaaatccaaataatatagaaaagtattaaaaatacaattaaaattaaagctacctataattctataactcagattcaacctttgttaacatgttagtga

SEQ ID NO: 6201 - DNA, 201 bp, Homo sapiens
ttaaaattaaagctacctataattctataactcagattcaacctttgttaacatgttagtgaacagccttccaaatgttttagtgagtatgcacaaacacrcatacacagagattggcaaactttcttctataaagacaagataataaatagttgaggctttgtaggacataccgtctctgttgcagctattaaactctgc

SEQ ID NO: 6202 - DNA, 201 bp, Homo sapiens
gaacagatccctccctggagccttcggtggaagcgtggtcctgcagatgccctgatcttggacatctagcctccagagctgcgagacagtcatttctgttstttaagctgctcaggttgcattcctttgttatggctgccctaggaaaccaagacatagtgccaaagcagccatagagaatgtgtaaacaaacgaactttg

SEQ ID NO: 6203 - DNA, 201 bp, Homo sapiens
ggtcttgaactcctggcctcaagtgatccacccacctcggcttcccaaagtgctgggattacaggtgctaattatgattagatccctatcagtagtcctgkatattgtttccaaatgttaaagttatttaacgaggctgaaatgatcactgtggaatgcagggatgaatgtctcaactctaaaatgggtaagaaaactaaa

SEQ ID NO: 6204 - DNA, 201 bp, Homo sapiens
gcaggtttacagccgtgttcttcattttaatttttttttgtttctataatggtttgaggtggcgcaaaactgtaggacttgtctcatccacagaaacactmtgaagctttgatctcaaggtaggggtatcagagacttggttttaggctctgagagtattaaagggaatcagatcaagcagcagcagaagagaactgggca

SEQ ID NO: 6205 - DNA, 201 bp, Homo sapiens
catgaatggaggtgcacaccattatcctgagcaaactgatgcaggaacaaactatgaattaaaataaataataacaaatggaatcactaataatcactttwaaaaaagagatggccattgtctgcaagatgttttataaaataatacttagcatttcacagacatcatcccactgaggcctcacaactgtccagtagcaag

SEQ ID NO: 6206 - DNA, 201 bp, Homo sapiens
tggaatcactaataatcactttaaaaaaagagatggccattgtctgcaagatgttttataaaataatacttagcatttcacagacatcatcccactgaggyctcacaactgtccagtagcaagatattattattgttattatttttctattctgtctataagcagacaaggttcagaaagcctaaggcagcctggggcttg

SEQ ID NO: 6207 - DNA, 201 bp, Homo sapiens
ggccattgtctgcaagatgttttataaaataatacttagcatttcacagacatcatcccactgaggcctcacaactgtccagtagcaagatattattattrttattatttttctattctgtctataagcagacaaggttcagaaagcctaaggcagcctggggcttgttggtgatatttccagactttatattataaaacc

SEQ ID NO: 6208 - DNA, 201 bp, Homo sapiens
cctaaatctctgagatttgtcaacagggactttgggcaaagcaactgcatttctcaggctcagttttccctatgaaaaatggagccaacttgccgggcacrgtggctagcgcctaaagtcccagcactttgggaggccgaggtgggcggatcacctgaggtcgggagtttgagaccagcttgaccaacatggagaaacccc

SEQ ID NO: 6209 - DNA, 201 bp, Homo sapiens
tcccacctgttgtgggagggacccagtgggggataaatgaatcatggggccagtttcccccataaggttcttgtggtagtgaataagtctcatgagatatkattgttttagaagagttttcctcttttacttggttctcattctctcttgcctgccaccatgtaagacatgcctttcaccttccaccatgattgtgaggcc

SEQ ID NO: 6210 - DNA, 201 bp, Homo sapiens
acagaggactccccaacgatccttaacacagccatatgactgatagccctcatcccacccccccaaaaaaagtctagtgagaagaaaatgcttaaaaataytctgatgcatgcatatcatggagttctttccagcagtcaaagagaatgaaggcaaaaaatggaaagctctccaaaacatatcgttcactgaaaaccaaac

SEQ ID NO: 6211 - DNA, 201 bp, Homo sapiens
aaaaatcagctgggcgtcatggcgcacccctgtagtagcctgtaaacccagctactctggtggctgaggcaggagaatcacttgaacctgggaggcagagrttgcagtgagccaagatcgtaccactgcactccagcctgggcaacagagcaagactctgtctcagaaaaacaaaaacatatgcaaatgcatataataaaa

SEQ ID NO: 6212 - DNA, 201 bp, Homo sapiens
agattggcattgagatgccaagccaaaggaatgcttatctgtattttcatttttttttttttacaatgaggatacattttttaatgagaagcaatatagcrtaatggttaagggcatagctcctagagccagttcaaatcccagctctgaagcttaccagcactgtgcctgcgtcatgacttaagctgtctgtatagtgga

SEQ ID NO: 6213 - DNA, 201 bp, Homo sapiens
aagaatccactttgcatacctgtgtgctgtgcattcctgtggaatacaccaccactccccacagcacacccagataaagtactgggcagcatggcctcttyccctggtccccaagacacctgaggacagcctccactggcagcactgatgtcggatacctatcaggaggtgatgttgggaaaaccacactacagcctaggt

SEQ ID NO: 6214 - DNA, 201 bp, Homo sapiens
cttcatgggtgagagcaacttcgcatctcctaaccccacgaccttgtaacagataggtacaacccttgccagagctgttcccttctcaggacaagcagagsgttagcacaacatcatgggtcagaaaagatgttgggtcttcaactgaatgctggcactgctactcattagatgttaaccttcagacgaactgtggcttct

SEQ ID NO: 6215 - DNA, 201 bp, Homo sapiens
ttttacattgtgactcaaagcaggggctctggcgtaagattgatcccagacacgctgcttaatctctcaatgcctgtttcctcaaaggtggatgaaaatcytgatggtcaccgtcatataggtttgtcatgatgtttaaattagataatggaggcaaagcatttaacacagtacctggcactcaggtaagctcccaataaa

SEQ ID NO: 6216 - DNA, 201 bp, Homo sapiens
taaattagataatggaggcaaagcatttaacacagtacctggcactcaggtaagctcccaataaatggaatctgttagttagaaatgcctcacttaagccrgtcacggtaactcacgcctgtaatcccagcactttgggaggccgaggtgggaggatcacctgaggccaggagttcaagaccagcctggccaacatggcga

SEQ ID NO: 6217 - DNA, 201 bp, Homo sapiens
tacttgggaggctgcagcatgagaatcactcaaacctcggagatggaggttgcactgagctgagatagtaccgctgcactccagtctgggtgacagagcgmgactctgtctcaaaacaaaaacaaaaaagaaagaaaaaagaaataaacaataaaataaataaaaacacacaataaaaaaatttaaaaaacaaagaattgc

SEQ ID NO: 6218 - DNA, 201 bp, Homo sapiens
gaagaatcatgcattaagctctgaattgtgcggtaatccaagcaaaaagaaaaccataagttgttataagaattgtgttgtcaacaagatcaaagcgtgcstcaaacagaacaaagcaatgctcttcatcgtacagaagtgtgagggatgctacaggacgacattctccacaagctgtcctgtaataaccgtatcagcaac

SEQ ID NO: 6219 - DNA, 201 bp, Homo sapiens
aaaataactatttcttgtagtacccttcagtgctagttaaggcatgatgaaaacacaaagcagtaaaagctaaattaattaatattcctctagctcaatgraattatcacctggtccttaaatgtggaaactaaacaacagaactgtctactttaattgagaaaagcaaaacaaatttgcatatgcaccgactcaacttgt

SEQ ID NO: 6220 - DNA, 201 bp, Homo sapiens
agaaatgataatgctgtgattttatcagttctcagatcatcaattaatatgatatgtactctataatatatgcacatatgtaatatctaactttagttttmaattctcccctgaaccataaccccgtatttccaactgcctaggtggcatttccaagtggggaagtaagcctaacttctatacttactaattctgcaatgt

SEQ ID NO: 6221 - DNA, 201 bp, Homo sapiens
cagttctcagatcatcaattaatatgatatgtactctataatatatgcacatatgtaatatctaactttagttttaaattctcccctgaaccataaccccrtatttccaactgcctaggtggcatttccaagtggggaagtaagcctaacttctatacttactaattctgcaatgtagttacttagctgaatagcctattg

SEQ ID NO: 6222 - DNA, 201 bp, Homo sapiens
acactgttcttttgtttttacagacatgtcactgaggacaactcaagccttttagaaaaatatttattggtaaaaagacaatactccctaaattttttttwaaatgtgcatcaaaagacactatcaatgtaatagctagaatataaaaaggtaacccatggaataggaaaaaatatttgcaaattgtatatctgataaggg

SEQ ID NO: 6223 - DNA, 201 bp, Homo sapiens
atcatgtgattcaggtacagttggtccattggccaggcttggaggcacccaattttggggcatgattctaaatcctttctgcaaaactgacagttgtttgyatatgtggtttgtctgagtcttcctaagtgtttgacacagataaaagaatctcatgaactagtttagagatcaaagaattcaaccatttcacttcttaga

SEQ ID NO: 6224 - DNA, 201 bp, Homo sapiens
tccattggccaggcttggaggcacccaattttggggcatgattctaaatcctttctgcaaaactgacagttgtttgcatatgtggtttgtctgagtcttcmtaagtgtttgacacagataaaagaatctcatgaactagtttagagatcaaagaattcaaccatttcacttcttagatggggaaactagaaagtgacttgg

SEQ ID NO: 6225 - DNA, 201 bp, Homo sapiens
aaagtgcaaatttatatctcagcatactttttacctattagcaaaattttgaaagattaattacacattgtattggcaaaactttggagaaataagctctytcatgcactgatggggtaagtatgaatttcctttggagggagatttggcaatatctgttaaaattgcaactgtgacccactctttcaagaaatttattct

SEQ ID NO: 6226 - DNA, 201 bp, Homo sapiens
ctgttaaaattgcaactgtgacccactctttcaagaaatttattctacactgaatgtgacgcaatacaaagatattcactacagctttgtttgcaatagcraaagattggaaacaacctaaatgtccaacaatagaggcctgaccaaataaaatatggtatatttgcataatgaaagattatgactctataaaaaataact

SEQ ID NO: 6227 - DNA, 201 bp, Homo sapiens
cccagctactcaggaggctgaggtgggatgattacctgagcccagggaagtccaggctgcaataagctatgattacactactgtactccaacctgggtgayagagtgagaccctgtctgaaaaaaaaaaaaaaatttaaataattaatcaaggagcctgttaaacatgtatgtggtttccccaaatattaactccaatgaa

SEQ ID NO: 6228 - DNA, 201 bp, Homo sapiens
taagatggatgttataattattatatggcttccagaaaccaatttgtacaatttatggccacgaatggtttccatttctctcctttttgctattatattaraaaaaagattgaaaaagaaagaaaacaacccattttgtgctctggttaataaatggagggagagaaagccagctaggcatcaaccactgtctccaaccat

SEQ ID NO: 6229 - DNA, 201 bp, Homo sapiens
cctttttgctattatattaaaaaaaagattgaaaaagaaagaaaacaacccattttgtgctctggttaataaatggagggagagaaagccagctaggcatyaaccactgtctccaaccattatcatctgcatttgtgcgcatggtctgtccaaaacaacagtatatgttgattaaaagaccacaatggaaacaaacaaaaa

SEQ ID NO: 6230 - DNA, 201 bp, Homo sapiens
aagaaaacaacccattttgtgctctggttaataaatggagggagagaaagccagctaggcatcaaccactgtctccaaccattatcatctgcatttgtgckcatggtctgtccaaaacaacagtatatgttgattaaaagaccacaatggaaacaaacaaaaatcccaaacccatggctaaactgtaaagtcatcaacaat

SEQ ID NO: 6231 - DNA, 201 bp, Homo sapiens
tgcgctcactcattaacaaaagaagcattattcataatggccccaaaataggacattacccaaatgtccatcaagattaggacagagacatccatgtgtgstgcattccagcaatgagaatgaaagcactgaaattacatgcaacaatcttgcaaacacaatgttgagccaaagacgacaaaaaagaaaagagtgtggctt

SEQ ID NO: 6232 - DNA, 201 bp, Homo sapiens
ttagaggggcctctgtctccccctaccagacacaaagccagcagcaaggccttcacaatgggcttgccgaacagccgaaaaggaggttatttattaagccrcaaggagaatgcacctacagtcatgtttccatgcaggaatctgtgacaactgaaatgccccatatgagctaattttctggataatcaaaatcccctcatt

SEQ ID NO: 6233 - DNA, 201 bp, Homo sapiens
gaaactgccatccttaccccgttttcaggctgaccaaggcgtcctctactcctttctgattaaatttggtcatgtactgatgcatgtagggatagttattscgaatgtttctctccgtgcttccattaggcactgtcccaaatcgaaaaggtggggaatagtcatgaggtctctgaaactggagagagaacgagaaaggaa

SEQ ID NO: 6234 - DNA, 201 bp, Homo sapiens
tccgtgcttccattaggcactgtcccaaatcgaaaaggtggggaatagtcatgaggtctctgaaactggagagagaacgagaaaggaagagagagagtagraaaagaaagagaagggaggagggggaggagagaacaaataataaattagtgatcattttgtctggtgttaggaggtaaatgcatgcattagggcaggatg

SEQ ID NO: 6235 - DNA, 201 bp, Homo sapiens
ataaagggttaatcttacaactacagagaaataattgtggggagagtaggaggaagagaaagagggaacaaaggaggagaaagaggaaaagaagagaagtyaaagagaagaaaacccaggggaagaaggagaagaagaagacagaccaacaggagagtaaagggagaagtgtgggaaaaggaaaagggctgttttcttaca

SEQ ID NO: 6236 - DNA, 201 bp, Homo sapiens
aggagatttataagtacttcatattcaagaatagagataaaataattctccgagttgcgtagtgtgtcttattggaggaggatcattatgatgagcaaatragcatatacatgaaagtgtttgttcgtgtgtgaggcacacaatatacagacaatatactgagtggaatagctgtgtgattccaggattaaagccagaaat

SEQ ID NO: 6237 - DNA, 201 bp, Homo sapiens
gagcagtgctggagctcaaaagaatgccatgctatgctggctacatgacaggctcaccccctgccaggcatcttagtggctgtgcgggtgccattaccttytccatcaccggcagtcctcaaggagcacaaatgattagaaatgacagtaattcagaacaagagggggaaataagacctcctctctgtaaattagcaaaga

SEQ ID NO: 6238 - DNA, 201 bp, Homo sapiens
aaagcccttacctatccctcaaggcacatctcatgtgtcacctcccctgtgaagctctgcctgacttctccagggtctcacagaccctaggccaggggctytcaaacttgagtgtgcatgggcatcacccactggagtcaccgaccaggagatctcaggggaagcccaagaatctgcattcccaagtgatgctgatgctgc

SEQ ID NO: 6239 - DNA, 201 bp, Homo sapiens
gacctgtaaaactagaaaacggattatctgctccccagatgcaattgtggaacaggcatgggatatcagttacaggggtttttgatcaaaaaaggaatcawtgaaaagaaaaaacaagttaccacatccaaacaattttggaattcagttaggcagtccggatgcagtggctaatccctgtaatcctaacactatgggagg

SEQ ID NO: 6240 - DNA, 201 bp, Homo sapiens
gtgactgcttaaggcaactgggccttaagatcactagagacatctgggatatagcatgaaatatctactctacatcacagttatcctgcctacaagacaamggactggagtgcttatccacaaatccctaccgttggctgcttccagcaccttcactccccctgcaggtgggctaaacctgcttccaaagccagaaaagac

SEQ ID NO: 6241 - DNA, 201 bp, Homo sapiens
catttaaaaggagaacaaaaatgaggctcagagaagataaagtaacttgcttaaatgaggaggctggattgaaagcaggcctgactctaaagtcacattcytgccccctacacatgctgacaggtgttcctattttctccatcttagtttgagccatatcacccacacctggaggtctgcaatgacctaatgctttcacct

SEQ ID NO: 6242 - DNA, 201 bp, Homo sapiens
aaatggtttatttttgccaaagttagcatttaacgtggacataatgatggttcaactccatggatcccatgtgccaatcttcccccagctccactattgawattctatacatccactgagtccagtccgttttccccccaaccatcactcactctgacctggttcattctccaggagcctcagctgatttttctctagctt

SEQ ID NO: 6243 - DNA, 201 bp, Homo sapiens
acgtggacataatgatggttcaactccatggatcccatgtgccaatcttcccccagctccactattgaaattctatacatccactgagtccagtccgtttyccccccaaccatcactcactctgacctggttcattctccaggagcctcagctgatttttctctagcttgatcacccttcttggtttcatgttcagttcac

SEQ ID NO: 6244 - DNA, 201 bp, Homo sapiens
tcactcactctgacctggttcattctccaggagcctcagctgatttttctctagcttgatcacccttcttggtttcatgttcagttcaccattgcctttawtgataaacccactcttccgctagttaaatccatgtcaccttcttgacaagcaatagtgctgaggtcagaactctccccatagccataccctaaaagatgg

SEQ ID NO: 6245 - DNA, 201 bp, Homo sapiens
taccctaaaagatggtacatccagacaatagaatattattcaacgcaaaaaggaagtgtgacatcaagccgtgaaaagacattgagggaccttaaatgcayatttctaagtgaaagaagccaatctgaaaaggttacatactgtatgattccaactatatgacattctggaaaaggcaaaactatggagacagtgaaaaga

SEQ ID NO: 6246 - DNA, 201 bp, Homo sapiens
attcctgagggacagacagtcactgttagctcaatcatatcctgatatagccttcctattccatgaatcctcacagtcttctgttagagacctaattgccraagcttattcctcatatcaagatgaaactttactccttatagtttcactcttggccaggtgccgtggctaacgcctgtagtccagcactttaggaggcca

SEQ ID NO: 6247 - DNA, 201 bp, Homo sapiens
ggctggtctcaaactcctgacctcaaatgctccatctgcctcggcctcccaaagtgctgggattacaggcatgagccaccacatcccacgcctgaccaggkaaaatatctttatattaatcaattaaacaaataaactagaagacaattaagatatttgctcatccatgctgctacaaaagaactctggtcttcaaatcag

SEQ ID NO: 6248 - DNA, 201 bp, Homo sapiens
aaaaacttcactgatcactctggaagttatttagtattactatgtggtaaataccgtgctaaacagtacttttcatgcggcacctcaatgaatatgacaakctctagaacattggtcctcaaagcacagcccctagaccaagaacatcaacatcacccaaaaacttgaaagaaattgcaaattctctgggctcaccccata

SEQ ID NO: 6249 - DNA, 201 bp, Homo sapiens
tgcttttccatacgccacacactggtctaagatgcaaatgcttttcttgtccccatattacacctgagggagccgacgtggagttcagtgactcacccaargtccgaagtctaaaaaagtacagattaggttcgaacccatgcaacctggccccagtgcccatgctcttaaccgtgatgccactgcctcccagggggccct

SEQ ID NO: 6250 - DNA, 201 bp, Homo sapiens
cttctttaagctacttttatgttttagaatttctgccatttaaaaaaataattttagctgagttaagcagtcaactggttatttgaaccaaaatctttcasatttcataggctttgaattaaggcgcaccagcactcatttaacctccctacacctcagttgccctctctgaaaaatgggggggtggtaccacacacttct

SEQ ID NO: 6251 - DNA, 201 bp, Homo sapiens
cttaattgtttggcacccttttaaattttgcatccaaggagggattcttaatctcctcttccttgtcctggccctgatacgtggctttccaattttctacratgagagtagttacttttacatttagaagaatcaaatgatatgacttttttaaagagatgagttattaaaaggagacgtgatcagaagacatttagcttc

SEQ ID NO: 6252 - DNA, 201 bp, Homo sapiens
acacaatcaaataaggtccatttgtgttcatgctgagccccagggcttcctggctcccatcacactcagagctggttgcaggcgagagcccaagtcagccmatgtgttcttcaacctcaggtaagtttgtcttctccagtgttgatgaacacagaaggcactccttcctcagggctcagaggacagagaagccctgacact

SEQ ID NO: 6253 - DNA, 201 bp, Homo sapiens
gtcattcattccataaatatgtgttgagtggttactaggttccaagcactgtgctagacactgagaatactgtaatggaagtgataaaatgtttgcttgcrtgaaatttttgtgctaattgagaagacacatgagtcaaatgattacacaaaaacatatgttcatacaaattgggaggaagaaatgaaacatgggtctaag

SEQ ID NO: 6254 - DNA, 201 bp, Homo sapiens
gagagtggaaaggaaagaaaagaggacagggaagagaaggaggaggaagaaaaaggggaatggagaaggacagaaagtgagaaataaaactattacagaarggaccctatatcagctgtcagaaccatccgtaactaaagcagaaggaagaccctgtttttctttccatagagggtaatagggtggtgtgcagggctgggt

SEQ ID NO: 6255 - DNA, 201 bp, Homo sapiens
caaaaaaatcaagcagtgtaacccaaaaatccagataccagacagatccaagaatgtggctagtgccatttccatttgctcaaaattagcatcaaagttargaagagtcagggttaaaatacaaacaccccatgctccaaccaaagcgatctgcatatggctgtccatacgcaccatgtacttggccacctacgtgtcttt

SEQ ID NO: 6256 - DNA, 201 bp, Homo sapiens
gcctatactccacacggctcacttcctcacctcctcagagagacctttcctgctcagcctctcttaaatactccacctttatccatccacagcactctctstcttacctctccctgctttatttccctgtctagtacttaacactacctaaaattaacttatatgcttcttcattctgtttatcatcttgcttctctgaaa

SEQ ID NO: 6257 - DNA, 201 bp, Homo sapiens
tggtaggcactgggacgaaaagaatgaatgatccttgacatcaagaagctcaaagactagctggaaagatactaatatagcaattccttttattttctctwataggagacccactcgcaactatgaggaatagatactatcagcagcaacagcaactttttttttaaggacaaagaaagtaaatatgggaaaatgtaaact

SEQ ID NO: 6258 - DNA, 201 bp, Homo sapiens
caagttacttctttctgcacctccatttcctcatctgtaaactgggagtaataagcccactcacctcccagtgaaatgagatggcatgtagaaagcacctkgcacatcctgatgattcaataaacgatagtcgttgttatagtgatgatctttgtaactcttgtaagatgcttttcagttcacatctttttaaatgattgt

SEQ ID NO: 6259 - DNA, 201 bp, Homo sapiens
taatgatgaggttgaggtctggagaatgtctaagaattatgagagagtttggggtatgtgtgcttctttccgggagggttgaggggctctgtttcagacasaagaggcaacatgtaggaaggtcctctcaatatctaacactgttagacatataaaacccttgataataataatcaaataatcagataataataacagagg

SEQ ID NO: 6260 - DNA, 201 bp, Homo sapiens
aaggagctttaaaaactactgaagctggggtcccatgccctgagtttctgttttgatttgtctgcactgtgtcctaggatggagggaagttgtaaagttcycctaggtgattatagtatgcagtcaagtttgagaaccactggacttagcctctcttgggatctcagaataagtttgggtgggtaggcttctagaataagg

SEQ ID NO: 6261 - DNA, 201 bp, Homo sapiens
tgcgtgtgatggcatatgtctataatcccggctactcgggaggcagtggtagaagaattgcttgaacctgggaggcagaggttgctgtgagcagagattgygccactgcactccagcctgggtgacagagcaagactctgtttcaaaaaaaaaaaaagaagaagaaaagaaaaacattgggttagcaaaaagacacatgca

SEQ ID NO: 6262 - DNA, 201 bp, Homo sapiens
ccgtttatgtgatttatatgtttaggtatttatgtatttgtccattcatttactcgctcattcatcccccaaattctgaatgtttctgacattcctgacartatggttagtgctagcaatatacaaggccaaaaagacagatgtggtgtcttccctaatgagcttatattctagtgggcagagacagtcaataagcagata

SEQ ID NO: 6263 - DNA, 201 bp, Homo sapiens
atgcagtgagccgtgatcacaccactgcactccagcctgggggacagagcaagaccctgtcattatataaaaaaaattaatgttttatatatttttaacasataaaaatatataatgttttatatatttttaacacataaaaatatatgttttatatatttttaacacataaaaatatatgttttatattttttaacaaaa

SEQ ID NO: 6264 - DNA, 201 bp, Homo sapiens
ttgcattttgaaagatcccactggcttcagtagagaggatagattttgagcaagaagcaaagatgcttgtgcaaaggagagtaattcgaagacctttggtwgtcctggcaagagatgttgagtgttggatcacagagctggtgatggaaatggggagatgtatttcgactgatgttggtcaagttacttctttctgcacct

SEQ ID NO: 6265 - DNA, 201 bp, Homo sapiens
atgatgaccacaataataagaaaaataaaattataataatgacctgatagttatttgtaaaatgccttctccatgcctggcaccatgctaaatgtatatastttaagatgttacaagaagaagagatgtctatcttacacacacaccctctttaggaaaactcctgggttcacagttgttaataacttatacttggtaaat

SEQ ID NO: 6266 - DNA, 201 bp, Homo sapiens
tttatgggaaattgctatgtttcaacaggaatttgaagaaaggcccacaaaatattaaaaggcatcttctgtatctggaaatggagtgtatcaagggcagstgtcacctgcactgcagtggcctccttgtgtaccagctccctggaagatgagtcagattctaaggtagcacagaaaattcacaggtgtgagtcaagcctg

SEQ ID NO: 6267 - DNA, 201 bp, Homo sapiens
atagttcaatagaccctgctactaacaaccccaggtgcaaatctttgcttcacatgctattctctgactcttacttgcatagtctgttttgacttctccaygtgcttcagtgaaatgcaaattactgtttgatcccatggactagactatggggaaatctccattgtttcagggcaagattgatattcagctggttgttta

SEQ ID NO: 6268 - DNA, 201 bp, Homo sapiens
gtagagctaggattcaaacttaggtctctccaaaatcaaagactacatttatcctcccttcctccactgttctagatcactcttgcactggggcactcttsctctgagagacgtatcccactcacagacatggagtggatgcctcggttgctgcatcatttaacaagcatctattgtctgctctgtgccatcccctatggt

SEQ ID NO: 6269 - DNA, 201 bp, Homo sapiens
gggtactttgccctctaagaagcctactttcctcttttcctctcctcctctccctatttctctttgttgagagagcagtcagattaacccaacaactcttrgagtgccttggtcacctgagagcatggaaagtccatgccctcaccagagtaatgactaccatttctccaaaactctcctcatgccatccgataggcagta

SEQ ID NO: 6270 - DNA, 201 bp, Homo sapiens
gttaattaatcaacatctgtacttccttcctgggattattgagagtgctgcaacaatttctcatctgccaattatttgccaactttgtcttctggagttgsaggcataagagttaggtcaatctctttgtgtaatcttggttatatgatgtcacctctgtgaacattatctgtaaaattggaataatcccatgcaactcaa

SEQ ID NO: 6271 - DNA, 201 bp, Homo sapiens
tctttatgtttcccctctatatagaaataattaataataatattaaattgagggtccaacatcggctaggcacagtgctgggtgtttaacataagttatcrcattttatacttcagcagctctggaactaagcagctaatgcattcaattgagagagtgtttgcatgtttcggaaattgggccttgtatcctggaaaagag

SEQ ID NO: 6272 - DNA, 201 bp, Homo sapiens
gatttttttctttgcaaacgattttttgtattttcaatagctaatatacatgtagttgaaaatatgctttataagaaaaataacctccctctctaactcawgatttacagaagtgatacatttaagtttttaaaattagtttatttaaagcaaaagactgagtacatgaaaatacagagggttcgttcatatggcaatgac

SEQ ID NO: 6273 - DNA, 201 bp, Homo sapiens
accacaaagagtctgtactcttaaaactgcaataatagagtcaaggagtcttacgggacgagccatgaatcttgttaagaatttgggcatgtatctcttcyggttgtcctgattatgtaagtcccttcttcaccctaataacactgtattgagaaaaacttcaagtgcattatgcccccaggatgaagctataccttgtta

SEQ ID NO: 6274 - DNA, 201 bp, Homo sapiens
agtagagacagggtttcaccatgttgcccaggctggtctcgaactcctgacatcaggtgatccacccgccttggcctcccaaagtgctgggattacaggcrtgagtcaccgcgaccagcccacaacttgcctgggactccgcagtcctcttccctcctgatttttttccattatacttagcaccctccaatacattatata

SEQ ID NO: 6275 - DNA, 201 bp, Homo sapiens
cttggcctcctaaagtgccgggattacaggcatgagccatcatgcctggccttcttttctcttctttatcctttattattaccacctccttctcctttttyccccctctaatttctccctcatatatctctatccctttttccttccccacactatttgtctttctttcttcttgttctcatcttcatcttctcccttctc

SEQ ID NO: 6276 - DNA, 201 bp, Homo sapiens
gtgcaccaagagcctttagtatcatttctagcatcatggtatatttatatataagaataattgcctgtttatctgtctccccagcctttttatagcatgawctatgtccttcaccactgtatccctagcaactagcacagagcctggcacctagctcacaatcaataaatatttgtggaattgatggatgaattcaggcac

SEQ ID NO: 6277 - DNA, 201 bp, Homo sapiens
tgtctccctgaatatgtgagtaagagcgatcacttaaggataagggactaaaatgtatttagcctctaatatatgttgaatggtgtgccagatactttccrtatgttacctgaattctcacccaaagaactaagtgcagattttctcattttacagagagaaaacagaggtgggttttataatggtgtgaaaagctatacg

SEQ ID NO: 6278 - DNA, 201 bp, Homo sapiens
atatttccagactttatattataaaaccctctaggacaacactgtccaatagaactttctgcaatgctggaaatgctctgacaccatctactatggatatygagcacttgaaatatgtttagtgcaaatgagttgtaaatttcatttaatttcattaatttagattgtaatgtagggggtcccacgtgcctatgggctatt

SEQ ID NO: 6279 - DNA, 201 bp, Homo sapiens
ctaccttggcctcctaaagtgccgggattacaggcatgagccatcatgcctggccttcttttctcttctttatcctttattattaccacctccttctcctkttttccccctctaatttctccctcatatatctctatccctttttccttccccacactatttgtctttctttcttcttgttctcatcttcatcttctccct

SEQ ID NO: 6280 - DNA, 201 bp, Homo sapiens
agttttcagggttttcatacaccttatttcattcgatcctaataagaaccctgagaggtagatttcaactgtgctttccaaaagtaaagatggaggtgggrggaagaactcagcgatggagctagaactatgggcacgtgaaagaaagaacaagttatctaattcacctgatgggtgcactgtgggagacagagcctggtg

SEQ ID NO: 6281 - DNA, 201 bp, Homo sapiens
atggcgacaacagtagtagcacgatattatgggttcttcctctgacatatgctaataaccccactaatatcaccagacctcaagaataaatacaatctaastaaatacaatgggcttgctatgcaaactgaacttcaaggtaagttccctaggtattcctgccacttgtaactatgttggtggcacttaggcccttccaat

SEQ ID NO: 6282 - DNA, 201 bp, Homo sapiens
agttaattctttccactcccacccactccccttgaggaacgggtctctcctccgctcctctggcccagggcttctcaaactccccacctctgttcctctarctgcagagtcagaggaagcatgacattttttctgcccttttgtgctttacctaaaaactttgcattttcttccagaacctacccacatttaataattttt

SEQ ID NO: 6283 - DNA, 201 bp, Homo sapiens
cttcttcattccagccttcttccttccctccacttctgtgtaattcccaaaccaggctgtcataacatcgccttcaaatcttcaaatctctctcccttctwctccaaaccaaagctcccaggctgtccacaaaaaagaccctccctctcattcagagccaactgatttttgtacactctttcttgcattttgagactctcc

SEQ ID NO: 6284 - DNA, 201 bp, Homo sapiens
tctcttggtatcacccaactcctctcaatatcaccgttccacatggggaccagacatataccccgatgttacctccactgagctctttgcttccctgccamcttgcctcatctccctacagttccaccagaatcacagagagtggccaatgtctccaagaccaactctgaaagtcccaacaacaatcaggagtatcgaatc

SEQ ID NO: 6285 - DNA, 201 bp, Homo sapiens
aaggaagggctgttcacctctcagacaatctcctttctaaatacatccccagtttctcaaaatacgaccttttaaaccaacttctcttggtatcacccaamtcctctcaatatcaccgttccacatggggaccagacatataccccgatgttacctccactgagctctttgcttccctgccaccttgcctcatctccctac

SEQ ID NO: 6286 - DNA, 201 bp, Homo sapiens
ctggagtatagaattgaagaaaccttcccaaacacagcacaaacagagaactggaaaaaaaaaaaaacaagatacatggagaattgactgagaaattacayatatatatatagtacagtcatgtgctgcataaggaggtttaggtcaacaatggaccacaagtacacaatgctggtcccataagattatattctaagtttt

SEQ ID NO: 6287 - DNA, 201 bp, Homo sapiens
atgatgtagttaactggagtatagaattgaagaaaccttcccaaacacagcacaaacagagaactggaaaaaaaaaaaaacaagatacatggagaattgaytgagaaattacatatatatatatagtacagtcatgtgctgcataaggaggtttaggtcaacaatggaccacaagtacacaatgctggtcccataagatta

SEQ ID NO: 6288 - DNA, 201 bp, Homo sapiens
cttcacaactgaagaaggaaagatgctagagcaatcagagaagaactttataatacatattttttaatctttgaagggacaggggagggagttacatgcamaaagtgagaagagtttttcattatttataacacaaaaaaacagggaggtgtaaagaggaaccaattattatcttggaaataaagtatatccttgttgaaa

SEQ ID NO: 6289 - DNA, 201 bp, Homo sapiens
gaacatccaactaactgattctacaaatgaaggacttcacaactgaagaaggaaagatgctagagcaatcagagaagaactttataatacatattttttartctttgaagggacaggggagggagttacatgcacaaagtgagaagagtttttcattatttataacacaaaaaaacagggaggtgtaaagaggaaccaatt

SEQ ID NO: 6290 - DNA, 201 bp, Homo sapiens
tggactcctaagcctgtaccacaggccacgtagaatgggaagagagtacaaacctgagctgctgacatgggctctggcttaaaatacacaccctcacagayacagggcataagaaatcataaagttgccttgaaaataagttcacaaacaaaaattaaagaacatatgtgaacatccaactaactgattctacaaatgaag

SEQ ID NO: 6291 - DNA, 201 bp, Homo sapiens
taaaaaaatatataaaagcaggttgtgaaataaaacggggtcaaaatccgagtgaacacactcagtaaccttccttttctgctcctaagacatagaatttwtaaagaaacctttagttatttttaaatttacatagtattgcttgcaaataagaaaagagaatcacagatcaaaaatagagagtaatccctaaaaataaat

SEQ ID NO: 6292 - DNA, 201 bp, Homo sapiens
tttcgtatgtaaccccccaatttatgctaatcctcaggatggctggtaattatctgcccactagagagaagagaaaaattggcaaacacctatgaaatcastcagcattgagggaacaaacactgcacgaatgccctgaaccatattgtgatatgttcatccggaagctccaacaagctggcatcggagccaatgactaga

SEQ ID NO: 6293 - DNA, 201 bp, Homo sapiens
agccctctttctctctctttccccactcactctgcctacagtagcattttccatctgaggctatgagaaagaagataaacaccgctgcaaacccaccagaycacagctcttcagggcccaaacgattgtcagcaacccctgagggctacttggagtgtgagtcacgctaccgggaggacgcctgttggtctctgatgactt

SEQ ID NO: 6294 - DNA, 201 bp, Homo sapiens
aggagaaccagaggttcagacaggtgaagggccttttctaaggtcacacaggtatttttgaaaattgaatttcattcttcagactctttgtccaaggtttycttggatcttccaactcaagttgattcatcatggctgcctggagtactgtgttgagaaggccttaaggccagtgggctcaacagggccaggtgttatagg

SEQ ID NO: 6295 - DNA, 201 bp, Homo sapiens
attgaggctcaagatattaagaacttccccatgatcacccagccagtaagaggtggaatccctgaatttaaattcaggcaatctaactcaaagtacaatayattaaccacttgataatgacattctttaaaagattaaagcagccatgagtctaccaccccaaagataactgctattcatattttggtatgtttgttgcca

SEQ ID NO: 6296 - DNA, 201 bp, Homo sapiens
agagcataccctcatgtaaccacatcatccttaatcactctttctggttattaaaaagtacatgtacactggagaaaaataaaaactaaaaaatgcagacrcaataacaatagcattcctgtaataagcatttattataaggtaggcactgagacatggactaatatccatgatgtcatttaaatctcacaactctacaaa

SEQ ID NO: 6297 - DNA, 201 bp, Homo sapiens
ggtccagttggtggagtcatttagtgcaaaggtcaatgagatagtcttctcctacgatcactttcatgctggccacatttagcttccgtttgccaggatamagctctcagcaagtcctacaaaggcaaaggaagcttctgattgtctcagttaagaaaatacaaatcatttcatgttagaccctccacttctgacagttct

SEQ ID NO: 6298 - DNA, 201 bp, Homo sapiens
ccctaggttctagttacagctttgaacaatgcacaaattactgcaactcccagatcctttatttcctcatctgaaaatagagattctttaaacaaatacckttggagctgccaggttccccaggctatcactgagttattaatccttggcagagataaaatgagaaactatatatgtccacactctaaatccctaagcctc

SEQ ID NO: 6299 - DNA, 201 bp, Homo sapiens
caagggaagaggattgcttgagtccaggagttcaagaccagcctgggcaacatggtgagacccccgtctctaccaaaaatttaaaaattagccggatatcrtggcacacgcctgtgttcctagctacttgggaggctgagatgagaggatcacctaagcccaggaggttgaggctgcagtgaactatgatcatgccactgc

SEQ ID NO: 6300 - DNA, 201 bp, Homo sapiens
ctgtctatgttattggtaaggcttctgatcaacagtgggctatagtttatgggaatcaaaagttatacatggattttaaactgcatgggggttaatgcaastagcgcctgcattattcaaggatcaactgtgtttaataaaccaataaataaatcaaatccaaggaagtctatgaaagggtttcagagggtctgtgatccc

SEQ ID NO: 6301 - DNA, 201 bp, Homo sapiens
ttctaagacagggactcagttcctcaaagcaggagcctagtgtccagaaagggagcccacatgagaagaacaaagtcagtgttagagcaggtggaggtctsggttctgagctgaggtgtcttgactccactgaggctcagttacagaagaggagtgaggagaagccttggaattaagctctaactacctcccaacctctct

SEQ ID NO: 6302 - DNA, 201 bp, Homo sapiens
cagtctctccatttcaagatccttaatttaattatatttgcaaagtccctttagccatataaggttagtattcacaggttccaggaattagaatgtggatrtctttgggtggggaagagggggtggtggggacatgattctgcctaccacaccccctaggactatttgagtaaaaattcctgagaagcattgaacctagaa

SEQ ID NO: 6303 - DNA, 201 bp, Homo sapiens
atttagcccaactttcttacttgcaggagaaactgaatttcagagtttgccgcaagtcaaggaatgcagttctggaagctagtaaaggaaaggaaacagaytcttccccagagtctccagagggagcacagctttgctgacaccttcattttggtgcagggaacctgatttcagacttctgccctccagggctgtaagagg

SEQ ID NO: 6304 - DNA, 201 bp, Homo sapiens
ttccaagcaaggaaggcttggacaacaggaataccattgacagagagaagaaatccagaataagcatgaatcaaagaggacaggcctgggcaggttcagtrtgaggcacccatggccatgtcaaggagagaagcccaccaagcacctaggggaacaggtcaggaacccagggcaagaggttgaggctacaactgtagattg

SEQ ID NO: 6305 - DNA, 200 bp, Homo sapiens
gggcttcactttcctcctctctacaatgagggtggtggtcctcggatccctgcctgcaacactctgcctgcacatcagggagctcaatatacatccgtcctcatgttccttccaagcaaggaaggcttggacaacaggaataccattgacagagagaagaaatccagaataagcatgaatcaaagaggacaggcctgggc

SEQ ID NO: 6306 - DNA, 201 bp, Homo sapiens
gattcatgctacgacatggatggaccttgaaaacattatgctaagtgaaagatgccagatgcaaaaggtcacataacagacgatcccatcccatctagaaygagtaaatccacagatacagaaagcagattaaaggtttccaggagctggaggggtggggaaatagatcgtaactgcttgatggttactggtctccttttg

SEQ ID NO: 6307 - DNA, 201 bp, Homo sapiens
atcaccaaagctttaagagtggagagtaacatgtccaatgcgccccttgagtaggagagcttcccgtataagcaggaaactcagaagactggaatcaaagytcaggtggaaggtgataaggaccaggtgccagggatggagacgaaccaagagttgggcagtggaagaatggaaaacaccagagggccaggtatagtgtca

SEQ ID NO: 6308 - DNA, 201 bp, Homo sapiens
aggcaccttggagaacttgacacttaaaacttaaaggacttaaaggcaaagcgggactaacaatgacatgtttcacacttgtatttcttcttacagttttsagggttttcatacaccttatttcattcgatcctaataagaaccctgagaggtagatttcaactgtgctttccaaaagtaaagatggaggtgggaggaaga

SEQ ID NO: 6309 - DNA, 201 bp, Homo sapiens
acagaaatccattttaagtggtaggagggaccctggacgatgaaaagggtgatctagcccagggtccaggaaaactgtcaggcttcctgcccatctgcccmctctgcacctgcacgcatacctgacttctttctccctagaagagctcctgtcccccacagtgattttcaactctcttgctatgcatgaggtcagccattt

SEQ ID NO: 6310 - DNA, 201 bp, Homo sapiens
aggtgagatttaggtggggacacagccaaaccatatcaagttcaaaggctcaaaggacttcaaaagaaggggcaagaataaataatcgcacagaaatccaytttaagtggtaggagggaccctggacgatgaaaagggtgatctagcccagggtccaggaaaactgtcaggcttcctgcccatctgcccactctgcacctg

SEQ ID NO: 6311 - DNA, 201 bp, Homo sapiens
gatcccatgatgtacagcatctcttaaatttattttggcttaaacttttttctgtagggtcatattcctcagagccctctttgggaaagtctagagcaaaytgcaaaatgaggagagaactgagttgaagctcaaaaggtcagcaggggtcagaaatcagggatttgtgcagccaggagtttacattttatctgaaggcaa

SEQ ID NO: 6312 - DNA, 201 bp, Homo sapiens
caacaagaacaagtgttgtataaaaaacagaaggggagtcttctgatcaaatagatttgggaaacattcgttcaaacagcaggaaataagtttaaaccgtktctgtagcgcaggacttctcagagctttgaagaggctcatgtgcattgtaaatatctgaggatcccatgatgtacagcatctcttaaatttattttggct

SEQ ID NO: 6313 - DNA, 201 bp, Homo sapiens
atttagagcaatgtgggtttttgttatattttagcaatcagggcaatggtttttgtcatattttatcaagccaacaagaacaagtgttgtataaaaaacaraaggggagtcttctgatcaaatagatttgggaaacattcgttcaaacagcaggaaataagtttaaaccgtgtctgtagcgcaggacttctcagagctttg

SEQ ID NO: 6314 - DNA, 201 bp, Homo sapiens
tctcagagggcatggcttctgagatgagttttgaaggatatgagacagacagaaatagcagcacagacaagtgccagaaaatgtgaaagaggcacatttaragcaatgtgggtttttgttatattttagcaatcagggcaatggtttttgtcatattttatcaagccaacaagaacaagtgttgtataaaaaacagaaggg

SEQ ID NO: 6315 - DNA, 201 bp, Homo sapiens
agtaatttcagcttttcaaagaaatttcaaatccattaacttagtctctaccaaggcctccgagttcgaggcattaaaggctccccaagtggaattaccarcgtgttataaacgaaagaatctgagtcaccaaaacagcccagcctctgtctgacctccgaccctcctcatctgacactacagcttttcccaaggcagctg

SEQ ID NO: 6316 - DNA, 201 bp, Homo sapiens
tggaagcgaggtgcagaaacagctggatccattacagcttggcatttgccctacttgagcccagtttgaacagttggtcccccttgattggctgaaactcrgttgtttggacaacagtgggttacagtctgtttacacatccagttaggttgcagttcactacttatggagaaacctttaaagtatgtaaagaggcagctt

SEQ ID NO: 6317 - DNA, 201 bp, Homo sapiens
atttacaaagacaggtggcaggccatagtttatagatccgtaaagtaggtgataccttgatatggcaaaatccaggaaggtgatacaggaaagactgaaakaagaacagcattcagttactgggaccctgagtctcctctctttagagaaattaataaattcttatgaattcagtcttactcagagacagctataggacac

SEQ ID NO: 6318 - DNA, 201 bp, Homo sapiens
acgaaagcacccatagaaagcacatctacagatgggtgcaattctgttctaataaaactttatttacaaagacaggtggcaggccatagtttatagatccstaaagtaggtgataccttgatatggcaaaatccaggaaggtgatacaggaaagactgaaataagaacagcattcagttactgggaccctgagtctcctct

SEQ ID NO: 6319 - DNA, 201 bp, Homo sapiens
tgattgtggccatggtttcacaggcacatgcatacatccaaactcatcaaattatgtatattaaacacacgcagtttttaatattatttagatgtcaatgsagctgtttttaaaaaaaaaaaattgaccatgagttgaagctgaattgagggtacatgagtgttcattacacattctctctattcttgtatgtttgctaat

SEQ ID NO: 6320 - DNA, 201 bp, Homo sapiens
agagctggcatgatggaaaatagcggcaggggctgatcaagatggcatggagtgaggcttctgaaaacacttattgaccagcttgcatgctgtgggtgatmgataaatattaaacaccgaggctagtggagaacaggttttaatgaggcccagaacagcatgtagagtgggctgtagtagtgaggggccatggagatgcta

SEQ ID NO: 6321 - DNA, 201 bp, Homo sapiens
ataaatattaaacaccgaggctagtggagaacaggttttaatgaggcccagaacagcatgtagagtgggctgtagtagtgaggggccatggagatgctaascaaccagtctcatgcctgcaggtcccccatgtccatgcttctccctaggctgttctcagttacaaagacaaagcaaaccaactcggggggaaattcatcg

SEQ ID NO: 6322 - DNA, 201 bp, Homo sapiens
gagatgctaagcaaccagtctcatgcctgcaggtcccccatgtccatgcttctccctaggctgttctcagttacaaagacaaagcaaaccaactcgggggsaaattcatcgggaagttggaagctaaagggtccctcctagcatggccaaggcctgccgctccagtctcttctcaccacttatcccatttttttttttttt

SEQ ID NO: 6323 - DNA, 201 bp, Homo sapiens
acatctccttctctgactcttccatgcccgcctcttataagtacagtcacaattatattgggcccaccagataattttggatgaggctctcatctcaagayggatccataacttaatcacatcttcaaaatcccttttgccataaatcataacatttatacaggagtcagagtttagaaggtgaacatctttgagaggtcg

SEQ ID NO: 6324 - DNA, 201 bp, Homo sapiens
accctttcctaacatgctttcctgatagtaaatctcctaattttagcatcttttgcaatccagataggctgagaatttcccaagtcatcaaatcttgcttkctttttgcttaacagttcttgcttcaatctctttcctctcacattttactaaaaggagcaagaagaaaccaggctgccccttcaacactttaccaagttc

SEQ ID NO: 6325 - DNA, 201 bp, Homo sapiens
tgagcgggagacatatattaagaaatacatgacaaggaattggcttacatgattgtggggaatgggtaggtaagtccaatatccacagggcaggctggaayttctgggcatgagctaaaccttctctcctcaggtggaatttactcttcagagaagcctcagctctactcttaaggcatctgactgattgaatcaggccca

SEQ ID NO: 6326 - DNA, 201 bp, Homo sapiens
gccaaggtccagataagcacatataagttaagtgagcaagtctaaaagcagatgcgcttatcctttcaatcactctacttttcatcactctcccttttacmctctgctccaccatccaaccccactggttctgaaggtttcctattgaaccaccctcccagaaagcccatcatcttctgctttggaaagccaatattgtaa

SEQ ID NO: 6327 - DNA, 201 bp, Homo sapiens
cacacacgcaatatcatcccacctcttcaacagatgaaggcgaaaacaactaaaatccaagagtaaatctccagctaaaaacaagctcaaatagcaacaaraacttcaaggaggagattcatttgcaactaggtgctaatgaaaccaggtcctccttccaagaaaatcaaactgtgtaactcagaatagccaatttaggat

SEQ ID NO: 6328 - DNA, 201 bp, Homo sapiens
tgaaggcgaaaacaactaaaatccaagagtaaatctccagctaaaaacaagctcaaatagcaacaagaacttcaaggaggagattcatttgcaactaggtkctaatgaaaccaggtcctccttccaagaaaatcaaactgtgtaactcagaatagccaatttaggatgcaagaggcatttggctaattatactcaattgta

SEQ ID NO: 6329 - DNA, 201 bp, Homo sapiens
aatttatctgtcagtggaaatgtcttgaaagaataagttcactccaccttcacaaggatggtaatgatgatgatgtttatagcagctaccatttatcgggsaactgaccttgggcctcacgactgtgctaagcacttaacatacaatgtttcgttttatcattattatgacctgaggccctgaaaaagaatttgagctccc

SEQ ID NO: 6330 - DNA, 201 bp, Homo sapiens
ctgggtaatttataaggaacagaggtttaattgactcaccgcttggcatggctggggaaggagacctcaggaaacttacaatcatggtggaagacgaagasgaagcgaggaacatctcacacagcggaaggatggggatgggtagaaaagaagcaattgacacacacttttaaaccatcagatctcgtgagaactcgctta

SEQ ID NO: 6331 - DNA, 201 bp, Homo sapiens
taaggtctgagtacctagatttcagaattcttggtatgggagttctccagtggggaaacaaaaagccttgcaattaagaaaactgaaaaagaacagaacargcttggcccagttgccgaagaccagtcgtgtgtgaaatgcctcagaacaccggatggagacagcacggatcaagccaagtaaaaattgagagcatgaaac

SEQ ID NO: 6332 - DNA, 201 bp, Homo sapiens
agcctggtcagtcagtgtattcctatcctgaacaatgtgattggttgatttatgggcaagtgaggaagaggagtccaatcagagttagccctgggacttcygatgaagcgaccaggaagtggactctgcactctgtttcccctaagtcacttaactgacagaataaagatgcaacacttctgctagtgactgtcttgccac

SEQ ID NO: 6333 - DNA, 201 bp, Homo sapiens
taagtcacttaactgacagaataaagatgcaacacttctgctagtgactgtcttgccacactgggagttggggtggggagacattccctgaataaagtcartacaggctgggtgtggtggctcctgcctgtaatcccagaaattttggaggccaaggtgggaggactgcttgagcccaggagtttgagaccagcctgggca

SEQ ID NO: 6334 - DNA, 201 bp, Homo sapiens
gctgatgccagctcaaagcttcattgcaaaattcttccaggctacctgttctgagttataggaaatatcccaaagcgcccatgtcctaccattccagggtrcaaaagagcacgaacccacaagaagatattggaagatttactgagccacagggaaatgaggaaatgagagcaaagtaaggaagttatataagggtcacac

SEQ ID NO: 6335 - DNA, 201 bp, Homo sapiens
ggttgtgaaaacaaggacactgtaagacctttcataccattcaaagaagaaagtggacaacgccttccgctaagggcctccttaacgtggtgtattccagkgtgtggtatactgatggtgtacaagatcattttagatggtgcagggatacattttcctcttaaattttcaaaaattcaggagccattctactatattaaa

SEQ ID NO: 6336 - DNA, 201 bp, Homo sapiens
gtgaacatgagggtacagatatttctttgagatcctgatttcaattctttgggatatgtacccagaagtgggattgctggatcataagatagttccattasgctggtgctattacttttaattgcaaaaaccacaattacttttgcaccaaccgataataaaaatttaaaaatttttcgaggagccgccatactgtttttc

SEQ ID NO: 6337 - DNA, 201 bp, Homo sapiens
gaacatgagggtacagatatttctttgagatcctgatttcaattctttgggatatgtacccagaagtgggattgctggatcataagatagttccattacgytggtgctattacttttaattgcaaaaaccacaattacttttgcaccaaccgataataaaaatttaaaaatttttcgaggagccgccatactgtttttcat

SEQ ID NO: 6338 - DNA, 201 bp, Homo sapiens
ctacagttagtaatatcatactatacacttgaaatttgtgaagcgattagatcttaattatactcacaccacatacacagacacccaaaatggtaaccaayagtcgtgaaagatgtgttaattaattcgatggtggtaatcatttcacagtctacacactcatcaaaacatcacattgtacaccttgaatacaaaccactt

SEQ ID NO: 6339 - DNA, 201 bp, Homo sapiens
cacaaggatagcaaggaggaaatgtttaatctgtaaggatttcaaagagggaagctaaaattgtatttctaagcagaaatttgtggacccattttaatgamaagataaaacacatttctagttagcagcattccttgtacataaacaatttatctacccaaggctagaaaacggtatgccctcaagtagattaaatcaacc

SEQ ID NO: 6340 - DNA, 201 bp, Homo sapiens
tgcatggaaagcatctatcaccgtctggcatacagcagaggcacaataaatggaagatattgtcacaaggatagcaaggaggaaatgtttaatctgtaagsatttcaaagagggaagctaaaattgtatttctaagcagaaatttgtggacccattttaatgaaaagataaaacacatttctagttagcagcattccttgt

SEQ ID NO: 6341 - DNA, 201 bp, Homo sapiens
tgtttactgtcctggttccctgtgtgtgctgcctctcactattacccatgaaagggaatcaaaagggggctgggaaagtttcacggagagggttgagaacwcacaaataaagaggacaattaggcccggcatggtggctcacacctgtaatcccagcattttgggaggctgaggcgggcacatcacgaagtcaggagtttg

SEQ ID NO: 6342 - DNA, 201 bp, Homo sapiens
tgctatacaagcccatttataacagaacagaatggaaattttataaaagttcaagaacaagcaaaactaatctatgatgattgaattcagaataatggttwtcttggggttggtgagaagggagcaaataagaacttcatagggaactagaaatgttctatatctttgcaatgtatctatgtaataaaactgcacttgcac

SEQ ID NO: 6343 - DNA, 201 bp, Homo sapiens
gtttcaccatgttgaccaggctggtctcaaactcctggcctccagcgatccacccacctcggcctcccaaagtgctaggattacaggcatgagctaccacrcccagcctgctgactgtaatttctgatgaccaaaaacttcactgatcactctggaagttatttagtattactatgtggtaaataccgtgctaaacagtac

SEQ ID NO: 6344 - DNA, 201 bp, Homo sapiens
actcacccaaggtccgaagtctaaaaaagtacagattaggttcgaacccatgcaacctggccccagtgcccatgctcttaaccgtgatgccactgcctccyagggggccctggccactcctgaactggacagattcttgtgatggaaccggacacaacagccgggattccaccagccaaacaggtcaaggtttaccttcac

SEQ ID NO: 6345 - DNA, 201 bp, Homo sapiens
cacaatcttggctcaccgcaacctccgccttccaggttcaagggattctcctgcctcagcctcccaagtagctggaattacaggcatgcaccacccacacstggcaaatttttgtatttttagcagagagggtttctccatgttggtcaggctggcctcaaaccccttaggtcaggtgatcctcccgcctcggcctcccga

SEQ ID NO: 6346 - DNA, 201 bp, Homo sapiens
aagcaggcagagtcccctaccttaagaaaattacaggctggtaaactctcaacaggagaaatattggatatatcaaatatagttccttcccctgagaaacrcagactggttggtgagacagacaaatagattttatgatttcagaacaatgtagtaaatgttaaagtattacagaatgctatggaataatggagagatgag

SEQ ID NO: 6347 - DNA, 201 bp, Homo sapiens
agtcatctctgtagcctccacagcccttcataaacagcagattcaaacaaacaaaagcttcattcaagaaaggaaggaaggcggctttttgtctagccccrtggttctcaacagggaaagattattttttaactttcattttaggttcaggggtacatgtgcaggttatataggtaaactgtgtgtcacagggatttggta

SEQ ID NO: 6348 - DNA, 201 bp, Homo sapiens
caacaatgaatgttaaatatgtaaccaccataagtgttaccaacgagaagcatatggtgggttccaggagggcagttgatacaggttatggtttaggaacratttttctaaggagtaatgatgaggttgaggtctggagaatgtctaagaattatgagagagtttggggtatgtgtgcttctttccgggagggttgagggg

SEQ ID NO: 6349 - DNA, 201 bp, Homo sapiens
gaggttgtggtgagccgagattgtgccattgcactccagcccgggcaacaagagcgaaactccgtttcaaaaaaaaaaaaaaaaaaaggtacattcctaawtcccacaggctttgcaaacctgtgctctaggataggaattcagtgctcatttgtttttcaatgcaaaactttctatgaagacatttcaaacacatacacg

SEQ ID NO: 6350 - DNA, 201 bp, Homo sapiens
tccagaatattatataaaggcttactaggatattatatgtgatgtgcttggcatagtgctgaaccatagatgagaggacctaaaacaattttttccttccmttttctcagcatcacttgtgactgaataataaaattaggcattcttgttcttctcagtatcttttgttctggcccccagatatgagaagggtttgacctt

SEQ ID NO: 6351 - DNA, 201 bp, Homo sapiens
ttagaaaaaaaacatgaattgcattttggctttacatgtgtaagaggaaaaaaaatcaggatttgaaagatggataagagaaagtaatgatataagaaaayattataggcaacaacaacaacaaaagcatattcaaagtcccaaatgcatgaaggaacccagtatatacattcatggagttgcaaatcacttgcatggtgg

SEQ ID NO: 6352 - DNA, 201 bp, Homo sapiens
attctcctgcctcagccttcagagtagctgggactacaggcacctaattttttttttgtatttttagtagagacggggtttcatcatgttagccaggatgrtctccatctcctgacctcgtgatccacccacctcggcctcccaaagtgctgggattacaggtgtgagccaccgtgcccggctagagaatttcttgactgg

SEQ ID NO: 6353 - DNA, 201 bp, Homo sapiens
aacattcaagaagcctttaacaagacactgcttgtcttgatgaattaatgaaaccagcatgtgcacatgagtgtgtgtgtgtgttactgaaaattaaaacrtctctttgatgataactgaatatatttttttcagatcaaaccaaacccttgccaggaagaggaacacattagcacttgaggtcagttggcatgtttgggc

SEQ ID NO: 6354 - DNA, 201 bp, Homo sapiens
ggtgggattacaggcgtaagccaccatgcccagcacgattaatggatttctatggaatttaatttcctttctgcctactgctttcaggtaaaaacgatgawtgattcagattcccctgatgatctcacttgcataactgagatcaggggtttttctgaaattcaccaggacttctccccttttcaatcactttgtgtgatt

SEQ ID NO: 6355 - DNA, 201 bp, Homo sapiens
ctttgtagggacatggatgaaggctggaaaccatcattctcagcaaattatcacaaggacaaaaggccaaacaccacatgttctcactcataggtgggaaytgaacaatgagaacacatggacacaggaaggggaacatcacacaccggggactgttgtggggtggggggaggggggagggacagcattaggagatacacc

SEQ ID NO: 6356 - DNA, 201 bp, Homo sapiens
gtctctattgtcaatcgtcaccaggtattttaggtgtctatttaaatagctgtctccatgcaaccagattaatgctaattcatctgtacagtaatagcacmcagcccagctcccagtacatggggagctgagaacacattcagtgaaggtataagtaagcaggtgaatggatggacagacgaatgcatggatggatggacg

SEQ ID NO: 6357 - DNA, 201 bp, Homo sapiens
tcagtatttctggagatattattattgcctgaaatcagggaagctggggggtgggatggaccacataatgctctctgtgcccttctaactcactctatctrtgattccaagaacgcaagtccagggagaaggttcagctctccatggagactctcttatatccaaagtaagagaaattagttctctatttgccctaagact

SEQ ID NO: 6358 - DNA, 201 bp, Homo sapiens
tgcatctttaggtgaggtcatatcccctctgtggcttcagtttccatattactggactaagtagcaatttatgatccactacagttgtaaaagccagggartatataattctgttggttatatgcctcatattgcacatattaaatatgtgcatatatgtgcctcatatgcatattgcatatattgcattaaagagcataa

SEQ ID NO: 6359 - DNA, 201 bp, Homo sapiens
actgctgcactccagcctgggcaacaagagcaaaactccatctcaaaaaaaaaaacaagaaagaaaaatggagccaacaatatttgcccttagagggctgytgggaataaagtgttattatataagtaaagtatgtgtgcaatgctcagaacataacaaatgctcgaaacacataaatgcattcaatcaaattcagatttt

SEQ ID NO: 6360 - DNA, 201 bp, Homo sapiens
gtttaggtatttatgtatttgtccattcatttactcgctcattcatcccccaaattctgaatgtttctgacattcctgacaatatggttagtgctagcaayatacaaggccaaaaagacagatgtggtgtcttccctaatgagcttatattctagtgggcagagacagtcaataagcagataaacaagatagttataggct

SEQ ID NO: 6361 - DNA, 201 bp, Homo sapiens
acgtgggttgattgcaaatttggagagggctcccaagaaaacacaacacagcctgaggatgaagcagcagagattgcaggtgactctttggaggaggcaasagcatccttgaaggcatgtgtgcaaaggcactgccgcatggacttgaagggaatcgtcaaatatccaaatggagtttcataccatggagcttacatgaat

SEQ ID NO: 6362 - DNA, 201 bp, Homo sapiens
ctccctgtgtcacacagcatcgagtaagtcatttctttcaaactctctctcaccgccagcttcaacaaaccaggaaacccatcaggctgtatcacctttgrgcagaaatccccaggggcttgggcatcacgctgacaaagtctctgccaggtgttaggtgctggttcctatcattggttccatcaccccttaaagcggctt

SEQ ID NO: 6363 - DNA, 201 bp, Homo sapiens
gatcatctaatgtattgggagaggcagataatagataatgtacaaaccaaactaaggttagtgccatgagagtaaaggacagaggccagagactaacaccyaatctagggtgatcagggaatctgtctctggggaagcgacattgaagcagagacctgaaggatggcagagttttggggattggtgctggttccagacaga

SEQ ID NO: 6364 - DNA, 201 bp, Homo sapiens
tacaccagcacactccctagctcacgatattttaagtggatgaataaatgaatgagcaaaaaaagagcaccctacctctaactggatcccccagctgtgarctctctcacattttttctctagcaaattccctcttttttgctgtttctttctcctcttttctgttctattctctttcttcatcccctatgctttaaaaga

SEQ ID NO: 6365 - DNA, 201 bp, Homo sapiens
ccaaagtgctgggattacaagtatgagccaccacgcccggcctaataactttagatctacaagtttcatccatagtagtaaccatttacagactgcttttscatacgccacacactggtctaagatgcaaatgcttttcttgtccccatattacacctgagggagccgacgtggagttcagtgactcacccaaggtccgaa

SEQ ID NO: 6366 - DNA, 201 bp, Homo sapiens
tatacatattcctatacatctatacatgaacctctacataaaagcacacttatatacaggtacattcatgcctacccacgctcacattataatcacatatrctcacacccacacgtacaactacaaatacacacatacctaacacaaacacatatactcgaacctctacacacacacacacacacacacacacacacacac

SEQ ID NO: 6367 - DNA, 201 bp, Homo sapiens
gtaaatataaaactagttaacctaaaaagtttattcaaaaactgtttttgaattcaaaagggagagttttttaaaaacagcaaatatgttctcagacacaragtagcaaagttgccaggagtttaaactttggagccagccactctggcttcaaatcccagctgtaccacttgtgagctgtgccacttgggcaaatttctt

SEQ ID NO: 6368 - DNA, 201 bp, Homo sapiens
gtttctccagtcatggccccctgattggaaatccagtgtctcctcacatacaataggaggtaagctgtgatgagtgagtgtgcaatgtctcattcaaattscaaatgtgtacaatggtgctaccatgtggaggaaggtcaccagtcaactctatcctggtgacacagtcactattagagtcctgtcctgatttcagagtca

SEQ ID NO: 6369 - DNA, 201 bp, Homo sapiens
aaggacagcccagtgtaggcattgagaatgtggttctgacgccaggccacatgggttaaaatctcagccctgaacttgctgggactttgcatgggtcctcwcctatgcagtttcctcatctgcatgtcggggaatataatggtatccagtacctggcgcgtagtcagcacctagtaaattttggttgatcacttaaaggtc

SEQ ID NO: 6370 - DNA, 201 bp, Homo sapiens
agtgtagattagtgcaaccattgtggaaagcagtgtggcgattcctcaaagacctatactgggtatacacccaaaggaatgtaaatcattctattataaayacacaggcacacatatgttcactgcagcactattcacaatagcaaagacatggcatcaacctcaatcaaacccaccagtgacagactagataaagaaaat

SEQ ID NO: 6371 - DNA, 201 bp, Homo sapiens
ctcctaggtgattatagtatgcagtcaagtttgagaaccactggacttagcctctcttgggatctcagaataagtttgggtgggtaggcttctagaataargcagtgcctctaaagacgtggtctgtggaccccctgacatcagaatcacctgggaatctgcttaaacatgtgcatcctaggctctatccctaaatttaga

SEQ ID NO: 6372 - DNA, 201 bp, Homo sapiens
cacctacatgacaggtttgttgtgagaattagattgattaataaatagaatttagcacagtatgccagacacactctaggcacttgataaatgctaattaytgtagatgtgataatacctttggttgttgttaattaatcaacatctgtacttccttcctgggattattgagagtgctgcaacaatttctcatctgccaat

SEQ ID NO: 6373 - DNA, 201 bp, Homo sapiens
ttaaaggtgaatgatctgagccaaggaacaaatgctattgaatttcatatctaaaaggcagtaatagctgtgctgttcagcaaaagtggatgggaggattmcaaggcagataattcagctggacccaaatagtctccacatagaagagttttaaggttatctatctaaaccaacagaactgctccctctgcccttggcctc

SEQ ID NO: 6374 - DNA, 201 bp, Homo sapiens
tcctctcatcatcagattttccagatgataagtttttagcaggcccttcttccccctctactcctgtgtggacctctgggctgcctttttcaggttttgcraactggctatgaattgttcagcggttggattagccagttctgcagactgcctcacacgcagaccatctggaccgcttatagagaagacatgttccaagta

SEQ ID NO: 6375 - DNA, 201 bp, Homo sapiens
gagaccatcctggctaacatggtgaaaccccgtctctactaaaaaaaaaatacaaaaaatttgccgggcatggtggtaggctcctgtagtcccagctactygggaggctgaggcaggagaatggcatgaacccgggaggccgagcttgcagtgagccgagatcgcgccactgcactccagcctgggtgacagagtgagact

SEQ ID NO: 6376 - DNA, 201 bp, Homo sapiens
taaaagtgaacaccacactcagctgagtctgtaactttagatcagcattcctgactcataaaagctattctgaagtgtgagccaataccagggttgcaccrcatttcctccagcagtgcttccaggagtaaggtttcaatccatttcctccagcagtgcttccaggaataaggtttcaatgcatcagagcaagtgaaatca

SEQ ID NO: 6377 - DNA, 201 bp, Homo sapiens
attcatatattgaagccttaacctgccattgactatatttggagatagggcttttaggaggtaactaaggttaaatgaggtcataagagtaggaccccagkttgataggactggtgaacttgtaagtagaggaagaagagagatttctctctctctctctctccaccagcatgcactgagaaaaggccatatgagcacaca

SEQ ID NO: 6378 - DNA, 201 bp, Homo sapiens
ctctttagtttgacatggaaattttccctaatcccaagacatagatgataccatgtgataaaaaaaaatcttaagatacatttatccatttattttacagyttttttagtatttaggacctaccaggcattatatgaggtgctaaagacacaacggtgaccaagacacagtctactggtctctgtcccctatactctattt

SEQ ID NO: 6379 - DNA, 201 bp, Homo sapiens
gagacagagtgacggctaaaaatatgaggtttctttttgtggttttggaactgttctagaattagggagtggtgatggttgcacaatatagtcaatatacyaaaaagcattggactgtgaactttaacatgataaattttatgtgaattatatctcaaaaacatttaaacgtaagactaggtatcacttattgaccaattt

SEQ ID NO: 6380 - DNA, 201 bp, Homo sapiens
aggcttgtctgtgttgaccagacccactcacctctcctcctgtaatgtttaagtgtcaccagaaatgaatctcaaacccttaaagagaattcaaacatgcyggacaccaggagaggtgacagggtgggaggagagaaaagaatcagtgctctctaagattacctcatcatatgggctggaaaatttttgctggctataaag

SEQ ID NO: 6381 - DNA, 201 bp, Homo sapiens
aggtgtggtgctgcatgcctgtaatcccagctactcaggaggctgagacaggagaattgcttgaacccgggaggcagaggttgcagtgagctgagattgcrctactgcactctagcctgggccacagagtgagactctgtctccaaaaaaataaataaataaataaaagtatatatatacaaaaagaaactcaatggaggc

SEQ ID NO: 6382 - DNA, 201 bp, Homo sapiens
atatttaaatatataaaatatactgttttatatatttaaatatataaaatatataatttctatatatttatatataatgttttatattttaatatattaaratatgttttatatttattttaatatacaaaaatgttttctatattaaaaatataaagatattttttgaatatgtatgttcaaaaataaataaatgaataa

SEQ ID NO: 6383 - DNA, 201 bp, Homo sapiens
aagtgtggccctggaaccagtgacccaatcctgcatctaccacttgataaatatgggaccttgcacaattactcagccttgaattcttcttcctgaaaatrtgaccactgttagtgcttaattgaggttcttgtgacaatttaatgggatcagccatggtgcgttcattttctattgctgctatgacaaattaccatcaac

SEQ ID NO: 6384 - DNA, 201 bp, Homo sapiens
taaaacttaaagtataataaaaaaaaattttactctaagttccaggatacatgtgtagcatgtgcaggtttgttacataggtatacacgtgccatggtggytggctgcccctatcaatctgtcatctatattttaagccccgcatgcattaggtatttgtcctaatgctctccctcctcttgccccccacccctgacaggc

SEQ ID NO: 6385 - DNA, 201 bp, Homo sapiens
taaaatccctaaaggacccagatcatagtaagttttcataagcagtatgtttgctactatttactgttgtgaagaaaatgcctaacacagtgcctggcctrtggcaatcctcaaatatgtgtgtttctttttctctctctctttagaacattcaggattacttagaaaagtcacacatgagcagcatacttagggcacaaa

SEQ ID NO: 6386 - DNA, 201 bp, Homo sapiens
gagcgcagagtgtaggaggaagattgacaggaaaaccaaaataagacacctgaaactccacgatatgataaatgatatgacaacagggggaggtgctaaaygttacgagagtgcagcagaggcataaaataaaagaagcctgaagcaaacttttaattcgttacacaaaaaagtctttagtcttctttgccgagattaaag

SEQ ID NO: 6387 - DNA, 201 bp, Homo sapiens
cagagatactaggggttaggacccaatatatgacttttagggagatacaattcagtgcattctcaacaataaacaacatatcagagggttctcctaccctyggatgaaaccagagacgtgcttctttctcctgaagcccatttgaaaacctccatgaaccaggacagggatggaggatttcctatttcggaggagggaagg

SEQ ID NO: 6388 - DNA, 201 bp, Homo sapiens
atctgtaaactgggagtaataagcccactcacctcccagtgaaatgagatggcatgtagaaagcacctggcacatcctgatgattcaataaacgatagtcrttgttatagtgatgatctttgtaactcttgtaagatgcttttcagttcacatctttttaaatgattgtctgtccacactgttcactccatctgtgcagct

SEQ ID NO: 6389 - DNA, 201 bp, Homo sapiens
ttactgacagatccagttgaagtaaggggaaaaccacaaagagtctgtactcttaaaactgcaataatagagtcaaggagtcttacgggacgagccatgartcttgttaagaatttgggcatgtatctcttctggttgtcctgattatgtaagtcccttcttcaccctaataacactgtattgagaaaaacttcaagtgca

SEQ ID NO: 6390 - DNA, 201 bp, Homo sapiens
ttttagcacacttgatttcctcctggcatcaccaacaggaaaatataaccctatggggaaatatatcacttcatagttatatttattgtcaaactaatgtraattgattcagtagtttgaggaatgttcttaaactagattttataaagtcattttctttgcatagactgaagttgaaacccatgacaattttagcatttg

SEQ ID NO: 6391 - DNA, 201 bp, Homo sapiens
ccttctgctgacttagcaccatgtctacagagatgctgctcttgtccttcgtcctgagaaggagacacagtgtgcctgaaggagcccatctcagacacccygcccctggcagcagccaccagggaagccagtacaatagtggtctcagtaagggaggacctaggactgcgcaaaaaaatcaagcagtgtaacccaaaaatc

SEQ ID NO: 6392 - DNA, 201 bp, Homo sapiens
tgctgggactttgcatgggtcctctcctatgcagtttcctcatctgcatgtcggggaatataatggtatccagtacctggcgcgtagtcagcacctagtamattttggttgatcacttaaaggtcctcctccctccttccctttcatcctgagtttgagagtttcacagtcatactaaatcagattaggaaactgagccct

SEQ ID NO: 6393 - DNA, 201 bp, Homo sapiens
agaagagctgaggcaggactagcttctctgtcataatgtaaaagagtcttggaacgtgtcctgggcccaggctctaaaccccctcatggcctttggaacaycaagctctgtgccaaagggtggaaggctgccctgccacaccacaatctaagcccagggcataaaacccctcgtggcttggatacaatccaaggctcaggg

SEQ ID NO: 6394 - DNA, 201 bp, Homo sapiens
tggggaagaaattgcctatagacaccaatgaacttaaaacccttttcctcataagcaaatattttctgagggttaaaataagtccaataatacttcttgartagtaaacatattattattttaaaattgttttcctagtgaagctacttataataataaagagctaggttgatagcaggccaccttcttattagagtatga

SEQ ID NO: 6395 - DNA, 201 bp, Homo sapiens
ccaggctggagtgcagtggtgtggatctcagctcactgccacctccacctcctgggttcaagtgattctcctgcctcagcctccagagtagctgggattayaggtacctaccaccatgcctggctgatttgtgtatttttagtagaaatggggttttgccatgttggccaggctggtctcaaactcctaacctcgagtgat

SEQ ID NO: 6396 - DNA, 201 bp, Homo sapiens
atacaaacccatctctccatttttcaatcccttgccgagcaaaattttcaggccacaaattagaggtacccctggcttaaaacaaaacaaaacaaaaaggytgggattttaatgagccttctgcctctaaataaatctctctacccggcactcaagtcctctccagacttaaatgaaatgcatcgacaaagcaagtcatgc

SEQ ID NO: 6397 - DNA, 201 bp, Homo sapiens
agtatgtaagttacattcattcccctctgcttctggctttccatctgattagatcaaaagcactcttgcatatggaaagcttgcacgagcacaattttacstggttatgggaaggaatggtgttctctatgtgtatttttattttttccaatgattggattctccagggtgcgcacatgacagagacaagtttctgtactg

SEQ ID NO: 6398 - DNA, 201 bp, Homo sapiens
acctggccaacatggcaaaactccatctctactaaaaacacaaaaattagttgcgtgtgatggcatatgtctataatcccggctactcgggaggcagtggyagaagaattgcttgaacctgggaggcagaggttgctgtgagcagagattgtgccactgcactccagcctgggtgacagagcaagactctgtttcaaaaaa

SEQ ID NO: 6399 - DNA, 201 bp, Homo sapiens
tctgatgagggaaggaagaaatcatgaaggagtgcaatggaggggagttgtgcagtttgcaaaggacctgaaaagtcagagtggaaagaagggatgtgtasgatcagagaacagcatgcacaaaagcttagaagctgagttttaatgacatgtttgtgaactaggaagttgtccaaacaggaagaaacacaaatatataaa

SEQ ID NO: 6400 - DNA, 201 bp, Homo sapiens
gggagtggtgatggttgcacaatatagtcaatatactaaaaagcattggactgtgaactttaacatgataaattttatgtgaattatatctcaaaaacatktaaacgtaagactaggtatcacttattgaccaatttctccttgctggcctaagtgctattatacatagataaaatttctggctcaatccttcaaagaatc

SEQ ID NO: 6401 - DNA, 201 bp, Homo sapiens
tctctcacattttttctctagcaaattccctcttttttgctgtttctttctcctcttttctgttctattctctttcttcatcccctatgctttaaaagacrcttgcatctggggctttttctgaagccgttttttccctcatttttttctgtccacaaaacagcaggaaataatttgctttaaatccacataaaataccca

SEQ ID NO: 6402 - DNA, 201 bp, Homo sapiens
tcttctcattcttccctcattttcaataccacttattgggaaggaaggtactgaaatgaaaacaatttggaaccaaaaggcacaactctcagagccacagygatacagtgacaagtgaaatgggctttctaatagtatcctgctgcggattaacagacacctggtattccacctcggaggtggctggtgatgcagccttct

SEQ ID NO: 6403 - DNA, 201 bp, Homo sapiens
cttggaggagaaaactagaatgcatataggtctgcaaaaaaagtttaggaggagatgtgaaggtaactaggacaatcacagaaacaggaattggggctggrgaaggttaaacacataacattggatgagaacttgacctaaggacagtcctttgttacagtaacagtgataactattattattttttaatacctgcataaa

SEQ ID NO: 6404 - DNA, 201 bp, Homo sapiens
atattttttttggaaaacgtgtttttaacaatgatcatccatttcccaataagtccaaggaagtgttgatctccaaaaaaaaaaaaaactgaatcccaacstaagtttgtgaccttgagcaaattgcaggatctgtctgtgcctcagttgccccattaataaaaagagggaagtcacctcactgctaacacttcattagta

SEQ ID NO: 6405 - DNA, 201 bp, Homo sapiens
tctcccatttcatcttcacaccagccttattaggtaattatttctgtaccctttcacagatgaataaaccgaggctaaaaaagatcacttctttcatagargtatttgtaaatgggacagtagatttagttcagatgtgcactaaattactccttcctaaaggatttatacatctcaagagtttagtcatctttgatagat

SEQ ID NO: 6406 - DNA, 201 bp, Homo sapiens
gctggcagaacaaagactgcagggtgtttcagcatctccataccaacagctagaacagattcctctcctaaccctctgtgccgtatcaaccagctggtctrgtctgactcacaaatggctacagcctggtggtaaacggaactttgttaaccatttgcaaaaaattccaggcaactggggagatggaacaaaaatgccccc

SEQ ID NO: 6407 - DNA, 201 bp, Homo sapiens
taagtgatagagctaaaattcaaaccaggcagcctgattccaaagcccacactcttggccactacataaaagattcttcaccagaatgaccttggtaccayaggttcatgatcagaaagtgatgatacctctatctggggacttggaaacatccatagctccttcaatgagcccaggacaatctttcaccatcgtgagagt

SEQ ID NO: 6408 - DNA, 201 bp, Homo sapiens
ctgacctggccgcctgcaaaccaggtttctccttgcagcttggtttagtaggaaatgatcagaattggactcagatgaactagagccaattgttacctctrtaaaagtctgaacagggtgttgtccattggctggtagcctcagcatcacctggcagcttgttagaaatgctgggtctcaggctccaccctagacccactg

SEQ ID NO: 6409 - DNA, 201 bp, Homo sapiens
tggaatcgcacttagttcacgtcacttcccagatctggcttccaatggcctcttctcaccctctaaataaaatacgtaaatcctcaatgtggcctttacartctgcctcttttaatccttctctgcagccacaatgacttctatgatggtcttccaataccctgagcctgttcccacctcagggtctttgccattgctgtg

SEQ ID NO: 6410 - DNA, 201 bp, Homo sapiens
agtgttggatcacagagctggtgatggaaatggggagatgtatttcgactgatgttggtcaagttacttctttctgcacctccatttcctcatctgtaaamtgggagtaataagcccactcacctcccagtgaaatgagatggcatgtagaaagcacctggcacatcctgatgattcaataaacgatagtcgttgttatag

SEQ ID NO: 6411 - DNA, 201 bp, Homo sapiens
cacctttcccaatgcagtgaaggatagatcccacgtcttgggcttaggcagttaggtggatggtgagtgcaattactaaagagagaaagacctgggaaggracagttaagggtggggagcaagaggaagacaatcaagaaatgctcagtacctgtgggttccctcttgcctatccacccctccctcctacttctgtttctc

SEQ ID NO: 6412 - DNA, 201 bp, Homo sapiens
ttcaggagttttcaagtcagtagaccaatgatgtcatcaagattttgctccttccaactctctgccctacataccctctgctgaaactatcttatggctgrtgccccatcgtgaacacaacatgggaacctgccaacattccacaagtgcttccatgcatgctcttgtatctttagaaggttctcagaagccctccaataa

SEQ ID NO: 6413 - DNA, 201 bp, Homo sapiens
ccctatccatcatgcttctttggttttggacagcaccttgtaaatatcattttcctctttctcctttttcttctcttccgctgctgtcttcatttatttayttttctatttctccagaaatgggtgcaatactgcatatcttcagcttcttcagttttgtactcccattactttggtcctagtcttggttatactcaaagg

SEQ ID NO: 6414 - DNA, 201 bp, Homo sapiens
cttaacttaatcacagttgtaaaatctcttttgccaaattaggcaacacatccactggttccaagcattagggcatggacacatttggtgagtccttctcstaccacatgtgaagaacatgcatgtgttaaccactgcggctatttctacactactcctactattacagagaaagaaagtttttttttctcctcctaaaag

SEQ ID NO: 6415 - DNA, 201 bp, Homo sapiens
aatcaagctgtccatcaatgagactggataaagaaaatgtggcacatatacactatggaatactatgcagccataaaaaaggatgagttcatgtcttttgyagggacatggatgaagctagaaaccatcattctcagcaaactaacacaagaacagaaaaccaaacactgcatgttctcactcataagtgggagttgaaca

SEQ ID NO: 6416 - DNA, 201 bp, Homo sapiens
gatcacaaagtatgctctttaaatttttataaaaattggcaaattgccttgcaaaatcttactccctttatgtttttgtattactgtatatatctctatgyatctttctcaactaatttcagaatcagtctcactcttctctctctctctccttctccctccctccttttctctcccccttgccttcctctccaactctct

SEQ ID NO: 6417 - DNA, 201 bp, Homo sapiens
ctgaggattgacgtccccgagatgttaacctctgtgtgtcaatgaagcagggaaactggacagttggttcacttttctaaatgcaggagcaagatgagggwaattattgatttctatcaaaacagacaagaagcaaatagaagagaagaccatgggcagggaagggtttgaatacaaatggaaaccaccaggcatagcatt

SEQ ID NO: 6418 - DNA, 201 bp, Homo sapiens
tttccaatttccaatgcgaactgctgaagagggccctgcacctgtcagaatgcaaagcccatttgtcagttcctggatagtttctttcagctatttcaagrggtgacctgggttacttcccccatcttctctgtactcaggccttgtagctccttctctctaaggcaataaagtaaactgtcattgttccagagaatgtgg

SEQ ID NO: 6419 - DNA, 201 bp, Homo sapiens
tcggaagtaaaggtaatagtgtgaaatacctcctttctcacttaaaaatggaatgaatgatctagatcttcaacaataggctcatttttccaatttccaaygcgaactgctgaagagggccctgcacctgtcagaatgcaaagcccatttgtcagttcctggatagtttctttcagctatttcaagaggtgacctgggtta

SEQ ID NO: 6420 - DNA, 201 bp, Homo sapiens
aagtttatttttgaacattctgtagtgaggcaagggaagaagaaatccatcacatggaatatcaccctccatgttatcatcttacatctttggcacaaackctcggaagtaaaggtaatagtgtgaaatacctcctttctcacttaaaaatggaatgaatgatctagatcttcaacaataggctcatttttccaatttcca

SEQ ID NO: 6421 - DNA, 201 bp, Homo sapiens
acctaaatctgcccctaactccaacccccattcgtaaagaccccagtctccaagtcaacagaggcaagagatcccaggtccatcatgagtcaggacaggcrgctcatgtggggaaaaggatgcattctttgtttttgctcctggctcagatttcggacacatcattgtaatcctctggtcttctgttgcaccatcatgtct

SEQ ID NO: 6422 - DNA, 201 bp, Homo sapiens
cccacatgcccatcaacaatggaatggataaagaaaatgtgatatatatacactatggaatgctacacagccataaaaaagagtgaaatcatgtcctttcsagcagtatggatgcagctgaaggccattatcctaagtgggttaacaagggaacagaaatccaagtaacacatgttctcactaataagtaggaactaaaat

SEQ ID NO: 6423 - DNA, 201 bp, Homo sapiens
tgaatgggcaaggcaatcctaagcaaaaagaataaagccaaagccatcacattacctaacttcaaactatactacaatgctacagtaacccaaacagcatrgtactggtaaaagacacatagaccaatgaaacagaatacagaccccctaaaataaagctgcacacctacaaccaactgatctttgacaaagtcaacaaaa

SEQ ID NO: 6424 - DNA, 201 bp, Homo sapiens
taatttgatacttactggtatggctgtttgttattgcagagcatgtctggtccctgcaaccagattactaattatgaaaaaacagaatctaaccctaaccytaacatggcccagacctcgctaaatgattttaggcattaggccaatacagatggcctaaagactttttatatttcttccttttataaaacattaattttg

SEQ ID NO: 6425 - DNA, 201 bp, Homo sapiens
ccaggaatctatattctgaaccagcatacttggcatcattgatgcaggaggtccatagactccagtaagagacattgtattagggactccacttttcactragcacataatttgatacttactggtatggctgtttgttattgcagagcatgtctggtccctgcaaccagattactaattatgaaaaaacagaatctaacc

SEQ ID NO: 6426 - DNA, 201 bp, Homo sapiens
ttttaagtaaaaatacatcataagttcatactgatactttttaaattgacattgtatattaatatttatggggtacggtgtgatacttcaatacatgtatrcaatgtgtaatgatcaaggcaaggtaattagcttatccatcacctcaaacttgtcatttcttgtatttagaacattaaaaagtctgcttttctagctatt

SEQ ID NO: 6427 - DNA, 201 bp, Homo sapiens
gttccatctttggccagttgatttcagattggcttctgagtccctttgacctgtagtctttggtaactgctttgctcattgcagtgacaagacactctagraaggtttatcttgttcatttccaccctacaccttgaatcacccactttcccagtggtctccctcagtggaaaataatttaaaaaccaaactctaagtgga

SEQ ID NO: 6428 - DNA, 201 bp, Homo sapiens
tgtcaaacatagaaaacagaaaaaatagtataacaaacccccatgtatcctccactcaattttaactattttcaattcgtgactgatcttgttttgtccayattcttaccaatgttctccttccaatgcattattttgaagtgaactccagatatcatatcattcatctgtaaatatttcagtatacatctctaaaagtca

SEQ ID NO: 6429 - DNA, 201 bp, Homo sapiens
tggtctagaaagcaagggccactcacttttcaaagtatccacggagaagctatgtgactcaggcaaatgcagttacagggacctggctcagcctcttcctrtctgtgtgaacttgggcaagtcttttcaccttgcttaccctcagtttgctcatttcgagaaaggtgataattcccagccttgctggtttattgtgatgat

SEQ ID NO: 6430 - DNA, 201 bp, Homo sapiens
ccccatattctgggaaacacttatgtaacctaactctctcacatgtccaaaggaggacaggacactaactggtctcctgtaaccaaacaagttgctgccasatcccggtgttctgatcctttgttgaacgttccttcctctgttctgtgagtcttttattagcattaagagtggaacccaagcctcctctttaaagttggc

SEQ ID NO: 6431 - DNA, 201 bp, Homo sapiens
cacaaccagaaaatgttagaagaatggaccatctttattagcatcagataaaacagacttcaagacagtattcccggaggggcatttcataatgagaaaarggtcaattcatcagaaagatataataaccataaatgtgtatgaacttaataacagaacccccaaaaatacagaatggaactaaaaggaaaaatagacaac

SEQ ID NO: 6432 - DNA, 201 bp, Homo sapiens
catggatcctactcacaagtcccctgaaaaacagagaactttctccagctggagtcagagaagtagcagagaagaagtcagagagactcaaagtgtcagargatcttcattcaccattgctggaggagctacatggaaagcatgagaaagaagtctctaggagcaaagaccagcctgccatccacagactgcaaataaatg

SEQ ID NO: 6433 - DNA, 201 bp, Homo sapiens
gaatcccccaaagatgtccacacctttaaccctggaacctctgaatgtgttatgttacatgaaaaaagtgattatggacctaaaaacggagagattatccwggtttattccatggatcctactcacaagtcccctgaaaaacagagaactttctccagctggagtcagagaagtagcagagaagaagtcagagagactcaa

SEQ ID NO: 6434 - DNA, 201 bp, Homo sapiens
ttgagatgagaggtatagattaaaagccaataaataagttaaaacaaagtgtgtaaatactctaaaaatccataaaaaggcagatataatgggcaaaatgratcccccaaagatgtccacacctttaaccctggaacctctgaatgtgttatgttacatgaaaaaagtgattatggacctaaaaacggagagattatcctg

SEQ ID NO: 6435 - DNA, 201 bp, Homo sapiens
aataggacaaatgtggagaaaaccatgctaggcacatcacagtcaaactgatgaaaatcaaaagaaagaaaatctcaaaattagcaagagaaaaatagcamattatatatagagaacaatgattcaaatttttcacagacttaagattagaaactacagagtccagaagacagtggaataatgtctttataagtgctgggg

SEQ ID NO: 6436 - DNA, 201 bp, Homo sapiens
gggccacaaggccagatgagccagtttatcaatctgggtggtgctaactgatccatcagatgaagggtctgcaaaatatctcaagtaccgatcttaggttktacaatagtgatgttatccccaggagcaatttggggaggtttagagtcttgcagccttcaactgcatgactcctaaaccataatttctcatcctctggct

SEQ ID NO: 6437 - DNA, 201 bp, Homo sapiens
gaaagaggagacttagagaagggaattcttggcatgtatatgtaaactctgcccaagcctctggccagtccttgaacaaagggtgagtagacaaggctcaragtagtttgcatttaaacccaacaggactgagaactaagcctccacctgagagacagatatggaaatgtaagtataaccaggttagttacctgctaagac

SEQ ID NO: 6438 - DNA, 201 bp, Homo sapiens
caatagccagctccatccacttagccatgtcatgagccatctcatacatttcagcccaactgtgctctcagggaactgtagcctcagctgttattacatgsagcagaaaaaccacctagtagagcccagtcaacccacagaactgtgactgacaataaaatgattcttgtttctagctcctgtatcttgtagcaagaatat

SEQ ID NO: 6439 - DNA, 201 bp, Homo sapiens
tcagtaaaacagaagcttccacttcttccctgatataacaattgcccttgggtatgtcaactcaaaactcaaccaccatgctttgtgaaatccaagccacwtaaaaaggttacattaggcagtgagctacgcccccaagccaatagccagctccatccacttagccatgtcatgagccatctcatacatttcagcccaact

SEQ ID NO: 6440 - DNA, 201 bp, Homo sapiens
tctcctcttgaatctgaccagcacagtgactatgtgaccaatagaaaagcctaattttcagtaaaacagaagcttccacttcttccctgatataacaattkcccttgggtatgtcaactcaaaactcaaccaccatgctttgtgaaatccaagccacttaaaaaggttacattaggcagtgagctacgcccccaagccaat

SEQ ID NO: 6441 - DNA, 201 bp, Homo sapiens
gcagactggttggtgagacagacaaatagattttatgatttcagaacaatgtagtaaatgttaaagtattacagaatgctatggaataatggagagatgaraggctcattcaccctgggaaataaaggaagcctttctggagaagacaaagagttgtgtagatagtcatttgagaggcaagactggggggaaggggagagg

SEQ ID NO: 6442 - DNA, 201 bp, Homo sapiens
aatcttatacacactacagttcaagaatcacactctaggtagagccaaccttgacgtcaaagaaatctcgagttcttgttctgcaccaagcattgggatcsctgatacagaaaaaagcagctcaaattcaatgtttgagtaagcacttgacttcagccttcaggatacaacctgctaggcctccaggtgaataatttaact

SEQ ID NO: 6443 - DNA, 201 bp, Homo sapiens
tccagataccctagaccagtggttctcaacatgcaatgactgtgctccaccaggggatatttcgctatgcctggagatgcatttagctgtcacagctaggrggcagggtatgactggcacccagtgggtaaagaccagggttgctgctaaacatcctacaatgcacaggaaagctccctattcacaaataattatctagcc

SEQ ID NO: 6444 - DNA, 201 bp, Homo sapiens
tggacattttatccatccttcatggttttaaatatatgccaatgccttccaaatccagatcattccactgggctttgatatttaaagaactggatgttcayggtgccccataagccagttaagctcagcagactctaaaactgaccttgtcatccaccacccaaacttactcagtgatacctcaatccacagccatccaga

SEQ ID NO: 6445 - DNA, 201 bp, Homo sapiens
tagtgttccccaaggctctgtgttgcatccattgttcctcactgggtacatcatttacttggacattttatccatccttcatggttttaaatatatgccartgccttccaaatccagatcattccactgggctttgatatttaaagaactggatgttcatggtgccccataagccagttaagctcagcagactctaaaact

SEQ ID NO: 6446 - DNA, 201 bp, Homo sapiens
ttcaactcactatattatcattttaatgtgcaatcaatataaaaattattattaatgagatatttcacattcttttttttcacagcaagtctgaaattcasagtgaatttaacacatatagcacatttcaggtcacactagccacacttcaaatgctcagtagacacagggagtcaatggccatcctgttgcacaaaacag

SEQ ID NO: 6447 - DNA, 201 bp, Homo sapiens
ttattcaactcactatattatcattttaatgtgcaatcaatataaaaattattattaatgagatatttcacattcttttttttcacagcaagtctgaaatycagagtgaatttaacacatatagcacatttcaggtcacactagccacacttcaaatgctcagtagacacagggagtcaatggccatcctgttgcacaaaa

SEQ ID NO: 6448 - DNA, 201 bp, Homo sapiens
atgtatcttattcaactcactatattatcattttaatgtgcaatcaatataaaaattattattaatgagatatttcacattcttttttttcacagcaagtytgaaattcagagtgaatttaacacatatagcacatttcaggtcacactagccacacttcaaatgctcagtagacacagggagtcaatggccatcctgttg

SEQ ID NO: 6449 - DNA, 201 bp, Homo sapiens
ggtgggcaccaccacacccagctaattttgtaattttagtagagatggggtttctccatgttggtcaggctggtctcaaactcccaacctcaggtgatccrcccgcctcagccttccaaagtgctggtaattacaggtgtgagccactgcgccctgccctcaaaccacatatattaaagtaaaaagaaaaagttgaaatta

SEQ ID NO: 6450 - DNA, 201 bp, Homo sapiens
ccatacctggtcgtatttatttttttgacagagttttgctcttgttacccaggcgggagtgcggtggcgtgatctcggctcactgcaacccctgactcccrggttcaagagagtctcctgcttcagtctcccaagtagctgggattataggtgggcaccaccacacccagctaattttgtaattttagtagagatggggtt

SEQ ID NO: 6451 - DNA, 201 bp, Homo sapiens
tttgggagggggtgagggataaaagactacaatagttagtagtcttaggtgatgggtgcaccaaaatctcagaaatgaccactaaacaacttatccctgtraccaaaagcacctgtaccccaaaaactattgaaatagaaattaaaaaaattttaaaacagtatgaattattaatgcattaggaggcaaagacagtgaaat

SEQ ID NO: 6452 - DNA, 201 bp, Homo sapiens
gcgagactccatctcaaaaaaaaaattacataatggactttggggacttaggggtagggaaagtttgggagggggtgagggataaaagactacaatagttrgtagtcttaggtgatgggtgcaccaaaatctcagaaatgaccactaaacaacttatccctgtaaccaaaagcacctgtaccccaaaaactattgaaatag

SEQ ID NO: 6453 - DNA, 201 bp, Homo sapiens
gtaactcgggaatggaaaaccaaatatcgttatgttctcacttataagtgggagctaagctatgacgatgcaaaggtataagaatgatacaatgggccggrcacagtgactcacgcctgtaatccccgcactttgggaggccaaggcgggtggatcacttgaggtcaggagtttgagaccagcctggctaacgtggcgaaa

SEQ ID NO: 6454 - DNA, 201 bp, Homo sapiens
ccacacttcagccttcagcagtagtgaaacatgagtcactgttaagttctcacgatgaaattctcactattagttcagcactattaagtgactcatgttcsacacttcagtggtagattctgtgttcagcaggtcccacattttgaaatttggggtgaattcttcctgcgactctgtggtaataaagaatatgaattatgc

SEQ ID NO: 6455 - DNA, 201 bp, Homo sapiens
ctgagaatgtgcatattttggccctatctcaagtgatagtgatgatgctggtccagaaaccacactttgagaaccacagcacaaaggttacccagtgcccwtccttgtttaatagtgactcattttccacacttcagccttcagcagtagtgaaacatgagtcactgttaagttctcacgatgaaattctcactattagtt

SEQ ID NO: 6456 - DNA, 201 bp, Homo sapiens
caatccctgcccctcactttctgattcagtaggatgcatatgggcctgagaatgtgcatattttggccctatctcaagtgatagtgatgatgctggtccasaaaccacactttgagaaccacagcacaaaggttacccagtgcccttccttgtttaatagtgactcattttccacacttcagccttcagcagtagtgaaac

SEQ ID NO: 6457 - DNA, 201 bp, Homo sapiens
agtaattgtgggtggggtaggggagaaatctagctgctgctatcagatgcaatgtgaaataaagaaaaataatgtttgtggttcagttactagaatggatmagatgactgtcaccctttggatagctcttctttatcctttaggacttggtcctaacttaggtctttcaggaagttttttcacctccccagtgcccaggct

SEQ ID NO: 6458 - DNA, 201 bp, Homo sapiens
tgaagtgtttctttttaactacaaatcatctaaactctccttaaaattattcaatctttttccaggcaaagagattttctttggtgaagagaaaaattgcytaaagtggtttgacccacacctctctctctggcctccttcctcttcctagaaatccagctattgattcagcttctactcatgcctgtaatctcttgctca

SEQ ID NO: 6459 - DNA, 201 bp, Homo sapiens
ccatgtcaccttcttgacaagcaatagtgctgaggtcagaactctccccatagccataccctaaaagatggtacatccagacaatagaatattattcaacrcaaaaaggaagtgtgacatcaagccgtgaaaagacattgagggaccttaaatgcacatttctaagtgaaagaagccaatctgaaaaggttacatactgta

SEQ ID NO: 6460 - DNA, 201 bp, Homo sapiens
attgcttgaacccaagaggcagaggttgcagtgagccgagatcacacgactgcactccagcctggacaacagagactgtctcaaaaaaaaaaaaagagagwgataccatctcataccagttagaatggcgatcattaaaaagtcaggaaacaacaggtgctggagaggatgtggagaaataggaacacttttacactgttg

SEQ ID NO: 6461 - DNA, 201 bp, Homo sapiens
aaaaaaccaaacaccacatgttctcactcataggtgggaactgaacaatgagaacacacggacacaggaaagggaacatcacacatcggggactgttgtgrggtggggggcggggagggatagcattaggagatatacctaatgctaaatgacgagttaatgggtgcagcacaccaacatggcacatgtatacatatgtaa

SEQ ID NO: 6462 - DNA, 201 bp, Homo sapiens
acactatgtagaaggtgtagtcacagggtgaggggtgtgagggaaatggtggcagcaagaagttgagcctgggcatctgggaggatggtggtgccatgccmtggaggaggaccagtttgaagaaggaatatcataggagtccaataaatactactagaatgaatgacttaataatcagtatgtaagttacattcattcccc

SEQ ID NO: 6463 - DNA, 201 bp, Homo sapiens
tatgaggtcagttctattttatcccttttaacaaataagtaaactagagcacagatgggttaagtgacttgtccaagatcacacagcaagctagtagagaygggattcaaactaaacggtaactcaagtcccttctcttaagccctccatctcatgtactcagaggcattaaatctcaaggtatacataaaagataaggta

SEQ ID NO: 6464 - DNA, 201 bp, Homo sapiens
ggctcgaatagaagaaattcatttcctccacgctcttgctccacacattcatttattttccttatctcaatggaagaagaaacattgccccttttgaaacrgtagtaaagattttaaagaaaaaaggagaacttttgaagtaaaaatatgacgaaattggtactaggttttgcataatggtgggccattagaaacggcctt

SEQ ID NO: 6465 - DNA, 201 bp, Homo sapiens
tggtggtaattctcatattctggttttcataatcatctgaggagttgaagtcatgtctcataccacccaccaagaaaaattccaaatattaaaaaatgcarccaaaaaagaagaaaacacgaggtaattatcttgtaataaagaatgatgaaagacttttgaattacgtctcaaaattcaacagccataagcaaatggttg

SEQ ID NO: 6466 - DNA, 201 bp, Homo sapiens
tgaatgatccttgacatcaagaagctcaaagactagctggaaagatactaatatagcaattccttttattttctctaataggagacccactcgcaactatsaggaatagatactatcagcagcaacagcaactttttttttaaggacaaagaaagtaaatatgggaaaatgtaaacttgtccaaagacatacatctagtca

SEQ ID NO: 6467 - DNA, 201 bp, Homo sapiens
gctgaggcttgagaaccactgcctagaaattaggtgctattatcatcactttgcaataaacacctgaggcccagaaaagtaaaatgatgtgcaagtcatayagaaagtggacgagacaagctttgaacccagacaagtctaactccagagttgaggcccttaatcacagttctacactgctcattatctgaggaataaagc

SEQ ID NO: 6468 - DNA, 201 bp, Homo sapiens
aaaaaaaaagatgtctgtgtttacttgagtttttattaaggaaaaaactttctaactctatgatgtggaagcaattatttttgagctttgtttgcagtgtkggggtggatctcagaaaccaggtcattgttgatctgattttctctggagatgacgctaccccatttagaacagctcactgaaccctgatgtctatgcccg

SEQ ID NO: 6469 - DNA, 201 bp, Homo sapiens
ctgtagtgcagtgttgtgatctctgctcactgcaaccttcgcctcctaggttcaagcaattcttgtgcctcagcctcccaagtagctgggattacaggcaygcaccaccatgccaggctgccttgggtgtttctttatagcaacacaagaatggactaacatgggctcagagaggttaggtaacttgtctaagaccacaga

SEQ ID NO: 6470 - DNA, 201 bp, Homo sapiens
tgaacatgtttcataatcttcccataactcggttttatcatatttacaatgggcaaaactactcacctcatattgctggtggaattaaatgaatgcaagtktggcacatctctaggaatttatctaagtcttttttaaattgattattgtattatacctactataacgacgtgtattttctatgacattttgtgattcaag

SEQ ID NO: 6471 - DNA, 201 bp, Homo sapiens
cggccaacctttctgaaacccagaagaaagaagagcaagtggggctcagagtcacagttgctcagcactgcaggcagggtccgtatgtcataataacagayggggtaggtaccattgctcttgcagcctgcaggtcccaaaggaaattgtgtcattttatcttgcctagctccaaaaggagcagcctctgtcagaagatct

SEQ ID NO: 6472 - DNA, 201 bp, Homo sapiens
tagccaaatgtggtagtgcgcacctgtagtcccagttacttaggagggtggggcgggagaattgcttaatccaggaggcagaggttgtagtgagccgagaytgtgccacagcactccagtctgggagacagagcgagactctgtctaaaaaaaaaaaaaaaaaaaaaaaaaaaaggagatataatcctttttgtttttttg

SEQ ID NO: 6473 - DNA, 201 bp, Homo sapiens
ttagcatttgacaagcattttttaaattaattgtcagaaaagttccttcaaatctgctttcccaacaaattgaacatcagtggttttcacctaacaactawtgacttcaggttatgacaagattaaaatatttcattttgttttatccatcagttgaagtacataaaccatacttttctggtattacaagcaatatcagtg

SEQ ID NO: 6474 - DNA, 201 bp, Homo sapiens
gtttgcagatgctctctgggggtctcagcacatttaaaggctaattatatagttaaagttaattattcattcattaacattcaagaagcctttaacaagasactgcttgtcttgatgaattaatgaaaccagcatgtgcacatgagtgtgtgtgtgtgttactgaaaattaaaacatctctttgatgataactgaatatat

SEQ ID NO: 6475 - DNA, 201 bp, Homo sapiens
agcgagggttcgtcaagttcagggaacagaaggaaagtcagaacagctgaagtttaaggagcaagagagagtggtgagacatgagttaggacaggaagcaraggccacatcacacaatgaatgccctgtagtcaggatagggagtctgtatctaattcctaggtcaactgtattgcaaacaactcctctgctaaatgtgcc

SEQ ID NO: 6476 - DNA, 201 bp, Homo sapiens
acatggaattagttactaatatttaaaaatggaaaggtttctaacaaaatcagatgacattttctctttttaaaaaactagaagacctgataatattgackctacattcccataagacaatactcagcaggagttgaggatggctgccacgctactggtgaggtaaacatcatgcaattggccacagtcctcagtattccc

SEQ ID NO: 6477 - DNA, 201 bp, Homo sapiens
attcccattctctagcaaaatctcattttggaattgcatgttgggtgcctgcctcttactaccatgcctcttctcagctggtgtcatctcctctggggaartttttcatcatctttgctcaattaggaattaatctccctcatctgacttttctagtatgatttttcattcatgtcttaatcaccacctgacactttattt

SEQ ID NO: 6478 - DNA, 201 bp, Homo sapiens
ccctgtgcccagcaatgtgcctaacatgcaaactgtgcttaatgcacattcattcattctgtattaaaacaatttatttataacaattttacttataacartgtctgtgttatttcactgtaaaggaattcagcaaaaatcattaaaacattcctgaccccaaaacatggtctgtttcacacaattatgaatcatgatgaa

SEQ ID NO: 6479 - DNA, 201 bp, Homo sapiens
acttgcacacatatgtttatcagagcacaactcacaattgcaaagatatggaatcaacctatgagcccatcaactgatgattgcataaagaaaatgtggtrtatatacattgtggaatactactcagccataaaaaagaatgatgcaatgtcttttgcagcaacttggatgaaactggaggccatcattctaaatatatga

SEQ ID NO: 6480 - DNA, 201 bp, Homo sapiens
ctaaagatgttaacttccttgtcatcagtaagaacaaacctaatgatgttattacaacatccagatatggggccaattatttatatgttcattttatatgrtcccgcatttagaatagaatgaaattttaatttattattttggtttttacctgcctttatcattaggaagtgatgtttattagtcagtgaattaagagga

SEQ ID NO: 6481 - DNA, 201 bp, Homo sapiens
aatacccacccaagcttggaacaagacatgggaataaaagggcagaacgtgacaatagaaagacttcattgcaattctgacttgatcatctgctagctgcrtggcctcggagctacagttatcctgtctgtgaaataggcataataatagaacatacttcctagagtcgccatgaggattgaatgagatgagaatgtataa

SEQ ID NO: 6482 - DNA, 201 bp, Homo sapiens
tgcttttctcatgggtactttgccctctaagaagcctactttcctcttttcctctcctcctctccctatttctctttgttgagagagcagtcagattaacmcaacaactcttggagtgccttggtcacctgagagcatggaaagtccatgccctcaccagagtaatgactaccatttctccaaaactctcctcatgccatc

SEQ ID NO: 6483 - DNA, 201 bp, Homo sapiens
atccatctatccacccatccatccatcattcatccattcacacatactttatttagggtctatgtgccaagtgttgttctgtgtgctaagtgtacaatggygacaacagtagtagcacgatattatgggttcttcctctgacatatgctaataaccccactaatatcaccagacctcaagaataaatacaatctaagtaaa

SEQ ID NO: 6484 - DNA, 201 bp, Homo sapiens
cgtgccatggtggttggctgcccctatcaatctgtcatctatattttaagccccgcatgcattaggtatttgtcctaatgctctccctcctcttgcccccmacccctgacaggccccagtgtgtgatgttcctctccctatgttcatgtattctcattgttcaacttccacttatgagtgaaaacatgtggtgttaaacaa

SEQ ID NO: 6485 - DNA, 201 bp, Homo sapiens
tgttaatttctttggctgcatagcaaccactactgccatcaatgccctcggggaatgctcactcttcctgtccgccatcttgatgagtctattaaatgcasttgcttgatcgagagctgagatgcaacatgcaagctgtgtccaacaggctttttaattttgagtagcatgccctcagagtcctgcctagtcccctcaacc

SEQ ID NO: 6486 - DNA, 201 bp, Homo sapiens
agagatcagggtgtcttcaagagtttgaatttctctcttctcaagaatagaaggaaaattaagcattatttttttctctcaatgattttgccttttataawaagtaactcttatagactccttactatgtgacatgccctgtttcaaacatataaaatatattaactaatttaatgctcataacaactctatgaggtcagt

SEQ ID NO: 6487 - DNA, 201 bp, Homo sapiens
taaaggaagttttctttgggaacaaagtttataaaagcacaatgctgaaaagtcagaggcaggacagctgcaaaagatgtggttgactctgaccaaagcarttacacattggcatgactggggtgggctggtggtcatgctgtcagaggggtctggccatggaggcacacaattgggccagccctccatggcctgactgtc

SEQ ID NO: 6488 - DNA, 201 bp, Homo sapiens
catcctgtctccctcccttgcacccccttcctcagctaactagtgttcccctggctcaaagaaaatgtggaagttggtggtttttcacaaggatgatactrtctggagctgctgtcctctgagagtaggacgggtcagaagagatctgcacctgctctgttaaggtagtcttgccatctctaagggtttgatttgctggct

SEQ ID NO: 6489 - DNA, 201 bp, Homo sapiens
gtagacacagggagtcaatggccatcctgttgcacaaaacaggtttctgtggtcaaggtgatctcctcgtcccatggtccttttttgaacttggtgttacygaatctttcctctactgacatcacctcccttttctccttgacacactctcctccattgctgcctgaaacatctttttctccttgtccttctcttatatcc

SEQ ID NO: 6490 - DNA, 201 bp, Homo sapiens
cagctggggagagggcttaacagagattgattacatacaattaccagaagaatggaaatgagtgttaagataaaaaatacacaggttcattccataatgasaatagaaatatagtggacatagaatatctttcctcatcaagcatccattctagttttttactgaagaattgtccctgcttgcccctttatccctgtggac

SEQ ID NO: 6491 - DNA, 201 bp, Homo sapiens
atctctagaacattggtcctcaaagcacagcccctagaccaagaacatcaacatcacccaaaaacttgaaagaaattgcaaattctctgggctcaccccayattttctattacattagaaactctgagattgaggcccagtaatttgtgtcttaacaagtcctcccagagattctgatgcctgctgaggcttgagaaccac

SEQ ID NO: 6492 - DNA, 201 bp, Homo sapiens
tagagaaaaagctatagaaactaacacagcttcctttggctcttaccaggtgaaccttgagaaatctctgagatggcctcatgtatcacactagagcttgmaaatggcataaaataatcagataaaacaaggtacaagatgaggaggcatcaggttccttaatgctttaacatcagctcagtgcaaatggtgaactgatag

SEQ ID NO: 6493 - DNA, 201 bp, Homo sapiens
acaagcaaaactaatctatgatgattgaattcagaataatggttatcttggggttggtgagaagggagcaaataagaacttcatagggaactagaaatgtkctatatctttgcaatgtatctatgtaataaaactgcacttgcacctcttaaatttaaacaaaatttttgagatttttcgtgaaaacggccatactgccca

SEQ ID NO: 6494 - DNA, 201 bp, Homo sapiens
ttacaggtgtgtgccaccacacccagctaattttatttttagtagagatggggtttcaccatgttagccaagctggtctcaaactcccaacctcatgatcyacccgtcttggcctcccaaagtgctggaattacaggcgtgagccaccgtgcccagccaatgtcacgcacagttttaagcaaaactatgtttcagtctcag

SEQ ID NO: 6495 - DNA, 201 bp, Homo sapiens
atgggaaggttatgaggactttttaatatcacaaaggagttcttgtgttttaaacacatacagatttaagaaaaaaaaggatagcaataacttcagatccygtgctgttttgagagccactggctaaactgggtttccagtactacagcagctaacaaccctgccctaatgaccaacgaggggaagtaaatctgggtgttt

SEQ ID NO: 6496 - DNA, 201 bp, Homo sapiens
atgccagaaacctatctggaggaggataagcagagcatccatccatgtgcacaccctggggcctgcgcccccccataaatcattatctgaaccaacaggayaggctgctgggacacccactctacttatcagagcccagcagttgtgcccaaggcaacagcacctgaattttataattctgcaggtgaaatttagtgcaaa

SEQ ID NO: 6497 - DNA, 201 bp, Homo sapiens
ctactctgagcctggagctgggtgctggatattcaacaacagataagaaaggcagagaccctgtactagtctgttcttgcattgctataaagaaatacctsagactgggtaatttataaagaaaagacgtttaattggctcacagttctgcaggctttacaggaaacatggtactggcatctgcctggcttctggggaggc

SEQ ID NO: 6498 - DNA, 201 bp, Homo sapiens
ttctagaaatgcaaattgtcagtctctttgcctccagacctaatgaaacaaactccagaaataacattcggaaatctgttttcacaagctttccaggtgastgacacacactaaagtttgaaaaacattgggttaacacgccgggcacagtggctcacacctgtaatcccctgtaaacccaacattttgggaggccgaggt

SEQ ID NO: 6499 - DNA, 201 bp, Homo sapiens
caactctctgtctttttgttttctttcgtttttccttttgatgatgagccctactttgtctctctgtccagtgggtgtctacctgctttctgtgaattacmactagacatccagtgaggtaactcaaaggcagagaggaaaggtcgggggtgatatgccaatgggactctaacattcctaactccacttacatcgttaata

SEQ ID NO: 6500 - DNA, 201 bp, Homo sapiens
ctgtatctctggagtgttggaatcagtagatctgggataaggtgtgggatcctgacttttcaaccagcgtcctagagtcattctgctccgtgtggtctaakgaccccattttaaggagcaccaggaggggaagacctatgactaacatacaggattaaataaagcataagaacaagatggaaatctttcttcttgggttac

SEQ ID NO: 6501 - DNA, 201 bp, Homo sapiens
ttatcacaaggacaaaaggccaaacaccacatgttctcactcataggtgggaattgaacaatgagaacacatggacacaggaaggggaacatcacacaccrgggactgttgtggggtggggggaggggggagggacagcattaggagatacacctaatgctaaatgatgagttaatgggtgcagcacaccaacatggcaca

SEQ ID NO: 6502 - DNA, 201 bp, Homo sapiens
cagcctgggtgacagagcaagactctgtttcaaaaaaaaaaaaagaagaagaaaagaaaaacattgggttagcaaaaagacacatgcactcatatgttcgytgcagcactattcacaataacgaagacatggaatcaacctaggtgcccatcagtggtggattggataaagaaaatttggcacatatataccatggaatat

SEQ ID NO: 6503 - DNA, 201 bp, Homo sapiens
actccctcctcaaaactcccctcacttcctctgcagctccatttccaccttagagtttttcaaacacatacattctcttctttgctggagggtaagctccygggaaacagggatcatgtctgagccctcgctgcgtgccctcacccctgcacagtgtctggcatgtggtaggcggtcagtgaccatttgctgaatgagcag

SEQ ID NO: 6504 - DNA, 201 bp, Homo sapiens
agtcacttcatctcttggcattgattttgtattttgggcttctgatcagacacatctgtgtttctagcttttgtccccactgatttatagtataacttgayagatgtcccatctgtattttttgaatcctcatccattttcagtgagatgacaatgcctcaatgcaaagcctccatgtcattttggtaatgaaactcaaat

SEQ ID NO: 6505 - DNA, 201 bp, Homo sapiens
tggggtggagagaggagccccactctaggtcatctgatctgctacattggagctgatcaaaatgatatgaagaaggagtcatccaggcaaagattaggggygagatgagagtagggagagccattccagcagaagacacatatgccaaggtaagcgagggttcgtcaagttcagggaacagaaggaaagtcagaacagctg

SEQ ID NO: 6506 - DNA, 201 bp, Homo sapiens
gttttgccggcaaaacacacagtataccatgacgataaaaagccgcaggataagaagagtccctggtgaagaaaaggtgaggaacttcagaagaattcagrcccaaatctctttcaaagatttggaaactgggttcccaaaaagagagttgacacatccagggtcggagtgatagtgacacagtcaagactagaatccaag

SEQ ID NO: 6507 - DNA, 201 bp, Homo sapiens
aattaatgtctttttactttaatgaatcttatcacctttatcataaaaaagtgaagggaatgtgtaagacttcacttcttccatgagaccttcccattttygtaagctcatttttaccagctaattcttccaacaacccagcctacaaaaggtataacgcagagtaggaattccagggggaaagatgtgcaaagtaaatct

SEQ ID NO: 6508 - DNA, 201 bp, Homo sapiens
taccagctccctggaagatgagtcagattctaaggtagcacagaaaattcacaggtgtgagtcaagcctgctccaggactggttaaaaccaaccaaagggratgatttggtggctccaaaagtgaatcgcagattgtgtaacatcaaaaggttgaaaaccccaaaatgcaacaacataaggcagaaaggctccaactctct

SEQ ID NO: 6509 - DNA, 201 bp, Homo sapiens
tgttcctccatgtcccaccttgacacctctagaaatctcttccctctgtctagaatgtctttccctatccccttcacctgtggaggttttactgtgattaygaggcacacatcaaaacaccacagcatccaacatatagcaggtgcttgataaatatgtgttgaataagtgaatacaaactccctagcagaatagaatgca

SEQ ID NO: 6510 - DNA, 201 bp, Homo sapiens
acccaggcaaaataattttgaaatagaaaaacaatggtgaaggacttacattaccctcatttcaaacatattacaaagctacagaaatcaagagagtgtgrtattaagggaaagagacaaatcactggaacaaaactgaacgtttagaaataagctctgacactgtcaattgatttttgacaaacatgacaggataatttg

SEQ ID NO: 6511 - DNA, 201 bp, Homo sapiens
ctacccaaaggaaaagaagttattatatcaaaaagacacttgcacacatatgtttatcagagcacaactcacaattgcaaagatatggaatcaacctatgwgcccatcaactgatgattgcataaagaaaatgtggtatatatacattgtggaatactactcagccataaaaaagaatgatgcaatgtcttttgcagcaac

SEQ ID NO: 6512 - DNA, 201 bp, Homo sapiens
ttaactaatttaatgctcataacaactctatgaggtcagttctattttatcccttttaacaaataagtaaactagagcacagatgggttaagtgacttgtycaagatcacacagcaagctagtagagacgggattcaaactaaacggtaactcaagtcccttctcttaagccctccatctcatgtactcagaggcattaaa

SEQ ID NO: 6513 - DNA, 201 bp, Homo sapiens
ccatctctgaatgaggaggctaggtttttccaacggtggagccacaaaagtctgttttgacaagttatctccccgtaaacatactggtttatctcatgctraacaattagatgtgctatttaggcaaaataaaaaatatattgcacattttctagacagcctgttagcatccatgccaatgacacgaacatcaggacatgg

SEQ ID NO: 6514 - DNA, 201 bp, Homo sapiens
tcagtatacatctctaaaagtcaaggactcctttttacaaatatcatcacaataccatcatcacactcaaaatttaccttaatccttaatattatcaagtrtctggtctgtgttcatatttcgctgattgttctatatacttttagaaaaatcgtattcttttgacttagaatacacacaaggtctatatgattaatatgg

SEQ ID NO: 6515 - DNA, 201 bp, Homo sapiens
gcctggagttcttggggtgagcctgggctgtgatggaaggcataacaagaaagctgaaactgttacgagccaaacttcctaatctcttgcacatgtcaatygcactacagtgcagatgcattcttaactgtttttattttgtctgtgtcaggtttacatgcacaccatattgcttattctgtattagagaaaccattaggc

SEQ ID NO: 6516 - DNA, 201 bp, Homo sapiens
aaaatagacccaggcaaaataattttgaaatagaaaaacaatggtgaaggacttacattaccctcatttcaaacatattacaaagctacagaaatcaagasagtgtggtattaagggaaagagacaaatcactggaacaaaactgaacgtttagaaataagctctgacactgtcaattgatttttgacaaacatgacagga

SEQ ID NO: 6517 - DNA, 201 bp, Homo sapiens
ttcaagggctgcttgaagcccgagatcctagtgacactgagatatttataaggtttcccttcgtattctctgagcactcctctcatcatcagattttccasatgataagtttttagcaggcccttcttccccctctactcctgtgtggacctctgggctgcctttttcaggttttgcaaactggctatgaattgttcagcg

SEQ ID NO: 6518 - DNA, 201 bp, Homo sapiens
tctatttttcaaacaacccccaaaactagccacagcaacatgcaggggccctgcatcaacaggtacttgaatgctggtgaatgcgtcccaggcacctcacytcgttcgcccattttggtgcatcagaacaacgttgtcactggtctaacctcatcttcactccctggggactgaggtcttgcctgattcccaaagccctgc

SEQ ID NO: 6519 - DNA, 201 bp, Homo sapiens
attgtggccatggtttcacaggcacatgcatacatccaaactcatcaaattatgtatattaaacacacgcagtttttaatattatttagatgtcaatggarctgtttttaaaaaaaaaaaattgaccatgagttgaagctgaattgagggtacatgagtgttcattacacattctctctattcttgtatgtttgctaatct

SEQ ID NO: 6520 - DNA, 201 bp, Homo sapiens
ccactgatatttgagggcttatttgttatagcatctaccattatcctttgaattacgaagctaagggaaaaaaagcccattggctttaaaacccagcagarttcagtaggaggaggaagatggagaaagttataaagtaatcaagttgggtgggaacctcaggttagatcctcattacacttagaatgagcgttacccatt

SEQ ID NO: 6521 - DNA, 201 bp, Homo sapiens
tattttaaaaaaaagaacaagaatgctgtataaaacagtaaacagtaaaacataatgcagcaattaaaagttaatgccccaacatttattttggggatacrgcatatgtctcacctagtctgggactaaaaagtttcctgccttattcatgcaggggcttcttcatggtttgcgtaaggcagccaattaaagtagaaactc

SEQ ID NO: 6522 - DNA, 201 bp, Homo sapiens
tttttgtacgttagacagaagtatgcattgggaatacggttgcacatgtatgtgtattgaaagtacgaacacatgtacatggatttggatgtaaaccaaaytgattatcatgttttcccttctatggagagaacaggagaaaactgggacagggaaacagatagaatcagaacttctacattatcattaatgttttattgc

SEQ ID NO: 6523 - DNA, 201 bp, Homo sapiens
ggtaaaggaagttctaacacattagacaccatttttgtacgttagacagaagtatgcattgggaatacggttgcacatgtatgtgtattgaaagtacgaamacatgtacatggatttggatgtaaaccaaactgattatcatgttttcccttctatggagagaacaggagaaaactgggacagggaaacagatagaatcag

SEQ ID NO: 6524 - DNA, 201 bp, Homo sapiens
gatcctcccgcctcggcctcccgaagtgctgggattagaggcgtaaaggctgcagtcacgtagactcaaaagaaaaacagtattttaaaaaaaagaacaasaatgctgtataaaacagtaaacagtaaaacataatgcagcaattaaaagttaatgccccaacatttattttggggatacggcatatgtctcacctagtct

SEQ ID NO: 6525 - DNA, 201 bp, Homo sapiens
atcaataaaataaatgcaattgaattatcttcatagagggattttgaaaacataaggttgaggtaaaggaagttctaacacattagacaccatttttgtamgttagacagaagtatgcattgggaatacggttgcacatgtatgtgtattgaaagtacgaacacatgtacatggatttggatgtaaaccaaactgattatc

SEQ ID NO: 6526 - DNA, 201 bp, Homo sapiens
atttgcaacctccctgctacataggaggaatagtgagagctatttgtttatcagatgctttgcagagtaagaccttaatccagctgcaaatgtaatttttwagcttgaagtgaagaactcctaactccagagtcctgggcttctattgaacaagctggtagatctaacacaggctacagataggtctgttctctgctttca

SEQ ID NO: 6527 - DNA, 201 bp, Homo sapiens
ataataagagggtttgaacacagcactgtctaagtctacattccacaaagtcacatagctttgggaaaaatgatttgtgttcctctggattctctcacctygtatctcttgctgatttactttgagactcagctgtttttcccacttctgagttcagagtcccaatcagatgtacagcaaaggcccacaggacagcttggc

SEQ ID NO: 6528 - DNA, 201 bp, Homo sapiens
tagcacatgtcaccaaattactaaatttcaaaatgaaaacttctctagtattcatccctggaggaaatagatcaatgtgcctttttgttcggcattctggktccaaaatcctaagacttacatctggcctaaggcaaatgtgaacaatatttgtgctttatgtgtgaccccaaaacaacccaaaccacctttccctcaagg

SEQ ID NO: 6529 - DNA, 201 bp, Homo sapiens
cctcatccgtcgagacccaaagcttcatcacttccttatctctccaaagccaaaacttgacttgccatactttctcaatgtactgattaaataaaactgcyggtaggattaactctgcaaggatgcacccaacccagatatattcaccatagccatagattacacatttttggaaggcctactacgatgtctatcatggag

SEQ ID NO: 6530 - DNA, 201 bp, Homo sapiens
gatcattagcaggtcaggatatgggattattatcactaactccatctttttcatggtaaacaaaaaatataatttttgtgaaatctgatgatagtgtttaracattgggactttacttttggaaacaggaaaaacactctaagtttaaaaaaaaaaaaacatgcacacaacacaggtcaatttgcagcctctgaaagtcgt

SEQ ID NO: 6531 - DNA, 201 bp, Homo sapiens
aatgtcccctggcctagataattgcaactagtccttcaaaaatcagggcagtgtcacctcctccaggaagccccctggccccctcatcccccaaacagcascaaattcactgcgtgtttactttagctctttcccacatcagactgaaaccaggtctgcttctattttgtgcccctgacgctagcacagtgcccgcccggc

SEQ ID NO: 6532 - DNA, 201 bp, Homo sapiens
aggcaggagaaggtggaggttgtagtgagccgagattgcaccactgcactccagcctgggcagcagagtgagacttggtctcaaaaaaaaaaaaaaaaaamaaaaaaaaaacaaaaacctcatgcgtttaacaatctagtttttgtttaattgcttttcattcttttgtgatgatccatattctgtttggtattactttct

SEQ ID NO: 6533 - DNA, 201 bp, Homo sapiens
tagggagtgtgatgatattgcaaaagcacccagaagcctgctttgtacaaaggagaaaaataattacaagttaatggcctaagtgatctccagcatccctkcctgctctgacatcatgaaatacaattccagattattgtaaccaacaccatcaatctgcagatttaaaaaaaaaaaaggagaatcagaaaagttaagaat

SEQ ID NO: 6534 - DNA, 201 bp, Homo sapiens
aaaaaccaaggataagaggggactactgtataggttcgagtcattcaaaagcgactaacatatacgaagcacaaattatgtccattgagaagttttctgtytgaaattaaagtccaaagtatcttgtgcaaaagtgtttctcaaattcttacttaaaatgtcactttgttaacattcagctttgttaaatgtaaccatgta

SEQ ID NO: 6535 - DNA, 201 bp, Homo sapiens
tctcactccccgcctagagattgctccttctgcactctcttaatgagactgtcgttgtacatttttaaaaattttattctcaaaagccccagggagttggwataatgaaacatacttaattaagctatgcaaagcaatcctgccatctaggtggcattttttgttctattttccttggttattccgagaattatattatta

SEQ ID NO: 6536 - DNA, 201 bp, Homo sapiens
gtaataattattaattatgtctaattaggagggtaataaagcaaagtgatcccatgaccccacagatcctcccaacagtcaaaagcttcatgacatgagtscttggaaaaaaagaagagaaagttgcattaaacatcacccaacttctcaagagaaccagaaattgtgagtaggagcttttcatacaccctgaatctgccg

SEQ ID NO: 6537 - DNA, 201 bp, Homo sapiens
tattgtatttcacccacaggggttctttttacttgttgctgattttcaaaagaaaaaaagaaaagaacaaaattacaaaatccattacgtgaaggcattakaactgagtgtgaaaaacaatttagaatagaggctcccaagaatgtttgatttggagagaactagaaaatcattcttggttaaaaaaaaaaaaaagatgca

SEQ ID NO: 6538 - DNA, 201 bp, Homo sapiens
ctgagcctgcttaaaatgtagaaggcagataacgtttgggcttgaagtttgaaataacatttttttttccatttctcctttgggagggatattgtatttcmcccacaggggttctttttacttgttgctgattttcaaaagaaaaaaagaaaagaacaaaattacaaaatccattacgtgaaggcattagaactgagtgtg

SEQ ID NO: 6539 - DNA, 201 bp, Homo sapiens
gcacttaatgccactgaattatacagtttaaattgttaaaatggcaaattttttgttttctgtatttttccacaacaaagaatcattttaaatgaaagtamcaaagaaagcaagcagatggctgaatagaactgagctaattcaaggatacaataagtagttgaaaagcagtcatagctgagatatgagatttaaactcat

SEQ ID NO: 6540 - DNA, 201 bp, Homo sapiens
cacactgctgataaagacatacctgaactgggaagaaaaagaggtttaatggacttataattccatgtggctggggaggcctcacaatcatggtggaaggsaaggaggaccaagtcatgtcttacatggaagggagcaggcaaaaagagtttgtgcagggaaactccacctttttaaaaccatcagatctcatgagactta

SEQ ID NO: 6541 - DNA, 201 bp, Homo sapiens
tgtttttcacactgctgataaagacatacctgaactgggaagaaaaagaggtttaatggacttataattccatgtggctggggaggcctcacaatcatggkggaaggcaaggaggaccaagtcatgtcttacatggaagggagcaggcaaaaagagtttgtgcagggaaactccacctttttaaaaccatcagatctcatg

SEQ ID NO: 6542 - DNA, 201 bp, Homo sapiens
ggctgggggatgaatggtcagccaggagcaagtggtgggaattaaagatgctgagtgagaggttgacttaagcatgggatctaggagacagggagtgttaktagtctgtttttcacactgctgataaagacatacctgaactgggaagaaaaagaggtttaatggacttataattccatgtggctggggaggcctcacaat

SEQ ID NO: 6543 - DNA, 201 bp, Homo sapiens
ccacaccgtggcctggcaccaggccctccctggtgacattgggaaagtaggtcagtttcagagctggctgggggatgaatggtcagccaggagcaagtggkgggaattaaagatgctgagtgagaggttgacttaagcatgggatctaggagacagggagtgttattagtctgtttttcacactgctgataaagacatacc

SEQ ID NO: 6544 - DNA, 201 bp, Homo sapiens
accacaccgtggcctggcaccaggccctccctggtgacattgggaaagtaggtcagtttcagagctggctgggggatgaatggtcagccaggagcaagtgktgggaattaaagatgctgagtgagaggttgacttaagcatgggatctaggagacagggagtgttattagtctgtttttcacactgctgataaagacatac

SEQ ID NO: 6545 - DNA, 201 bp, Homo sapiens
cagcaaacaggaagggagcagtgaggggatgcaccacaccgtggcctggcaccaggccctccctggtgacattgggaaagtaggtcagtttcagagctggstgggggatgaatggtcagccaggagcaagtggtgggaattaaagatgctgagtgagaggttgacttaagcatgggatctaggagacagggagtgttatta

SEQ ID NO: 6546 - DNA, 201 bp, Homo sapiens
tgggcgagcagcaaacaggaagggagcagtgaggggatgcaccacaccgtggcctggcaccaggccctccctggtgacattgggaaagtaggtcagtttcwgagctggctgggggatgaatggtcagccaggagcaagtggtgggaattaaagatgctgagtgagaggttgacttaagcatgggatctaggagacagggag

SEQ ID NO: 6547 - DNA, 201 bp, Homo sapiens
cgagcaatctgcccaccttggcctcccaaagtgctgggattacaggcatgaatcacgatgcctgaccacaaaagtcttgtttttctattcagccatcgaargacatttaggtgttttacagtttggggcaattatgaaaagagattataaacatttgtgcacaggtttttgtgtgaccataggttaaatacctaagagtga

SEQ ID NO: 6548 - DNA, 201 bp, Homo sapiens
tttcatttcctgataatagatcttcccccacgaaccctggagggcatctctggccacagagattggttcagggatcggtacgtgactcaatctcattcaawcacatttcttctctgggaattttttattgcaactagaagggatcactgtctttctggattaaaaaagtatgtgaatcaatacttagtttagatgagttca

SEQ ID NO: 6549 - DNA, 201 bp, Homo sapiens
acttgactccttcaggttagacgcatcctcttccaactctcaacccctgttcttcatgtggcacacaccacttagagggcaccttctttatttatgttggkcccaaccactcaggactaattttaaaaagacacctctttctgaagaccctttactaccatttgccaaaacaactgtcaaaataaaacacaaatgtttgat

SEQ ID NO: 6550 - DNA, 201 bp, Homo sapiens
ttaacaaggctgatttcaagctgtttcttcattgtggggtttcctaataatctttccttctcttggttctgtttttttttttttttttttggcgggggggkgggggggtgggtgggggtgacggagtctcactctgttgcccaggctggagtgcagtggtacgatctcggctcattgcaacccccacctcctggattcaag

SEQ ID NO: 6551 - DNA, 201 bp, Homo sapiens
ttttaacaaggctgatttcaagctgtttcttcattgtggggtttcctaataatctttccttctcttggttctgtttttttttttttttttttggcgggggkgtgggggggtgggtgggggtgacggagtctcactctgttgcccaggctggagtgcagtggtacgatctcggctcattgcaacccccacctcctggattca

SEQ ID NO: 6552 - DNA, 201 bp, Homo sapiens
taaggcgcaccagcactcatttaacctccctacacctcagttgccctctctgaaaaatgggggggtggtaccacacacttctttatttttccaactctacratatttaattttctctcctcatcttcccctactcccatgaatacacaatgcatttggtcctaaccccatctcttagtatatgctgttcctcccacccaga

SEQ ID NO: 6553 - DNA, 201 bp, Homo sapiens
atatttgctcatccatgctgctacaaaagaactctggtcttcaaatcaggagacctagaatcttgtcctgtctccctgaatatgtgagtaagagcgatcamttaaggataagggactaaaatgtatttagcctctaatatatgttgaatggtgtgccagatactttccatatgttacctgaattctcacccaaagaactaa

SEQ ID NO: 6554 - DNA, 201 bp, Homo sapiens
ttgtatttttagtagagaaggggttggtcaggctggtctcaaactcctgacctcaaatgctccatctgcctcggcctcccaaagtgctgggattacaggcrtgagccaccacatcccacgcctgaccagggaaaatatctttatattaatcaattaaacaaataaactagaagacaattaagatatttgctcatccatgct

SEQ ID NO: 6555 - DNA, 201 bp, Homo sapiens
agtgcaatggtgcgacctcggctcactgcaaactccacatcccgggttcaagtgattctcgtgcctcagcctcccgagtagctgagattacaggtgtgcamcaccacacctggctaattgtttgtatttttagtagagaaggggttggtcaggctggtctcaaactcctgacctcaaatgctccatctgcctcggcctccc

SEQ ID NO: 6556 - DNA, 201 bp, Homo sapiens
atctggaaatgctgggtagtatttataacactgttaaaatagcaccaaatgcgtcaccattaacctctcatgactaaggatcacctaaccactttgaaccrgctggcacaagagccagtggaaccagctcacataatgagcttctaatccaaatgagcagaaaaaaatgtatgtaacgtggcgtgcatttccaagttcact

SEQ ID NO: 6557 - DNA, 201 bp, Homo sapiens
cttaaacatcaaggcagagaaggccaggcgcggtggctcgcacctgtaatcccagcactttgggatgccaaggcaggtggatcacctgaagtcaggagttygagaccagcctggccaacatggtgaaactccatctctactaaaaataccaaaaattagccaagcgtagtggcaggcatctataatcccagctactcatgt

SEQ ID NO: 6558 - DNA, 201 bp, Homo sapiens
atatacagtactcattggtggtttcctgttccccgtgaacaattaaaaagtcttaacagcagagccagaacttaaacatcaaggcagagaaggccaggcgyggtggctcgcacctgtaatcccagcactttgggatgccaaggcaggtggatcacctgaagtcaggagtttgagaccagcctggccaacatggtgaaactc

SEQ ID NO: 6559 - DNA, 201 bp, Homo sapiens
gtcttttgacggcagcaccttcctctttgccctggtgctcaatttcatatacagtactcattggtggtttcctgttccccgtgaacaattaaaaagtcttracagcagagccagaacttaaacatcaaggcagagaaggccaggcgcggtggctcgcacctgtaatcccagcactttgggatgccaaggcaggtggatcac

SEQ ID NO: 6560 - DNA, 201 bp, Homo sapiens
cctctgaatatccttgcgctgtcttttgacggcagcaccttcctctttgccctggtgctcaatttcatatacagtactcattggtggtttcctgttccccrtgaacaattaaaaagtcttaacagcagagccagaacttaaacatcaaggcagagaaggccaggcgcggtggctcgcacctgtaatcccagcactttggga

SEQ ID NO: 6561 - DNA, 201 bp, Homo sapiens
tttgtcatttaatttacatgtttttgaaaacacagtcagttttctttaacctcttttcaattctcaagatactttcattttcacagagtgttttttttttkttttttttttttctcttacaagcattctcctggtgtttgcaaatcccttcaactttgatgtctatcttagtgctttctcatcttccattaactattccct

SEQ ID NO: 6562 - DNA, 201 bp, Homo sapiens
gtttgtcatttaatttacatgtttttgaaaacacagtcagttttctttaacctcttttcaattctcaagatactttcattttcacagagtgtttttttttkgttttttttttttctcttacaagcattctcctggtgtttgcaaatcccttcaactttgatgtctatcttagtgctttctcatcttccattaactattccc

SEQ ID NO: 6563 - DNA, 201 bp, Homo sapiens
cagtaaaatcttgtcattgttttgcttatctctacaaaattgatcataaagctttagtggtcagataaaatgtcagaaattctgactgcttctaagcctcmaattacagcttcaatatctccatcaggagcaataagtacacagaagcatgctggcaaatagagaaggggaagactctagtgatttgccaagacgacttct

SEQ ID NO: 6564 - DNA, 201 bp, Homo sapiens
tccagagcagagttctttacctagggaaataccattttacaccacattgatcagttcccattaacacctgctgggcacttgtattaaacagtaaaatcttrtcattgttttgcttatctctacaaaattgatcataaagctttagtggtcagataaaatgtcagaaattctgactgcttctaagcctcaaattacagcttc

SEQ ID NO: 6565 - DNA, 201 bp, Homo sapiens
atttagtaaattatcaagaaatttggaaatatccagtttgttatctgtttggaaatgctggatcagggaacaaatgttttggtttcgataaagacacttgstcctggggagagccattcacaaggttgcgtaacatgaactgaatgtcacagcaactttttttttttttggaaacagggtctcactctgccacccaggatg

SEQ ID NO: 6566 - DNA, 201 bp, Homo sapiens
aggaaggaaaagttgagcagctcttgctcatgcacatggagaaaatgcaaagtccaaggcagaaaaccctgaaacatcatgatgtgttcaatgagctgccrtcagttcacaataagttgggggcaagtgggaaagtaacttgggagaggacgctagagacagacgcaggagtcagataagcaagtactatatagactgagt

SEQ ID NO: 6567 - DNA, 201 bp, Homo sapiens
gagtcaaattcctcattattagcaggacttcaaagtaactaattgagcctaagttaagctgtttttattttttaagctgacattttggttccgtttcccakggttatttttagccccgtcacattgtctggcatactgtgggggctcagttaatgtttggcaagtatgttgacagatcatcaccaaagggaaatccaccca

SEQ ID NO: 6568 - DNA, 201 bp, Homo sapiens
gagaactggagtcaaattcctcattattagcaggacttcaaagtaactaattgagcctaagttaagctgtttttattttttaagctgacattttggttccrtttcccagggttatttttagccccgtcacattgtctggcatactgtgggggctcagttaatgtttggcaagtatgttgacagatcatcaccaaagggaaa

SEQ ID NO: 6569 - DNA, 201 bp, Homo sapiens
agagacgacggtcaaagaaagcatatttactgtatgcctggtatataggtcagggcttatagtaagtcttatagatacagaaataaaaaacacagtgtttrtcttctttcttacccacattcttataattcaatggcatagacacataaacaatgacagtacctataatgccacttattcactgatggagagtaaatgtaa

SEQ ID NO: 6570 - DNA, 201 bp, Homo sapiens
ggttttgccatgttgaccaggctggtcccgaactcctgacctcaggtgatccgcctgcctctggctcccaaagtgctgggattacaggcatgagccaccayacctgccggaaggatattttcttgatttaacaactaattactctatttattatagagacgacggtcaaagaaagcatatttactgtatgcctggtatata

SEQ ID NO: 6571 - DNA, 201 bp, Homo sapiens
acattccattattcattatttattcaactaatatatatgaagcatttgctatatgtcaggactcagctagttggttcagggtaaataagaaaatgaacatrattcccaccctcaagaagtttagagtctaagggggaggatagtcatgaattgattaaacacagatttatgacaaatgatacaagggacgggagagtatgc

SEQ ID NO: 6572 - DNA, 201 bp, Homo sapiens
aatataatctttcatgtcttcacgtaatataatctttcgtgtctttctttgattccatataatgtttttcaattcatccatgttgttgtacatattactargccattctgttttattaatataccataatttgttcattcatttccttgttgatggacattgaattatttctgatgttttgctataatgaataaagttgca

SEQ ID NO: 6573 - DNA, 201 bp, Homo sapiens
tgcatgaaggaacccagtatatacattcatggagttgcaaatcacttgcatggtgggctacagggtgtataagagggaagaaaggaggttaaaaccaaggwcagttaactagatgctaacactttccttaagcatgacagaagcccatagaatcccagccgactccatctccatatacacactaagatctaagtttcttga

SEQ ID NO: 6574 - DNA, 201 bp, Homo sapiens
atctagggttttgtttttgagcatctctgggaagccttggactcatcaaactctaaggcagaccaaaatcactgaagaacaagggagagagaaaaggcatrgaagtcccgatttgtgagagaaagtctgctccattctgagttctgtgtctgcagtatacaggcaggcctggtgtttggcgtctgtataatccacaccagc

SEQ ID NO: 6575 - DNA, 201 bp, Homo sapiens
attttttttttgtatttttagtagagacggggtttcatcatgttagccaggatggtctccatctcctgacctcgtgatccacccacctcggcctcccaaastgctgggattacaggtgtgagccaccgtgcccggctagagaatttcttgactggcccaagttcacccttctctccgcctatgtagcacttatagccattt

SEQ ID NO: 6576 - DNA, 201 bp, Homo sapiens
aaaatggtaaccagaattattctcaaagcattttttttcaggtagaataagtagttcagcctagagcaatccaatttattactcaaggctcaactccaatrcctctagctttacaaagaatttctctaagtgagaaattctcacttagagaatttctttttttttttttttttgagatggagtctcactctgtggcccagg

SEQ ID NO: 6577 - DNA, 201 bp, Homo sapiens
tcgggaggctgagacaggagaattgcttgaacctgggaggcagaggttgcagtgagcccagatcgtgccactgtactccagcctgggtgacagtgtgagawtctgtcttgaaataaataaataaataataaaataaacaaagctactataaccctaaaatggtaaccagaattattctcaaagcattttttttcaggtaga

SEQ ID NO: 6578 - DNA, 201 bp, Homo sapiens
cagcctggccaacatggtgaaacttcatctctactaaaaacacaaaagttagccaggagtggctgcacgtgtctgtaatgccagctattcgggaggctgaracaggagaattgcttgaacctgggaggcagaggttgcagtgagcccagatcgtgccactgtactccagcctgggtgacagtgtgagattctgtcttgaaa

SEQ ID NO: 6579 - DNA, 201 bp, Homo sapiens
taccagttcatttggatttttggctcattgcagactaatgatgcacaagtggtctcattaatggtatgcatgtttgtttgtttgtttgtttgagacggagsctcgctctgtcacccaggctggagtgcagtggcaccatcttggctcactgcaacctccacctcctgggtcaagcaattcttctgcctcagcctcctgagt

SEQ ID NO: 6580 - DNA, 201 bp, Homo sapiens
gttgaaggtgggtcttacctcataagccccctacccacccagagaccctggtggcactctaagttctgaaaggaatcagcattcaagggaatataattagmaaagaaaatttgccttaaagtccactgttactttgttctctctctctcgtctccctcttcccccttctctctcccccttcctctccccagttccgtcttc

SEQ ID NO: 6581 - DNA, 201 bp, Homo sapiens
ccactattctccagcctgggcaacaaagcaagaccctgtgtcaggtgttagaaaaaagaaagaatgaaagaaaaagaaataaggacaaatactgcatgttytcacttgtaagtgggagctaaataatgcatacagttagatgcagaatgtgtaatgatagacaatggagactcagaaaggcaagtgggtgtgagggaggag

SEQ ID NO: 6582 - DNA, 201 bp, Homo sapiens
tcacttctctggtcctcatttttctcatctataaaataatatgtaccatttggggttgtagtgaacataaaatgtggtaatgtacataaagtggttggctyaggacctgtgatggaatcacagtttaaaaactattaggcactttttttttggaatgatgcaaggaaaactaagctccattcgcttcccacttaaattctc

SEQ ID NO: 6583 - DNA, 201 bp, Homo sapiens
gtaacccaagctttcttggatccttgtgtcaaacagtgtgaccttatgcatacacttgctagtgttcacttggctaagaagctgtattggggaaaaaatgmaaagaaatagaaaaaaaaagatagaaatttcagataatagacacactggaagacacatcctagccagaaagctgcgtgtcattatgtggataataataca

SEQ ID NO: 6584 - DNA, 201 bp, Homo sapiens
gccacactggcctcaaactcctgacctcaggtgatctgcctgcctcaacctcccaaagtggtgggattacaggcatgagccaccgtgcctagcccaaatcrtcactttaaatacctctgtgtatctggcccttccactccccagcttgtggccttttaatggttccccactgcagctggaatcaagtgaaaatgcctgacc

SEQ ID NO: 6585 - DNA, 201 bp, Homo sapiens
agtgagaggcagatctgatgagggaaggaagaaatcatgaaggagtgcaatggaggggagttgtgcagtttgcaaaggacctgaaaagtcagagtggaaaraagggatgtgtaggatcagagaacagcatgcacaaaagcttagaagctgagttttaatgacatgtttgtgaactaggaagttgtccaaacaggaagaaac

SEQ ID NO: 6586 - DNA, 201 bp, Homo sapiens
tattaaacaattaacgagtataattgttggcatttattgaggtactgtgatcaccccaacgggcattttctattttaccctcacaatcctctgataaaaaygccattattagactcgttttgtatgttggcaaacagggaatttaagtgacttgcccaagatcaaacagcaagtgagaagacctggaatctgagcttggac

SEQ ID NO: 6587 - DNA, 201 bp, Homo sapiens
tcagacacagagtagcaaagttgccaggagtttaaactttggagccagccactctggcttcaaatcccagctgtaccacttgtgagctgtgccacttgggmaaatttcttaatatctatttgcctcagtttcatcacctgaaaagtaggatgatgttaatagtataattcacaggattgctgagaggactaaattaatgta

SEQ ID NO: 6588 - DNA, 201 bp, Homo sapiens
cagcatcatcctaacaccattttaaaaagggactccagccaccagagtattcagggagaaagaaagaaccaatgggttgaatcctgaagacctcagtttcractgtcatattgtttctgcttgtctccatttccacagtggcatggagtatgtatgctccaaatgcctttatttagaagttatatccaaaatggaaggacc

SEQ ID NO: 6589 - DNA, 201 bp, Homo sapiens
tatggaagtatcaaggacctgtattctctcccttgctcttactgcaacttcagcccccgagactcagagccattgagggtggccgtctgaatagcctttgrgtattaaatttccccagagaaagcaaacagcatcatcctaacaccattttaaaaagggactccagccaccagagtattcagggagaaagaaagaaccaat

SEQ ID NO: 6590 - DNA, 201 bp, Homo sapiens
ccatatgtgcctcagctttggaatcttgtaccctaggcaaaatatggaagtatcaaggacctgtattctctcccttgctcttactgcaacttcagcccccsagactcagagccattgagggtggccgtctgaatagcctttgggtattaaatttccccagagaaagcaaacagcatcatcctaacaccattttaaaaaggg

SEQ ID NO: 6591 - DNA, 201 bp, Homo sapiens
tagaatgattaatgtgtccatatgtgcctcagctttggaatcttgtaccctaggcaaaatatggaagtatcaaggacctgtattctctcccttgctcttamtgcaacttcagcccccgagactcagagccattgagggtggccgtctgaatagcctttgggtattaaatttccccagagaaagcaaacagcatcatcctaa

SEQ ID NO: 6592 - DNA, 201 bp, Homo sapiens
atgggtagtttttggtggagtgaataaacatacagcctgtattttttacatgtgcatgagtcagaaagtgttagaatgattaatgtgtccatatgtgcctyagctttggaatcttgtaccctaggcaaaatatggaagtatcaaggacctgtattctctcccttgctcttactgcaacttcagcccccgagactcagagcc

SEQ ID NO: 6593 - DNA, 201 bp, Homo sapiens
cgtaatgattggtttctatgtccacagcttctaactcagggcatgccacatggagggacttaatgggtagtttttggtggagtgaataaacatacagcctrtattttttacatgtgcatgagtcagaaagtgttagaatgattaatgtgtccatatgtgcctcagctttggaatcttgtaccctaggcaaaatatggaagt

SEQ ID NO: 6594 - DNA, 201 bp, Homo sapiens
gtgtttatgtatatgttttacttatgagactatgatttcccagtctaccaggaattttatatgcgtaatgattggtttctatgtccacagcttctaactcmgggcatgccacatggagggacttaatgggtagtttttggtggagtgaataaacatacagcctgtattttttacatgtgcatgagtcagaaagtgttagaa

SEQ ID NO: 6595 - DNA, 201 bp, Homo sapiens
ctaaacatcatttgcttcacaatattatacctcaataatctacaataatctatgtgtttatgtatatgttttacttatgagactatgatttcccagtctascaggaattttatatgcgtaatgattggtttctatgtccacagcttctaactcagggcatgccacatggagggacttaatgggtagtttttggtggagtga

SEQ ID NO: 6596 - DNA, 201 bp, Homo sapiens
tgttttatatatatataaaaatatatattttatatatttttaacatgaaaatatatggtttatatatttttaatatataaaaatatattggtttctatatkttaatatatgaaaatgttttatatattttaacatataaatatatattttatatataaacttgtacattaactatatattttatctataaacatatagttt

SEQ ID NO: 6597 - DNA, 201 bp, Homo sapiens
ggctgacatttgtgacctcattgataaaattttctccaaaccaaaacaggccttatttttatatgttttatatatatataaaaatatatattttatatatktttaacatgaaaatatatggtttatatatttttaatatataaaaatatattggtttctatattttaatatatgaaaatgttttatatattttaacatata

SEQ ID NO: 6598 - DNA, 201 bp, Homo sapiens
caggatttcaacttcaaagaggctgacatttgtgacctcattgataaaattttctccaaaccaaaacaggccttatttttatatgttttatatatatatawaaatatatattttatatatttttaacatgaaaatatatggtttatatatttttaatatataaaaatatattggtttctatattttaatatatgaaaatgt

SEQ ID NO: 6599 - DNA, 201 bp, Homo sapiens
atatataatgttttatacatttttaacatataaaaacatacgttttatacatttctaacataacagtaggggcatatttatttattccatgatgtattcargatttcaacttcaaagaggctgacatttgtgacctcattgataaaattttctccaaaccaaaacaggccttatttttatatgttttatatatatataaaa

SEQ ID NO: 6600 - DNA, 201 bp, Homo sapiens
ctcaaagaacacccacccaaattagaacatcctctgacaactttcccacatcatcccctccatcctccttgtaactcatcactctctagcactgcactggktttcattccgtttcccaaactcccaagctcctttcctccccagggcctttgcacctgccattgcctctacctggaaggctttgcccagatattcacatgt

SEQ ID NO: 6601 - DNA, 201 bp, Homo sapiens
aaggaaagagatttaattgactcacagttccacatggctggggagtccccaggaaacttacaatcatggcagaagaggaagcagacacgtcttacatggcrgcatgtgagagaagtgaagcgaagggggaagagccccttattaaaccccttataataataataatataatgagagccccttattaaaccgtcagatctca

SEQ ID NO: 6602 - DNA, 201 bp, Homo sapiens
atcacttaaagggtagaggcaataaaatagtagatggatagatggttatttccactaaaagtagttttcatcagctcatttgcatgtaacttaggcagtargtggatgtcttagaagggcaggccaagtcataaggctctaagccttgtaacactctagaaaggtaagaaatattatgtaaaataagattactattcaact

SEQ ID NO: 6603 - DNA, 201 bp, Homo sapiens
aaaaagcatcacttaaagggtagaggcaataaaatagtagatggatagatggttatttccactaaaagtagttttcatcagctcatttgcatgtaacttargcagtaggtggatgtcttagaagggcaggccaagtcataaggctctaagccttgtaacactctagaaaggtaagaaatattatgtaaaataagattacta

SEQ ID NO: 6604 - DNA, 201 bp, Homo sapiens
gccaccatgcccagctaatttttgtatttttagtagagatgggtttcaccatattggtcaggctggttctgaactcctgacctcatgatccacccacctckgtctcccaaagtgctgggattacaggcgtgagccaccatgcctggtctagagtaatgtgttctaaaactgaaattttcattaaaggtaaatgaaattgca

SEQ ID NO: 6605 - DNA, 201 bp, Homo sapiens
aatatttcattttgttttatccatcagttgaagtacataaaccatacttttctggtattacaagcaatatcagtgacccaaaaccattcatacgatggtamaccaacgcagtataatgtattctttgtgtgtgtgtgattgagtctcgctctgtccctcaggctggagtgcagtggcacaatctcgactcactgcaacctc

SEQ ID NO: 6606 - DNA, 201 bp, Homo sapiens
tgattcgtaccttaaagtttttcctgcttcgaagcaagggagcagcttagcctttgtattctcacacagattagtctttggttacaggtgaccacaaagaytgagggaacttaaattgccaggcatttaccattccagtgcccaaaggcaaaaatctgctgaggatccctgaagtgaggctttgtcagcaaagcacagaaa

SEQ ID NO: 6607 - DNA, 201 bp, Homo sapiens
agggaaaatatttgtaatcacatcacaaaaggctcatctgtccaatatataaattaataagaaaaagaccaacaaaccaatagaaatattaataaaagtaraaaaggaattgccgatggctcttaagtatataaatatggccaaaatttactgagaaaagtgcaaatttatatctcagcatactttttacctattagcaaa

SEQ ID NO: 6608 - DNA, 201 bp, Homo sapiens
aacattatggtaagtgaaataagctagtcacaaaaagacaaataccgtatgattccacttagatgaggtacttagagcagtcaaaatcataaagacaaaamgtagaatggtggttgccaggcgctagggaaaagggggttgaggagtttttgtttagtggatagagagttgcagttttacaagataaagagctttggagac

SEQ ID NO: 6609 - DNA, 201 bp, Homo sapiens
gaacccggaaggcagaggttgtggtgagccgagattgtgccattgcactccagcccgggcaacaagagcgaaactccgtttcaaaaaaaaaaaaaaaaaawggtacattcctaaatcccacaggctttgcaaacctgtgctctaggataggaattcagtgctcatttgtttttcaatgcaaaactttctatgaagacattt

SEQ ID NO: 6610 - DNA, 201 bp, Homo sapiens
ctctactaaaaaatacaaaattgacagggcatggtgttgcatacctgtaatcccagctactcgggaaggctgaggcaggagaatcgcttgaacccggaagkcagaggttgtggtgagccgagattgtgccattgcactccagcccgggcaacaagagcgaaactccgtttcaaaaaaaaaaaaaaaaaaaggtacattcct

SEQ ID NO: 6611 - DNA, 201 bp, Homo sapiens
gaggattaattgagattaggcatatgaagtgctcaggtctgtagctcactaattgtcaggtcacattaagtgcaaagatgcctggacatatgatgatggtrttccaaaggcacttccaacttaatatgcctaaacctaaactcacattttgccacatctccacccatcctgcaccctccttctgaaatatcctccctcttc

SEQ ID NO: 6612 - DNA, 201 bp, Homo sapiens
catgtgagttcagcaagcaataacaagaggtgggccaggtgtggtggctcatgcctgtaattccaacactttgggaggccgagacaggcggatcacttgargtcaggagtttgagaccagcctggtacaacgtggcaaaaccctgtctctactaaaagtgcaaaaattagccagacatggtggtgcacatttgtggtccca

SEQ ID NO: 6613 - DNA, 201 bp, Homo sapiens
ctcttcccctggtccccaagacacctgaggacagcctccactggcagcactgatgtcggatacctatcaggaggtgatgttgggaaaaccacactacagcytaggtgagtatacctccaaattcatgtacacctgggacatcagagtatgcccttatttgaaaatcatgtctttgcagatataattgtttaaggatcttga

SEQ ID NO: 6614 - DNA, 201 bp, Homo sapiens
caacagattggcattgagatgccaagccaaaggaatgcttatctgtattttcatttttttttttttacaatgaggatacattttttaatgagaagcaatawagcataatggttaagggcatagctcctagagccagttcaaatcccagctctgaagcttaccagcactgtgcctgcgtcatgacttaagctgtctgtatag

SEQ ID NO: 6615 - DNA, 201 bp, Homo sapiens
cttggagaaatggaacgtacatcaaacagacaacagattggcattgagatgccaagccaaaggaatgcttatctgtattttcatttttttttttttacaaygaggatacattttttaatgagaagcaatatagcataatggttaagggcatagctcctagagccagttcaaatcccagctctgaagcttaccagcactgtg

SEQ ID NO: 6616 - DNA, 201 bp, Homo sapiens
ttctcagaggaattccaggaaataggattttacacatgtgggaaacaggctgagagaggttatttaatttgccaaaggtcacacagctggtattagagacmgaatattaaagtaggcgtttcttaccccaaaatccactctctgcaccaagaggccactcagaaaatataaaaataagcaaatcaaataaattgactacgt

SEQ ID NO: 6617 - DNA, 201 bp, Homo sapiens
acagaggcagagagaagcagagaaggggagaggatagaagagaggaagagaactagggaggaggaagagatccagatggaaggaggtaccaagcaaaacaygaagacggagacagaaagagagaaaaacgatgagaaagagaaagtgaggaagagaaacagagaaggagaaagagatgttagtaaggtacagagagggaga

SEQ ID NO: 6618 - DNA, 201 bp, Homo sapiens
agtcaataccaaatttcaccctgtgtgctttcagctcttgtcagtttattttgtgtggcttatttttttaccaataatattcactgtgaattgggcaaaaragatggatggttaatatttatttttttagctgataataaatcctgagtgattttgtaagacagaggcagagagaagcagagaaggggagaggatagaaga

SEQ ID NO: 6619 - DNA, 201 bp, Homo sapiens
acccatctcagtggacaatgcaaagggtagcattaaatcatgagctttgtgagggcagggagccctgtgcctcctatctggcatagcatcccacacctggygggtgcctagtaattgtccataggataaatggataacaacggagagacgaagaatttattgtagttgtgtttttgcaatagtttctctcccccactgggt

SEQ ID NO: 6620 - DNA, 201 bp, Homo sapiens
ccacagacccatctcagtggacaatgcaaagggtagcattaaatcatgagctttgtgagggcagggagccctgtgcctcctatctggcatagcatcccacwcctggtgggtgcctagtaattgtccataggataaatggataacaacggagagacgaagaatttattgtagttgtgtttttgcaatagtttctctccccca

SEQ ID NO: 6621 - DNA, 201 bp, Homo sapiens
accacagacccatctcagtggacaatgcaaagggtagcattaaatcatgagctttgtgagggcagggagccctgtgcctcctatctggcatagcatcccasacctggtgggtgcctagtaattgtccataggataaatggataacaacggagagacgaagaatttattgtagttgtgtttttgcaatagtttctctccccc

SEQ ID NO: 6622 - DNA, 201 bp, Homo sapiens
cctcttgccaaccacagacccatctcagtggacaatgcaaagggtagcattaaatcatgagctttgtgagggcagggagccctgtgcctcctatctggcayagcatcccacacctggtgggtgcctagtaattgtccataggataaatggataacaacggagagacgaagaatttattgtagttgtgtttttgcaatagtt

SEQ ID NO: 6623 - DNA, 201 bp, Homo sapiens
gctgcagcctcttgccaaccacagacccatctcagtggacaatgcaaagggtagcattaaatcatgagctttgtgagggcagggagccctgtgcctcctawctggcatagcatcccacacctggtgggtgcctagtaattgtccataggataaatggataacaacggagagacgaagaatttattgtagttgtgtttttgc

SEQ ID NO: 6624 - DNA, 201 bp, Homo sapiens
ggctgcagcctcttgccaaccacagacccatctcagtggacaatgcaaagggtagcattaaatcatgagctttgtgagggcagggagccctgtgcctcctmtctggcatagcatcccacacctggtgggtgcctagtaattgtccataggataaatggataacaacggagagacgaagaatttattgtagttgtgtttttg

SEQ ID NO: 6625 - DNA, 201 bp, Homo sapiens
gcatctagtattgctaaggggctgcagcctcttgccaaccacagacccatctcagtggacaatgcaaagggtagcattaaatcatgagctttgtgagggcmgggagccctgtgcctcctatctggcatagcatcccacacctggtgggtgcctagtaattgtccataggataaatggataacaacggagagacgaagaatt

SEQ ID NO: 6626 - DNA, 201 bp, Homo sapiens
gttttctattggaaaaaataattgttcctgttgttaaaaagaaaaaaaaatcccctaaatctctgagatttgtcaacagggactttgggcaaagcaactgyatttctcaggctcagttttccctatgaaaaatggagccaacttgccgggcacagtggctagcgcctaaagtcccagcactttgggaggccgaggtgggcg

SEQ ID NO: 6627 - DNA, 201 bp, Homo sapiens
atttccttagaaatcctatgcataccccagaaaataagcatcaggtaatctctccaagggcacaactgtgcctaaatattattattattattattattatwattcagatggagtctcactccattgcccaggctggagtgcaatggtgcgatctcagctcactgcaacctccacctcctgggttcaagtgattcttgtgcc

SEQ ID NO: 6628 - DNA, 201 bp, Homo sapiens
ttatcatttccttagaaatcctatgcataccccagaaaataagcatcaggtaatctctccaagggcacaactgtgcctaaatattattattattattattwttattattcagatggagtctcactccattgcccaggctggagtgcaatggtgcgatctcagctcactgcaacctccacctcctgggttcaagtgattctt

SEQ ID NO: 6629 - DNA, 201 bp, Homo sapiens
agctgggcatagtggctcacactgtaatcccagctctttgggaggtcgaggtgggaggatcacctgaggtcagcctggccaacatgataaaaccccgtctytactaaaaatacaaaaattggttgggtgtgatggcaagtgcctgtaatctcagctactcaggaggctgagacaggagaattgcttgaacccaggaggtga

SEQ ID NO: 6630 - DNA, 201 bp, Homo sapiens
gtagctgggcatagtggctcacactgtaatcccagctctttgggaggtcgaggtgggaggatcacctgaggtcagcctggccaacatgataaaaccccgtytctactaaaaatacaaaaattggttgggtgtgatggcaagtgcctgtaatctcagctactcaggaggctgagacaggagaattgcttgaacccaggaggt

SEQ ID NO: 6631 - DNA, 201 bp, Homo sapiens
tcttgaggtctgcattgggaccccttttctgtaactacaatggtgatggctaacatttattgaaccacttgtatgttacagggtctatgctaagctaagcyatgcactttacatgtattctcccatttcatcttcacaccagccttattaggtaattatttctgtaccctttcacagatgaataaaccgaggctaaaaaag

SEQ ID NO: 6632 - DNA, 201 bp, Homo sapiens
tgaacagcctttttcctagggaaatgcatggcaggcttcatgtaagaggttccctcaataaccaaacactccattcaaaggttatatttacacagctcatwaggaaaattttttatacttttgacactcattagactcataatcgtccactgaagctactgtgtaacaagagataaacactccattctagaggatgaataa

SEQ ID NO: 6633 - DNA, 201 bp, Homo sapiens
acacgtgtgtatatgtatgtctacatatgtgtatatatacacgtgtgatataaatttatatatgtgaattactagaaacgtttcgattttaggattagatrttttgcatttatacatttgtcagcctactggactgtaagttcattgagggtaagaagaaaaagaccatgataaccccttctgggaatatcagtgcctacg

SEQ ID NO: 6634 - DNA, 201 bp, Homo sapiens
ggctcccccactccaagatctgtgagcatcattatgctgaatggtgctattaaaactctagagtccattgcaggaagtttccttattaacatgagagcagsgtttgtggtcctctccaatctgttaacaatctagatgagtctttaaaattattgctggcaaaagttgcagtacaaaaggaacagagggaacctgatgaag

SEQ ID NO: 6635 - DNA, 201 bp, Homo sapiens
actgtcataccattcctaagccagccctaagaagactggctgtgaaggcctctcagggatacgccgtcctcagaatggacacatgtgtggtcatcactgcmtgagctgtgggactgtccagctctaccccagactcggatgtcagcccaaagatattaagctgggaagttgatcaagggcagtgttgaggatattagcaac

SEQ ID NO: 6636 - DNA, 201 bp, Homo sapiens
cggaggtcgcagtgagctgagatcgcaccaccgcactccagcctgggcaacagagcaagacttcatctcaaaaaaaaaaaaaaaaaaagaaaaaaaaaaaraaaaagaaaggaaaggaaaagaaaaaaaagaaataactagaatcttactaagggtaggaggaaagaatagagaggaagaaaaagacttgaaagatccaca

SEQ ID NO: 6637 - DNA, 201 bp, Homo sapiens
gggaggcggaggtcgcagtgagctgagatcgcaccaccgcactccagcctgggcaacagagcaagacttcatctcaaaaaaaaaaaaaaaaaaagaaaaaraaaaagaaaaagaaaggaaaggaaaagaaaaaaaagaaataactagaatcttactaagggtaggaggaaagaatagagaggaagaaaaagacttgaaaga

SEQ ID NO: 6638 - DNA, 201 bp, Homo sapiens
tctgcccttcttatctgtctccagacagtctagactaggtgccatcaaacttgttctgtaaaaggccagataataaacatactggcctttgcaggccttayggtttctgttgcaatgactaggctttacatgtgattgggtttcaataaaacttcattttcaaaaccaggcagtaaccgggatttgggtcatgggttttga

SEQ ID NO: 6639 - DNA, 201 bp, Homo sapiens
cacacctggctaatttttgtattttttagtagagaaggggtttcaccatattggccaggctggtctcgaactcctgacctcgtgatccaccctcctcggcytctcaaagtgctgggattacaggtgtgagccactgcacccagccttctctgcccttcttatctgtctccagacagtctagactaggtgccatcaaacttg

SEQ ID NO: 6640 - DNA, 201 bp, Homo sapiens
ctttaagtcttcttttttttttttttttttctgagacagagtctcattttgttgcccaggctagagtgcagtggcgcgaactcgactcactgcaaactccrcctcctgggttcaagtaattctcctgcctcagcctcctgagtagctgggactacaggcacccaccaccacacctggctaatttttgtattttttagtaga

SEQ ID NO: 6641 - DNA, 201 bp, Homo sapiens
accacctccttctccttttttccccctctaatttctccctcatatatctctatccctttttccttccccacactatttgtctttctttcttcttgttctcrtcttcatcttctcccttctcttaggagaactggacaaccaactttaagtcttcttttttttttttttttttctgagacagagtctcattttgttgcccag

SEQ ID NO: 6642 - DNA, 201 bp, Homo sapiens
gggttcaagtgattctcctgcctcagcctccagagtagctgggattataggtacctaccaccatgcctggctgatttgtgtatttttagtagaaatggggktttgccatgttggccaggctggtctcaaactcctaacctcgagtgattcacctaccttggcctcctaaagtgccgggattacaggcatgagccatcatgc

SEQ ID NO: 6643 - DNA, 201 bp, Homo sapiens
ctcactgccacctccacctcctgggttcaagtgattctcctgcctcagcctccagagtagctgggattataggtacctaccaccatgcctggctgatttgkgtatttttagtagaaatggggttttgccatgttggccaggctggtctcaaactcctaacctcgagtgattcacctaccttggcctcctaaagtgccggga

SEQ ID NO: 6644 - DNA, 201 bp, Homo sapiens
cagtcaaaagatacatgaaaaaatgctcatcatcactggccatcagagaaatgcaaatcaaaaccacaatgagataccatctcacaccagttagaatggcratcattaaaaagtcaggaaacaacaggtgctgcagaggatgtggagaaataggaacacttacactgttggtgggactgtaaactagttcaaccattgtgg

SEQ ID NO: 6645 - DNA, 201 bp, Homo sapiens
gtgaacgggcaacctacagaatgggagaaaatttttgcaatctactcatctgacaaagggctaatatccagaatctacaatgaactcaaacaaatttacargaaaaaaacaaacaaccccatcaaaaagtgggtgaagcatatgaacagacacttctcaaaagaagacatttatgcagtcaaaagatacatgaaaaaatgc

SEQ ID NO: 6646 - DNA, 201 bp, Homo sapiens
cgagatctcaccactgcattccagcctgggctacaagagcaaaactctaacaacaacaacaaccaaaaaaaaaaaacaaacaaacaaaaaacctaaaaccmtaaaaaccctagaagaaaacctaggcaataccactcaggacataggcatgggcaaggacttcatgtctaaaacaccaaaagcaatggcaacaaaagccaa

SEQ ID NO: 6647 - DNA, 201 bp, Homo sapiens
tcaccatgttgcccaggctagtcttgaactcctgggctcaagcaatccccccaccttggcctcctaaagtgctgggattacaggtatgagtcactgcaccyagggttaacaaaccttttgggcatcaatatgacgccatatatcaagactcctagagatctttagaaccagtaacctttaaattctacatctaagagtttg

SEQ ID NO: 6648 - DNA, 201 bp, Homo sapiens
cgaagtgttgtcaacaagttccttgaagctgtaaaatccagaagcgaaatggatcacttccatttgatctgtattccccattgcttagtatacacaaggarcttaatgggcatcggagacttagttgtggaatgaagagagaaggagagagtggaaaggaaagaaaagaggacagggaagagaaggaggaggaagaaaaag

SEQ ID NO: 6649 - DNA, 201 bp, Homo sapiens
ttttcctttagaacattcagctctgtctgtaattacacacagttactgtgacttcgttatttgatgcctgtgtccccgtctagattgataagctctgtgaragcagagtgcaagcctgtatagcctagcccagctaataaatgggtaggtggtgagttgtgagtgaatgtgtaggggagtctgacttgtcaatattctgct

SEQ ID NO: 6650 - DNA, 201 bp, Homo sapiens
tgtgcagccctgccaccctccaccgcacccgacacgcattatccagagtgatcattctaaaaagtatattggactaagttacttaaaacctgcttaaaacmctttaatgtttccccttccctaagataaagtctaaaccccttagcatgatattcaagggtcttcattcatctccatctgacagcttctctactcctattt

SEQ ID NO: 6651 - DNA, 201 bp, Homo sapiens
cctggtgctgccttggaagatgaggaaggggccttgagccaaggaaatcaggcaaggaaaaagcagcttcttcccctagagcctccagaaagagttcagcyctactaacaccttgattttagctccatgagacccatttcagctttctgacctgcagaactgtaggataataaatttgtattattttaagccagtaagttt

SEQ ID NO: 6652 - DNA, 201 bp, Homo sapiens
cctggatggatggagcactggaatttgggctaccagagagttccgcctcggttagcagaagtaatttgcccgtgtccttatgcaacatgctgacctggtcrgtcatttaaatgaaagggcacggcagccatgcaaaactctatctccctaatgcttttcttcccattgctttcttcttcttgaaatataaaaacgaccctg

SEQ ID NO: 6653 - DNA, 201 bp, Homo sapiens
caaataaggtcacatcctgaggtactgagggttaggacttcaacatatattttgttttggtgggggatacagcccatgatgccttgtcagatgacacctcygatcccaggaggatccatgccgtggagacaaacaactcattatttgccttgatgacctgtcatctcatagacacctccctggatggatggagcactggaa

SEQ ID NO: 6654 - DNA, 201 bp, Homo sapiens
cctttcttccagcttctggtagcctcaggcattccttggctcatagatggtgttctatttatgccataataaaaatattagtacttactttttttttttcyttttttttttttttttttttttttttgagatggattctcactctgtcacccaggctggagtgcagtggcgcaatctcggctcattgcaaacgccattctc

SEQ ID NO: 6655 - DNA, 201 bp, Homo sapiens
tccaccacaacggcctttgagaatatatttaacttctcttagtttcagtttactcattgataaaccaggataacacctacctttaattaggattagatgcwgggatatttatcaatcattcattctggcatttagtttaccctggcagcatttttctaataaaatgtagctactaatatcatcattattatcagcaccatt

SEQ ID NO: 6656 - DNA, 201 bp, Homo sapiens
tactgcaaacttggtggcttgaacaatataatttttttctctcatagttctggaggctgaaagtgtaagatcaaggtgtcggtggttccctctggagtctytgaaggacaatctatttcatgcctttcttccagcttctggtagcctcaggcattccttggctcatagatggtgttctatttatgccataataaaaatatt

SEQ ID NO: 6657 - DNA, 201 bp, Homo sapiens
ggcgtaagccaccatgcccagcacgattaatggatttctatggaatttaatttcctttctgcctactgctttcaggtaaaaacgatgattgattcagattyccctgatgatctcacttgcataactgagatcaggggtttttctgaaattcaccaggacttctccccttttcaatcactttgtgtgattggtattagcatt

SEQ ID NO: 6658 - DNA, 201 bp, Homo sapiens
agacggggtttcaccatgttggccaggctggtctcgaactcctgacctcaagtgatccgcctgcctgggcctcccaaagtggtgggattacaggcgtaagscaccatgcccagcacgattaatggatttctatggaatttaatttcctttctgcctactgctttcaggtaaaaacgatgattgattcagattcccctgatg

SEQ ID NO: 6659 - DNA, 201 bp, Homo sapiens
agcagagacggggtttcaccatgttggccaggctggtctcgaactcctgacctcaagtgatccgcctgcctgggcctcccaaagtggtgggattacaggcrtaagccaccatgcccagcacgattaatggatttctatggaatttaatttcctttctgcctactgctttcaggtaaaaacgatgattgattcagattcccc

SEQ ID NO: 6660 - DNA, 201 bp, Homo sapiens
gcttatgggatctatgtgggatcatcaatgagtctaagataataacagagggatttgcagggaggtagagaaataaactaggagagctagaagggcattgmccaagagtgagcaaagaggtaaaacaatagatcaaggaagaaaaggaataggaggaataaaaagaaagcaggcagagggtggcaaaaaaaaaaaaaaaaa

SEQ ID NO: 6661 - DNA, 201 bp, Homo sapiens
ctgtacttcctttctctcaccctcctctccatataccctccaaactgtactgctcctctgaagaagtctcacacatctatatctccctgcctctgctccayttcaaatgtccttccctggctcctttcaaagcccttacctatccctcaaggcacatctcatgtgtcacctcccctgtgaagctctgcctgacttctccag

SEQ ID NO: 6662 - DNA, 201 bp, Homo sapiens
tcactctggtcttaaatgtcaagactcaagtgatcctcctgccttggcctctcaaaatgctgagattacagatgtgagccaccactccccacccatcctcmctgcccaccatgtgtctgtacttcctttctctcaccctcctctccatataccctccaaactgtactgctcctctgaagaagtctcacacatctatatctc

SEQ ID NO: 6663 - DNA, 201 bp, Homo sapiens
aatggaaaaaggcaaatgcctggtatttcttaatgaaacactacactcagcacattataggagttatcagatttaatgcttccaacgacttaatatcaggyagtattattaactccatttgcaaagaagggatccaagtcctagatagaggaaatggcatccccaaggtggagaaccagttcaatcttggtcctctggctc

SEQ ID NO: 6664 - DNA, 201 bp, Homo sapiens
ggttctttccacaatactgcaggtccctccatgctcccacttttgatggaatgtagcccaagatcccccagaacagaaccatgataaccagacaggaggasggtcctacaactaactctcattttcccttcaagccaatattgaagacttgatatcttggtccattattctgtccaaataaggaaaggaaacaatgttgaa

SEQ ID NO: 6665 - DNA, 201 bp, Homo sapiens
caaattacacattgatactttagcctacagtaatctttctaaaactcttcagcggcccccattaaatataaactcatcctggctcacaaatcctttacaayatgacaacatctttgacttcatcttcactttcttttaacgtgtttagagacagggtctcgttctgtcacccaggctggagtgcagtggcaccatcacaac

SEQ ID NO: 6666 - DNA, 201 bp, Homo sapiens
caatttgaacacatccatacaaccattttccaaaatcaagcttcaagatacagaacaccagaaaccttcctccagctcccccaagtctatatcaaatcccyaccatggttgtccagccatctctctccttctctgtgtgtaccaattaatctctctctctctctctctctaacacaaacacacatttttagcaaagacaat

SEQ ID NO: 6667 - DNA, 201 bp, Homo sapiens
atgtctggtccctgcaaccagattactaattatgaaaaaacagaatctaaccctaaccctaacatggcccagacctcgctaaatgattttaggcattaggscaatacagatggcctaaagactttttatatttcttccttttataaaacattaattttgtaggtgcatatgaaagccaactcactcccatttataactcag

SEQ ID NO: 6668 - DNA, 201 bp, Homo sapiens
ctgcactcccatatttgttgcagcactactcacaatagccaagatttggaatcaacctaaatgtcaacagacaaatggataaagaaaatgtggtacatatrcacaatggagtactgtacagccatgaaaaagaatgagatcctgtcatttgcaacaatatggatggaactggaggttagtatgttaaatgaaataagccag

SEQ ID NO: 6669 - DNA, 201 bp, Homo sapiens
tggctcagaactgatggagccacactttgagaaggatgttgacttgctggctaatgaatgattaaggtcaagaggtaaaggtgtcactcatctttaatagycccaggtggaagaaaactggtctatctattcaggagacttactggtccttggctttcttaaagattccccaaatctagagttctcctgacattggtgtga

SEQ ID NO: 6670 - DNA, 201 bp, Homo sapiens
taggaggctgaggcacgagaattgcttgaacccaagaggcagaggttgcagtgagccgagatcacacgactgcactccagcctggacaacagagactgtcwcaaaaaaaaaaaaagagagtgataccatctcataccagttagaatggcgatcattaaaaagtcaggaaacaacaggtgctggagaggatgtggagaaata

SEQ ID NO: 6671 - DNA, 201 bp, Homo sapiens
tatatgtatatgtatgtatttatctaggacttatattctgtgtgtgtgtgtgtgtgtgtgtgtgtgtatgagataaaagtatatatacccaagatatttayattatattgaaaatgaaactatagactctggtgatattggaaaattcccctatataactagggaatagtccagacatggtagctcagtcctgtaattcca

SEQ ID NO: 6672 - DNA, 201 bp, Homo sapiens
catcaggacctcctttttatccttcagatttcagcttaaacgtctcatgctctgagaggccttttcttgctagagcagggtctttgtccatcagtcttcaycacagctctgcttattacctcccccataacactgtccaaaatctgtaattagttttttcacctgtgtattgatgtctccctatactagaatctggacatg

SEQ ID NO: 6673 - DNA, 201 bp, Homo sapiens
agttcccaatgcaagttagagttgtgtgtgatttggtctagaaagcaagggccactcacttttcaaagtatccacggagaagctatgtgactcaggcaaaygcagttacagggacctggctcagcctcttcctatctgtgtgaacttgggcaagtcttttcaccttgcttaccctcagtttgctcatttcgagaaaggtga

SEQ ID NO: 6674 - DNA, 201 bp, Homo sapiens
gagccatgactgtgtcactgcactccagcctgggcaacagagcaatactcttggagcaagggagggaggggggagggagggaggactgaccggagtttgartcctgggtttatcatttgctaattgagtgattttaggaagttatttaagccttgaagtctccatttcctaatctgtaaaactgaaaaaatagtattacct

SEQ ID NO: 6675 - DNA, 201 bp, Homo sapiens
aggatcgcttgagcccaggaatccaaggctgcagtgagccatgactgtgtcactgcactccagcctgggcaacagagcaatactcttggagcaagggaggraggggggagggagggaggactgaccggagtttgagtcctgggtttatcatttgctaattgagtgattttaggaagttatttaagccttgaagtctccatt

SEQ ID NO: 6676 - DNA, 201 bp, Homo sapiens
tgatcatagtgattaatctctcaccagccagtttattacatagtcctgctcaatctaaagctggcatgcaagacaccattttcaaaaattaaacaagccasgtgtggggacacatgcctgtaatcccagctacttgggaggctgaggcaggaggatcgcttgagcccaggaatccaaggctgcagtgagccatgactgtgt

SEQ ID NO: 6677 - DNA, 201 bp, Homo sapiens
tcactttaaaaatgcaaatagagataatttcacttcttcctttccaatttggaagccttttatttctttttctggcctaattgctctggctaggacttccmgtactatgctgaatagaagtggtgagattgaacatctttgtcttgttcctgatcatagaggaaaagctctcaattttcaccactgagtatggtgtttgtt

SEQ ID NO: 6678 - DNA, 201 bp, Homo sapiens
agtgcggtggcgtgatctcggctcactgcaacccctgactcccgggttcaagagagtctcctgcttcagtctcccaagtagctgggattataggtgggcaycaccacacccagctaattttgtaattttagtagagatggggtttctccatgttggtcaggctggtctcaaactcccaacctcaggtgatccacccgcctc

SEQ ID NO: 6679 - DNA, 201 bp, Homo sapiens
atgtatgtatgtatgtatgtatgtatgtatgtatacatgtacgtatgtatgtatttagagatggagtttcgctcttattacccaggctggagtgcaatggyacgatcttggctcactgcaacttccgcctcccgggttcaagcaattctcctgcctcagcctcccaagtagctggaattacaggcatgcgccaccacacct

SEQ ID NO: 6680 - DNA, 201 bp, Homo sapiens
atccccgcactttgggaggccaaggcgggtggatcacttgaggtcaggagtttgagaccagcctggctaacgtggcgaaacccgtgtctactaaaaatacraaaattagccgggcgtgctggcgtgcgcctgtagtctcagctacttggggaggctgaggcagtagaatcgcttgaacctggaaggtggaggtttcagtga

SEQ ID NO: 6681 - DNA, 201 bp, Homo sapiens
tgagccattaaacaacagtggtggaacacacaccaaacaacaaatggggaaactgaggcccagagagctttcatcatagcttctgcctgactcccagctgsaactcctaacataagtctctgctcatgtgaaagagttcagtgtcctcacccaatggagagtttccttatcattgtccttaaccaatggagagtttcttgt

SEQ ID NO: 6682 - DNA, 201 bp, Homo sapiens
tatatacccaaaggattataaatcatgctgccataaagacacatacacacgtatgtttactgcggcactattcacaatagcaaagacttgaaaccaacccraatgtccaacaatgatagactggtttaagaaaatgtggcacatatacaccatggaatactatgcagccataaaataggatgagttcatgtcctttgtagg

SEQ ID NO: 6683 - DNA, 201 bp, Homo sapiens
ctactcatctgacaaagggctaatatccagaatctacaatgaactcaaacaaatttacaagaaaaaaacaaacaaccccatcaaaaagtgggcaaaggatrtgaacagacacttctcaaaacaagacatttatgcagccaaaaaacacatgaaaaaatgctcatcatcactggccatcagagaaatgcaaatcaaaaccac

SEQ ID NO: 6684 - DNA, 201 bp, Homo sapiens
gcctagccatatgtagaaagctgaaactggatcccttccttacaccttatacaaaaattaatccaagatggattaaagacttatatgttagacctaaaacrataaaaaccctagaagaaaacctaggcaataccattcaggacataggcatggtcaaggacttcatatctaaaacaccaaaagcaatggcaacaaaagcca

SEQ ID NO: 6685 - DNA, 201 bp, Homo sapiens
atcacgctacctgacttcaaactatgctacaaggctacagtaaccaaaacagcatggtactggtaccaaaacagaacagaacagagccctcagaaataatrccacatatctacaactatctggtctttgacaaacctgacaaaaagaagcaatggggaaaggattccctatttaataaatggtgctgggaaaactgcctag

SEQ ID NO: 6686 - DNA, 201 bp, Homo sapiens
tcatttacgtgcaatttaatggatgtaaaatactcagcactatagtgcttggtatatagcaagcattcaatatatgtatgactttagcacccaaaagactrttagaaaagtacagtacttattcacgtactcgtttacttaatggctctttattaagcctcaaccatgtaccaagaactactatctcactgaagctgtggt

SEQ ID NO: 6687 - DNA, 201 bp, Homo sapiens
gaatggatggatgaatggatagacggacagatggatggatgggtagacgggtgggtggatggatgaatggagagatgggataaacagatggacagatggayggacagatggatggatggacagataaatggatgggtggttggatggatggacggacagataaatggatggatgggtgggtgggtggatggatggatggat

SEQ ID NO: 6688 - DNA, 201 bp, Homo sapiens
tcagacagaaaggttttcttgttgatgttttctactgcattctctcttaagctcaagactttttattttgtgttttttacattgatgagttataaaggggyctctctcatctttcccttctttttaccttcttctttgctgaatctctgctctctggccaggagtcattacatagaaacttaagtgcagggtgatcatcta

SEQ ID NO: 6689 - DNA, 201 bp, Homo sapiens
gcttccttagaatgtgcagctgggggagaggaacagatttcatacacccactttggttctgaagcaaaagcacttctctccccatgctcactgctctgcgkaagacagaacaaactgttttaaacacagagcgagggaggcaggagggtgtgggattctgggtgtctgctctagactctgtgtttcagtaccatcataact

SEQ ID NO: 6690 - DNA, 201 bp, Homo sapiens
acacaaggaatacagaaagctctcaacaagacacacgctaaaggcaccattggaacctaataaaaagggtctatgagacacttccttgggaagattggtaytggtggagaggtggaggtcagacatgccagatggtgatggaatgtgggatcctccaacacccttgctctatgtactctgagctagacatgaccagggtac

SEQ ID NO: 6691 - DNA, 201 bp, Homo sapiens
tgagagagctcctgttgctccaagtcctcaccacccttttcattgtcagtgttagtgttagtgtttggggttttagccactctcatagggatgtagtgctmgctcattatttcaatttgcaattccctaatggtatataatagtcccatctttttttttttttttcctgaaaactttaaaatactgtggaacttttcattc

SEQ ID NO: 6692 - DNA, 201 bp, Homo sapiens
cactttgtctttggtgtgaagtctaggtgtgggtttgttttattggttcggctctggacttagtacgattcttcaatctgaatacttagaactttagttcwggcaaaaattcacctgctatggctttgaatattacttctccctatcatatcttttttaaaaagttaatagattttatttttttagagtggttttatagtt

SEQ ID NO: 6693 - DNA, 201 bp, Homo sapiens
ttttgagaatttcactttgtctttggtgtgaagtctaggtgtgggtttgttttattggttcggctctggacttagtacgattcttcaatctgaatacttasaactttagttctggcaaaaattcacctgctatggctttgaatattacttctccctatcatatcttttttaaaaagttaatagattttatttttttagagt

SEQ ID NO: 6694 - DNA, 201 bp, Homo sapiens
atctatattttctctctagttgcttttgagaatttcactttgtctttggtgtgaagtctaggtgtgggtttgttttattggttcggctctggacttagtaygattcttcaatctgaatacttagaactttagttctggcaaaaattcacctgctatggctttgaatattacttctccctatcatatcttttttaaaaagtt

SEQ ID NO: 6695 - DNA, 201 bp, Homo sapiens
aagttggctaatcatctaattgtcgttactttctatgcaatctatattttctctctagttgcttttgagaatttcactttgtctttggtgtgaagtctagrtgtgggtttgttttattggttcggctctggacttagtacgattcttcaatctgaatacttagaactttagttctggcaaaaattcacctgctatggcttt

SEQ ID NO: 6696 - DNA, 201 bp, Homo sapiens
atcaaagttgacaattatttttccttgaccttttggagatgttaaattttcctctgatctggatggcagttgttgaaaagttggctaatcatctaattgtygttactttctatgcaatctatattttctctctagttgcttttgagaatttcactttgtctttggtgtgaagtctaggtgtgggtttgttttattggttcg

SEQ ID NO: 6697 - DNA, 201 bp, Homo sapiens
cttcaacggtcaagtagacagacagaaggaaaatgtggcacatacacaccatggaatactatgcagccataaaaaaggatgagttcatgtcctttgtaggsacacggatgaagctggaaaccatcattctcagcaaactaacgcaaggacaaaaaaccaaacaccgcatgttctcactcataggtgggaattgaacaatga

SEQ ID NO: 6698 - DNA, 201 bp, Homo sapiens
aaaacattagcacctccattgtaaattaaattaacaccacaaaaatccaccacatttgcatgacatttcaattgttataaggctttgttattttcttcaayggtcaagtagacagacagaaggaaaatgtggcacatacacaccatggaatactatgcagccataaaaaaggatgagttcatgtcctttgtagggacacgg

SEQ ID NO: 6699 - DNA, 201 bp, Homo sapiens
acaataaatgtaaccatgtgaggtaatggatatgttaattagtttgatggtgacaatcatctcacatttacttgtatatcagaatatcatttggggctggrgacggtggcttatgcctgtaataccagcactttgggaggccaagggaagaggattgcttgagtccaggagttcaagaccagcctgggcaacatggtgaga

SEQ ID NO: 6700 - DNA, 201 bp, Homo sapiens
attcttcttcaaactattgagagaggttggtcaaaaggcaccaacttccacttgtaaggtaaataggttctagagacctaatgtatagcatggtgactggkgatagcatggtgacaatacaaaaatatattgtatacaggcaatttgctaagataccacatcttaagtaatctcatcacacaataaatgtaaccatgtgag

SEQ ID NO: 6701 - DNA, 201 bp, Homo sapiens
agtgaaaattcttcttcaaactattgagagaggttggtcaaaaggcaccaacttccacttgtaaggtaaataggttctagagacctaatgtatagcatggkgactggtgatagcatggtgacaatacaaaaatatattgtatacaggcaatttgctaagataccacatcttaagtaatctcatcacacaataaatgtaacc

SEQ ID NO: 6702 - DNA, 201 bp, Homo sapiens
ttgaacccaggcggcagaggttgcagtaaaccaagatcgtgccattgaactccagcctgggcgacaagagcaaaactctgtctcaaataataacaataatrataataataataataataataataataataataataatttcactcttatgtctgtccccagaacaataacaaaattaagacttaaccttctaccttgtaa

SEQ ID NO: 6703 - DNA, 201 bp, Homo sapiens
atactgcacttgcattatgagtctctccagctagattctgaaacaaattgataacagatgcatccacaaagcattttggtccaaggacaaagccaagaaakgtatgaagaatgaacatacatttgacctgtgaacaacacactgcatgcgtctacctatacgcaaatttcttctccctctgccaacccctgaggcagcaag

SEQ ID NO: 6704 - DNA, 201 bp, Homo sapiens
atgaagtcatcaatacaagcgggatatggtctccccaaaccaagagaacaggagcacacagcacaagtgggcgtggaccaagggcatgtgaactgtggatrggatgtagacttgagcaagttcgtttctagcttctaaattccaccccagcaagtaccccagacctggctttaggaaccacgatatggcagcatgaagtgg

SEQ ID NO: 6705 - DNA, 201 bp, Homo sapiens
tggagggctctcgcctgtacagaggtgtaggtcccccaagcatgcaaaaggcagatcatcatcaatgaggctggagtgactcctgacttccaagaagcagyggagtctgtcaaggagtggaccttagcccaatcccattttacagatgaggaaaggtaaggtccagaagggagagaggaaggaagaagatacactataaag

SEQ ID NO: 6706 - DNA, 201 bp, Homo sapiens
agcccaccaagcacctaggggaacaggtcaggaacccagggcaagaggttgaggctacaactgtagattgtggaggcatctgcaaagctccaactactaasgactatatctagagaagaggagctgatgggatgcttggagggctctcgcctgtacagaggtgtaggtcccccaagcatgcaaaaggcagatcatcatcaa

SEQ ID NO: 6707 - DNA, 201 bp, Homo sapiens
gaaccaagagttgggcagtggaagaatggaaaacaccagagggccaggtatagtgtcagagattgttttatgtcttacttagatgagacacaaaataataytaaaagtatgcaggataaaactctgattatctttcaatccttctaattagtcagtgaggaagtctcatcttggtgctaataggtcttcaacacctttcta

SEQ ID NO: 6708 - DNA, 201 bp, Homo sapiens
taacgtttggtataacgatttaatgtattatcttttccactgaaagagctctgtattagtctgttctcacactgataataaagacatatcggagactggtracttataagggaaagaggtttaatggactcacagttccacatggctggggaggcctcacaatcatggcagaaggcaaatgagaagcaaggtcacatctta

SEQ ID NO: 6709 - DNA, 201 bp, Homo sapiens
acaatggagtactaatcagccataaaaagaataagatcctgtcatttggaacaacatggatagaactggaagtcatgacgttaagtggaaaaagccagacmcagatagacaaacttcacatgttctcacccatctgtgggagctaaaaatgaaaacagttgaacccacagacagagagagtagtgcaatggttaccagagg

SEQ ID NO: 6710 - DNA, 201 bp, Homo sapiens
aaaaaaaaaaaaaaaaaaaaaaatagccaggcatgcaggcatggtggtacacacctgtggccccagctactcaggagcctgaggtgggaggatctcttgarcctggtagggcagagcttgcagtgagctgagattgcaccgctgctctccagcctgggtaacacagtgaggccctgtctcaaaaaaaaaaaaaaagaagaa

SEQ ID NO: 6711 - DNA, 201 bp, Homo sapiens
aagactgagaaaccctgctaaaagaagacacagattttaaagaaatgataatgtgaaagaattaattgtagaagtgtactgtaatcccagcactttgggargccgaggtaagcagatcatttgagctcaggagttcgagaccaggcttgggcaacatggtgaaacaccgtctctactaaaaatacaaaaaaaaaaaaaaaa

SEQ ID NO: 6712 - DNA, 201 bp, Homo sapiens
gtggcacacccctgtaatcccaactactcaggaggctgaggtgggagaattgcttgtacccaggaggcggagactgcagtgagctgagatcgtgccactgyactccagcctgggcgacagagcaagaccctgtctcaaaaaaaaaaaaaaaaaaaaaaaagagagatgaatgaataaagaaaatgtgacatatttatacaa

SEQ ID NO: 6713 - DNA, 201 bp, Homo sapiens
atattttggatattagccccttatcagatatataatttgcaaatattttctcccattctataggataccttttcattctgttgattgtttcctttgcttcrcagaagtttcattgcagcattattcagaacagccaagatacggaaataacctaaatgtccatcaagagatgaatggagcctggccaacatggtgaaacct

SEQ ID NO: 6714 - DNA, 201 bp, Homo sapiens
tcaagtcctttgtccattttttaattgtccatttaataattttcactactgagtcataggaatttcttatatattttggatattagccccttatcagatayataatttgcaaatattttctcccattctataggataccttttcattctgttgattgtttcctttgcttcgcagaagtttcattgcagcattattcagaac

SEQ ID NO: 6715 - DNA, 201 bp, Homo sapiens
gataatgccataatgaacatgagtgaacatgagggtacagatatttctttgagatcctgatttcaattctttgggatatgtacccagaagtgggattgctkgatcataagatagttccattacgctggtgctattacttttaattgcaaaaaccacaattacttttgcaccaaccgataataaaaatttaaaaatttttcg

SEQ ID NO: 6716 - DNA, 201 bp, Homo sapiens
atatgtttccacaactgctgaaagcaactcattataggaatttggtatacttaggatagattaccttaattctattttctgtttatccaattagatttgcyggtcttaattgtactataaattgtgttgagctggtgaagatgactatgaagttgttgttccttcagatttcatggttggtatgcatgtcgctggtgtttg

SEQ ID NO: 6717 - DNA, 201 bp, Homo sapiens
tagctacttacaaaacggaggacgaagttcaaactccatattcaggcactcgattattcccgtcagctggctgtatggccactgtatgccttcctgccccrgccctggcctacatttccttaattcaactcacgtgccatttttcttcttttcaataaaaattcactgtgcacctattctgtgtgagacactatagtttcc

SEQ ID NO: 6718 - DNA, 201 bp, Homo sapiens
acagttgttgcattcatcatactccgtccctaacactcaagacagcttctcacgcattcctctatctcctcccctggggccaaggtccagataagcacatrtaagttaagtgagcaagtctaaaagcagatgcgcttatcctttcaatcactctacttttcatcactctcccttttacactctgctccaccatccaacccc

SEQ ID NO: 6719 - DNA, 201 bp, Homo sapiens
tctgccactatataacaaggatgtcctttcctccagttttcaataacatttccttcgtaggtagccctccctggtaatgcttttaacgtccatatttccamcaaaagtctgttcatgatgatttaggtagtctctaaaatgatgtatgccttctctaacatgtttcttacttctgagtccccagaaacagaactgttagca

SEQ ID NO: 6720 - DNA, 201 bp, Homo sapiens
agaccaggaagtcgaaggtgcagtgagtgatcacatcaccacactccagtctggccttcagggtgagacactgtttccagaaaaaaaaaaaaaaaaaaaawggagaggagagattcagttaggcaaacattaggcttcaaagcctagaaataatcctctcccatctctgtcctttgagcttgaggctctaccctctgagta

SEQ ID NO: 6721 - DNA, 201 bp, Homo sapiens
gaattcagttaggcagtccggatgcagtggctaatccctgtaatcctaacactatgggaggccaaggtggttggaatgcttgagcccagacattggagacsaacctggacaacgtggtgaaaccccacctctaaaaaagaaaaaaaaaatacaaaaacagattagctgggtatggtggtgcatgcctgtagtccaacctac

SEQ ID NO: 6722 - DNA, 201 bp, Homo sapiens
tctctccaactgtggacctgtaaaactagaaaacggattatctgctccccagatgcaattgtggaacaggcatgggatatcagttacaggggtttttgatyaaaaaaggaatcaatgaaaagaaaaaacaagttaccacatccaaacaattttggaattcagttaggcagtccggatgcagtggctaatccctgtaatcct

SEQ ID NO: 6723 - DNA, 201 bp, Homo sapiens
gtccaaaattttcatcaaaatctcatcagaccaggcacagtgactcatgcctgtaatcccagcattttgggaggccaaggcgggtggatcacctgaggtcrggagttcgagaccagcctggccaacatgatgaaaccagtctctactaaaaatacaaaaattagccaggcacggtgctgtgcacccataatcccagctact

SEQ ID NO: 6724 - DNA, 201 bp, Homo sapiens
aactcacgatagtgtcaaagtccaaaattttcatcaaaatctcatcagaccaggcacagtgactcatgcctgtaatcccagcattttgggaggccaaggcrggtggatcacctgaggtcaggagttcgagaccagcctggccaacatgatgaaaccagtctctactaaaaatacaaaaattagccaggcacggtgctgtgc

SEQ ID NO: 6725 - DNA, 201 bp, Homo sapiens
cacccatataagaactcaacagcagaccccaaaaaagactctgcacgccaaggctcagtgagcttcccttgttggcaacgtcccatgcttattttcatccrttgttgctgagaaggtggcactgtccatgattccgtaggaagatcaccactggcagctcacggttggacctttcatgattctgcctatgtgtccctcttt

SEQ ID NO: 6726 - DNA, 201 bp, Homo sapiens
agccttttctgggggagttggagctgccctaagccagtgaaagccaatgctcatacgcttgccctatccaactgctttcattagctccattctttttagtytaaaagccttcctgacagcaacaggggccaagaatttctctcatgaaccccattttcttgatttcaaaatccacttgccttgggagaaacgcttgaacct

SEQ ID NO: 6727 - DNA, 201 bp, Homo sapiens
actgaattttcattttgcttttcttaattataagaataatgcaaagtcccatcaacaacatttttgtgtgagttgatggatttctttatatatatatattwtttttttttgagataggatctcgctctgtcgcccaggctggaatgcagtggcacaatcagagctcactgcagcctcaaattcctaggctcaagtgatcct

SEQ ID NO: 6728 - DNA, 201 bp, Homo sapiens
aaaatcaaagttttttcccagcacagggagatggggccgatctctcttggatcaaaagtcctttttgtcctctcacatttgcagatgtgtaaattccaggsagatctaatgaaggagttaccttttcaatccctagattgtgtttgccaaaacttcacttgcaatagggacactccagcaaccctggctcggggctccctg

SEQ ID NO: 6729 - DNA, 201 bp, Homo sapiens
attctcttttttaaggattccgatgtctaagaaagcagccatgaggacctaataaagaactagagctgaataagttgtccagtgactatgatcaaatatayagctagcaatggcaatgtttcacatcaaagaagaaaatcaaagttttttcccagcacagggagatggggccgatctctcttggatcaaaagtcctttttg

SEQ ID NO: 6730 - DNA, 201 bp, Homo sapiens
gggccccctgctggagagccaacctgagggaaattgacgcacgatcagcatattccttccccaaaatgaggcgactcggaaatacacaatatcaatcatcrtctatgcaaccactcattattttgactcaaacagaacgacatacatcattggtaaagcccacgtggacatttccaggtccctggggcatttataagctgg

SEQ ID NO: 6731 - DNA, 201 bp, Homo sapiens
ttttgtcccccaccccccaaaaaaatggggagcattaaaattttaaaaaaggaattagatgaatatcctgctaaatgtaacttggcaagatgaaaggaagyagcaaagaaacatgaaaagggtgcagaccttcttgggccccctgctggagagccaacctgagggaaattgacgcacgatcagcatattccttccccaaaa

SEQ ID NO: 6732 - DNA, 201 bp, Homo sapiens
tttattcagcgcccttctgggcactaccagctgtgaaactggtaacctattgacaaataggttatttttccagctgcacccatattcaagagcttgaccarcaaagtcccctgataatatttggccatgagtcagaatgtattaggcaccttctgtagccagagccaaaaaaactctggctacaggagaaacctggcactg

SEQ ID NO: 6733 - DNA, 201 bp, Homo sapiens
ctccatccatgttgctgtgaagtacatgagttcattctttttatggctgtgtagtactccatgctgtatatgtaccagattttctttatccagtctaccaytgatgggcgtttaggtggattccatgtatttgctattgtgaatagggctgcagaatacatatgtatgcatatatctttatataattatttatattccttt

SEQ ID NO: 6734 - DNA, 201 bp, Homo sapiens
agtatttggttttctgttcctgcgttagtttgctaaggatactggcctctggctccatccatgttgctgtgaagtacatgagttcattctttttatggctrtgtagtactccatgctgtatatgtaccagattttctttatccagtctaccactgatgggcgtttaggtggattccatgtatttgctattgtgaatagggc

SEQ ID NO: 6735 - DNA, 201 bp, Homo sapiens
tttagctcccacttataagtaagaacatgtagtatttggttttctgttcctgcgttagtttgctaaggatactggcctctggctccatccatgttgctgtraagtacatgagttcattctttttatggctgtgtagtactccatgctgtatatgtaccagattttctttatccagtctaccactgatgggcgtttaggtgg

SEQ ID NO: 6736 - DNA, 201 bp, Homo sapiens
gtttagctcccacttataagtaagaacatgtagtatttggttttctgttcctgcgttagtttgctaaggatactggcctctggctccatccatgttgctgygaagtacatgagttcattctttttatggctgtgtagtactccatgctgtatatgtaccagattttctttatccagtctaccactgatgggcgtttaggtg

SEQ ID NO: 6737 - DNA, 201 bp, Homo sapiens
cccctccctatgtccctgtgttcgcactgtttagctcccacttataagtaagaacatgtagtatttggttttctgttcctgcgttagtttgctaaggatamtggcctctggctccatccatgttgctgtgaagtacatgagttcattctttttatggctgtgtagtactccatgctgtatatgtaccagattttctttatc

SEQ ID NO: 6738 - DNA, 201 bp, Homo sapiens
aactatttgtctgttgttcccctccctatgtccctgtgttcgcactgtttagctcccacttataagtaagaacatgtagtatttggttttctgttcctgcrttagtttgctaaggatactggcctctggctccatccatgttgctgtgaagtacatgagttcattctttttatggctgtgtagtactccatgctgtatatg

SEQ ID NO: 6739 - DNA, 201 bp, Homo sapiens
ggttctcaacagggaaagattattttttaactttcattttaggttcaggggtacatgtgcaggttatataggtaaactgtgtgtcacagggatttggtacmcacatttggtacagattattttgtcacacaggtaatatgcacatagtacctgacaggtagttttttatcctctccctcctcccaccctccgccctcgatt

SEQ ID NO: 6740 - DNA, 201 bp, Homo sapiens
gggtatgccaacttctatccctcatcattaaagacagttctggggggcatttatttatcccctgccacttcaggtctgccatatgcaggagccaaacacartcgtatggccagagaacattcttaggcagagagatgcctgtgcttgaggtgagaagccatcactgtgttgggaactgtccatctaagcttcaggtgaccc

SEQ ID NO: 6741 - DNA, 201 bp, Homo sapiens
ccctccaataacagtgtaggacacacctcattactgtctccctgagcagcaaagaagccagggtatgccaacttctatccctcatcattaaagacagttcyggggggcatttatttatcccctgccacttcaggtctgccatatgcaggagccaaacacaatcgtatggccagagaacattcttaggcagagagatgcctg

SEQ ID NO: 6742 - DNA, 201 bp, Homo sapiens
gctaatgcatatggggcttaatacctaggtgataggttgagaggtgcagcaatccattatggcaaatgtctacctaggtaacaaacctatgttctgtacaygtatcccagaacttaaaattaaatagaaatttttaaaaaggaaatagaaccatggaagcttaagcaaaatgaagcaaaggggaattacttcagttaagtt

SEQ ID NO: 6743 - DNA, 201 bp, Homo sapiens
acaccagagtctgttggtggtggggaagggagagcatcaggataaatagctaatgcatatggggcttaatacctaggtgataggttgagaggtgcagcaawccattatggcaaatgtctacctaggtaacaaacctatgttctgtacatgtatcccagaacttaaaattaaatagaaatttttaaaaaggaaatagaacca

SEQ ID NO: 6744 - DNA, 201 bp, Homo sapiens
ccggtcccagcgatcccaggaagtgaatagctagtttgttttgggtagctaagaacactgcccactcaaccaaaataagagtgacttcttcaaaaggttaygaacccactgatttctgacagtatttcccaagaaggcaaacagagcccaaagcctgtgcttaaaaagctagtgatctaataaccaaagaatcacaaatta

SEQ ID NO: 6745 - DNA, 201 bp, Homo sapiens
cctgctccctgggccaggctgcctgggggcgccccccagcccagccagccaggctctcaggccctgcgcctgcctcaggtctttcttgctgcagcatgctmcagcatggcccccaccccagggacaggaggccccacctggcttctcctgtagggtacctccctgcccccagcccccccaggaaatggtgctttcctggct

SEQ ID NO: 6746 - DNA, 201 bp, Homo sapiens
ggggagcaagttggtgggcatcatctcctcccgagacatcaactttcttgctgagaaggaccacaccaccctcctcagtgaggtgatgacgccaaggatcragctgatggtggctccagcaggcatgacattgaaacaggcaaatgagatccttcagcctagcaagggaagctgcctatggtcaatgatcgccatgagcta

SEQ ID NO: 6747 - DNA, 201 bp, Homo sapiens
tttttacctggggaatgtcgtggaactgtttgttttaataaagatttcttaacagaatatggagaagcaagtggcaagggggcaaagtggaagagagataycaatgaggaagctattggagtgatccaggggagtgatggcgccagccaggactggggggtgcatgggcaagggagaaaagtgggtaagtcaagggatatt

SEQ ID NO: 6748 - DNA, 201 bp, Homo sapiens
aggtaggctgaaatccaaagaacaagaaataatcagattacaaaaaaaaaaaaaataggaagaatgaataagacctaccatttaataaatagcacaacagkgtgactatagtcaataattgaacatttttaaataacaaaaaatatataattggatcgtttgtaacacaaaggataaatgctcaaggggatggagacctca

SEQ ID NO: 6749 - DNA, 201 bp, Homo sapiens
cacaccatgaaggtaggctgaaatccaaagaacaagaaataatcagattacaaaaaaaaaaaaaataggaagaatgaataagacctaccatttaataaatrgcacaacagggtgactatagtcaataattgaacatttttaaataacaaaaaatatataattggatcgtttgtaacacaaaggataaatgctcaaggggat

SEQ ID NO: 6750 - DNA, 201 bp, Homo sapiens
atgagcagatcaaatagaaaaatgtaacaaaaggcaatgcattataaccaagtacgttcacaccatgaaggtaggctgaaatccaaagaacaagaaataaycagattacaaaaaaaaaaaaaataggaagaatgaataagacctaccatttaataaatagcacaacagggtgactatagtcaataattgaacatttttaaa

SEQ ID NO: 6751 - DNA, 201 bp, Homo sapiens
ttccttttattttctctaataggagacccactcgcaactatgaggaatagatactatcagcagcaacagcaactttttttttaaggacaaagaaagtaaakatgggaaaatgtaaacttgtccaaagacatacatctagtcatgagaaagctgaaacccaaaacagctaagccgatgtatcacagcctctgaatcaccatc

SEQ ID NO: 6752 - DNA, 201 bp, Homo sapiens
tatatctcaggctacaagaaagtagagggagacaagagaaaaagcatccctcacacaaccttcagatcttccgctggagagatagccccactctaggaggraatggttattgctataatttgggggatattttggcaggtttgggaaaatctattcaaagtttagtttagtctcaatttctagaacatcgagccacttttg

SEQ ID NO: 6753 - DNA, 201 bp, Homo sapiens
cctaatctcccagcaaggaaaacctgggctgtcagtctactttaccaatccctgccttggaaattgctatatatctcaggctacaagaaagtagagggagmcaagagaaaaagcatccctcacacaaccttcagatcttccgctggagagatagccccactctaggagggaatggttattgctataatttgggggatattt

SEQ ID NO: 6754 - DNA, 201 bp, Homo sapiens
ataaacttgggacaagagcctaatctcccagcaaggaaaacctgggctgtcagtctactttaccaatccctgccttggaaattgctatatatctcaggctmcaagaaagtagagggagacaagagaaaaagcatccctcacacaaccttcagatcttccgctggagagatagccccactctaggagggaatggttattgct

SEQ ID NO: 6755 - DNA, 201 bp, Homo sapiens
tgctctctgcttttggccagaatccctggggtcatttaggtggtgatgttgccagttcttctcccctctggccaacacctctcaatccattatttgggatmccaattataaacttgggacaagagcctaatctcccagcaaggaaaacctgggctgtcagtctactttaccaatccctgccttggaaattgctatatatct

SEQ ID NO: 6756 - DNA, 201 bp, Homo sapiens
atgttggggcttcgagaaagattgctctctgcttttggccagaatccctggggtcatttaggtggtgatgttgccagttcttctcccctctggccaacacytctcaatccattatttgggataccaattataaacttgggacaagagcctaatctcccagcaaggaaaacctgggctgtcagtctactttaccaatccctg

SEQ ID NO: 6757 - DNA, 201 bp, Homo sapiens
agatgttggggcttcgagaaagattgctctctgcttttggccagaatccctggggtcatttaggtggtgatgttgccagttcttctcccctctggccaacmcctctcaatccattatttgggataccaattataaacttgggacaagagcctaatctcccagcaaggaaaacctgggctgtcagtctactttaccaatccc

SEQ ID NO: 6758 - DNA, 201 bp, Homo sapiens
agcaacagcagatgttggggcttcgagaaagattgctctctgcttttggccagaatccctggggtcatttaggtggtgatgttgccagttcttctcccctytggccaacacctctcaatccattatttgggataccaattataaacttgggacaagagcctaatctcccagcaaggaaaacctgggctgtcagtctacttt

SEQ ID NO: 6759 - DNA, 201 bp, Homo sapiens
ctttctgagcaacagcagatgttggggcttcgagaaagattgctctctgcttttggccagaatccctggggtcatttaggtggtgatgttgccagttcttytcccctctggccaacacctctcaatccattatttgggataccaattataaacttgggacaagagcctaatctcccagcaaggaaaacctgggctgtcagt

SEQ ID NO: 6760 - DNA, 201 bp, Homo sapiens
aagctttctgagcaacagcagatgttggggcttcgagaaagattgctctctgcttttggccagaatccctggggtcatttaggtggtgatgttgccagttyttctcccctctggccaacacctctcaatccattatttgggataccaattataaacttgggacaagagcctaatctcccagcaaggaaaacctgggctgtc

SEQ ID NO: 6761 - DNA, 201 bp, Homo sapiens
tcagagctatctcttgtcccaaaggatgaaaacctccgagcgccgtggaagagaacagtctgattaagttggctcaaactgccaggaagctttctgagcamcagcagatgttggggcttcgagaaagattgctctctgcttttggccagaatccctggggtcatttaggtggtgatgttgccagttcttctcccctctggc

SEQ ID NO: 6762 - DNA, 201 bp, Homo sapiens
tttcagcagagaaacaacatgatcgggtttgcattttgaaagatcccactggcttcagtagagaggatagattttgagcaagaagcaaagatgcttgtgcraaggagagtaattcgaagacctttggtagtcctggcaagagatgttgagtgttggatcacagagctggtgatggaaatggggagatgtatttcgactgat

SEQ ID NO: 6763 - DNA, 201 bp, Homo sapiens
gaggtcagccatgaagtgcttggaaggccacagagacaaattttattcctatcaccatagcaacgggaagccatgaaaccgttttcagcagagaaacaacrtgatcgggtttgcattttgaaagatcccactggcttcagtagagaggatagattttgagcaagaagcaaagatgcttgtgcaaaggagagtaattcgaag

SEQ ID NO: 6764 - DNA, 201 bp, Homo sapiens
aaaccacaatgcaataccactttattcctgcaagaatggccataatcaaaaaattaaaaaaatagacattggcatggatgtggtgaaaaggaaacacttcygcactgctggtgggaatgtaaactagtacaaccactatggaaaacagtgtggagatagcttaaataactaaaaggagaactaccatttggcacagcaatc

SEQ ID NO: 6765 - DNA, 201 bp, Homo sapiens
tcagcctcctgagtagctgggagtacaggcacccaccacaatgcctggctgatttttgtatttttagtagagacagggtttcaccacgttggccaggctgrtctcaaactccttacctccagtgatctgcccgcctcaacctcccaaagtgctgggattataggcatgagccactgtgcctggcccagaaagcatttttta

SEQ ID NO: 6766 - DNA, 201 bp, Homo sapiens
tttaaaaagtgctggactgaggaaaggtgagagttacaggctcagttctgccactcgcctgctgtgtgactttgagctggtcattccctatctcttaatawcagcttcttcatctatagaatgtgggtatacatgaggggatttttttagaactctagttctcagttctgactgcatattattctcaccaagaaaacagtt

SEQ ID NO: 6767 - DNA, 201 bp, Homo sapiens
ttggctcactgcagcctctgcctcctgggttcaagcaattctcctgcctcagcctcccaagtagctgggattacaggcacccaccaccatgcctggctaaytttttgtatttttagtagaggtggggtttcgccatgttggccaggctggcctcaaactcctggctcaagtgatccacccgcctcagcctcccaaagtgct

SEQ ID NO: 6768 - DNA, 201 bp, Homo sapiens
ggaggctgaggtaggtgatcacttgagccaggagtttgagatcaacctgggcaacatggaaaccccatctctaccaaatacgtatgtatgtgtgtgtatayacacacacacacacacacacacacacacacacaaacacacaaaattagctgggtgtggtagtgtatacctgtagtcccagctactcgtgaggctgaggtg

SEQ ID NO: 6769 - DNA, 201 bp, Homo sapiens
tggatcacatctataactttggaggctgaggtaggtgatcacttgagccaggagtttgagatcaacctgggcaacatggaaaccccatctctaccaaataygtatgtatgtgtgtgtatacacacacacacacacacacacacacacacacacaaacacacaaaattagctgggtgtggtagtgtatacctgtagtcccag

SEQ ID NO: 6770 - DNA, 201 bp, Homo sapiens
cacagaaactgaaacccttgtacattgctgatggcaatgtgatatggtgcaactacctgtgaaaacagtttggcaattttttaaaaacttaaaacgtaaasttactatatggcccagcaattccacttataggtatcaacccaagagaaattaagatatacatccacacagactggcatatagatattcacaggagtatta

SEQ ID NO: 6771 - DNA, 201 bp, Homo sapiens
agtctcccagattgaaaaattcatcctaaagtcgatttcctaagcttcggcctggaaatactgccaacatagactctgtgtcatgtcaactgtcactgagyacaaacaggtaaaaatgccacagtgccactttccatcctggacaaacagcccaggacatacagggaggcagggattggcacacatggaaggagagtgctg

SEQ ID NO: 6772 - DNA, 201 bp, Homo sapiens
acagttaaattatatcatctatataagagacttaatgcatatctggcattttcttttttatttatttttgggcagggttggggaacagggtcttactctgygacccaggctggagtgcagtagcatgatctcagctcattgcagcctccatctgggctcaagtgatcctcccacctcagctttccaagtagctgggactat

SEQ ID NO: 6773 - DNA, 201 bp, Homo sapiens
cttataaggggttgcagcctgtaagctgaccatctcgcaggctggggagtgtagcatccagcagaaaccagaggcaggcacttcaaaggaggcaaggtgasacaggaatttatgctaacagaatggctaagtatacatactcaagttataggaggagctatgaatattcacaaaagaagggcacgcaaatgcacagtaaat

SEQ ID NO: 6774 - DNA, 201 bp, Homo sapiens
actgactgcctgccacatcaccgtctctgcattgcaattgcaaacattgttgtgcattctgaatccccagtgtctttctgtttttcaccagccatgatcaygacagtgacaacaataacaatacagccttatgctcatagctccattcattcaaacagccatgcaacaacacctgagatttgttgtgcatctgtgaggact

SEQ ID NO: 6775 - DNA, 201 bp, Homo sapiens
cctctaaaagctggaaagcccagtaaatggattctcccctgcagcctccagaaagaacacagcactgcaccttgattttagcccagtgagatgtgggtgamcagtaggattataaattgatgtgttttaagccactgtgtgtaatttgttatagcagcaaagggaaaaaatactaataggatgtgtaacaggcatctcaag

SEQ ID NO: 6776 - DNA, 201 bp, Homo sapiens
ttcagaagaaaggcacagaggaatgcaatgttgctggcactggagatggaggaagcgaccacaagccaaagggtacaggcagcctctaaaagctggaaagsccagtaaatggattctcccctgcagcctccagaaagaacacagcactgcaccttgattttagcccagtgagatgtgggtgaccagtaggattataaattg

SEQ ID NO: 6777 - DNA, 201 bp, Homo sapiens
atttatcctggatgacctgcgtggggccaatatcatcaccagggtcacaagtgcagaacctttcctggctttgggtagaaagagatgtgacttcagaagawaggcacagaggaatgcaatgttgctggcactggagatggaggaagcgaccacaagccaaagggtacaggcagcctctaaaagctggaaagcccagtaaat

SEQ ID NO: 6778 - DNA, 201 bp, Homo sapiens
ctaattcctggaacctgtgagcatgttaccttacacagcaaaggggacttggcaaatgtgattcagttaaagatcttcagaggggaatttatcctggatgwcctgcgtggggccaatatcatcaccagggtcacaagtgcagaacctttcctggctttgggtagaaagagatgtgacttcagaagaaaggcacagaggaat

SEQ ID NO: 6779 - DNA, 201 bp, Homo sapiens
cgactgaacaaatgcagaaagtaaatatggaagagtcgagagcactgtgaacattccatctgcagctacctacacttctgaaaagccagactcaaacatcmaagtctctccttgcatctccaccaggatatgtgtgtagtaggcagagcactggtccccaacaaggtccacaccctaattcctggaacctgtgagcatgtt

SEQ ID NO: 6780 - DNA, 201 bp, Homo sapiens
gttctacctcaagcagctcatagtctggaggagaaagagctatgacgactgaacaaatgcagaaagtaaatatggaagagtcgagagcactgtgaacattmcatctgcagctacctacacttctgaaaagccagactcaaacatcaaagtctctccttgcatctccaccaggatatgtgtgtagtaggcagagcactggtc

SEQ ID NO: 6781 - DNA, 201 bp, Homo sapiens
tctaagagatgagtttggtttaaatttgaactcaaactgtattcttgtcacagacaatccagagcactctctggggtgtggctctgagacacacaaggagsaaaagacccaagttctacctcaagcagctcatagtctggaggagaaagagctatgacgactgaacaaatgcagaaagtaaatatggaagagtcgagagca

SEQ ID NO: 6782 - DNA, 201 bp, Homo sapiens
cacgcactaggatctgtatgatgctcctcatctaagagatgagtttggtttaaatttgaactcaaactgtattcttgtcacagacaatccagagcactctytggggtgtggctctgagacacacaaggaggaaaagacccaagttctacctcaagcagctcatagtctggaggagaaagagctatgacgactgaacaaatg

SEQ ID NO: 6783 - DNA, 201 bp, Homo sapiens
acacatgtccgtggccctcccacgcactaggatctgtatgatgctcctcatctaagagatgagtttggtttaaatttgaactcaaactgtattcttgtcayagacaatccagagcactctctggggtgtggctctgagacacacaaggaggaaaagacccaagttctacctcaagcagctcatagtctggaggagaaagag

SEQ ID NO: 6784 - DNA, 201 bp, Homo sapiens
ggggacctaaaagctaaaacaagagctcagcagggttagggtctgccatgaactcttaccaggcaaggcagggtggagacacatgtccgtggccctcccamgcactaggatctgtatgatgctcctcatctaagagatgagtttggtttaaatttgaactcaaactgtattcttgtcacagacaatccagagcactctctg

SEQ ID NO: 6785 - DNA, 201 bp, Homo sapiens
ccacaaaacccctagccacaatgccaagtttgtatccagagtggcgacggtggggacctaaaagctaaaacaagagctcagcagggttagggtctgccatraactcttaccaggcaaggcagggtggagacacatgtccgtggccctcccacgcactaggatctgtatgatgctcctcatctaagagatgagtttggttta

SEQ ID NO: 6786 - DNA, 201 bp, Homo sapiens
tgcatccatcccacaaaacccctagccacaatgccaagtttgtatccagagtggcgacggtggggacctaaaagctaaaacaagagctcagcagggttagkgtctgccatgaactcttaccaggcaaggcagggtggagacacatgtccgtggccctcccacgcactaggatctgtatgatgctcctcatctaagagatga

SEQ ID NO: 6787 - DNA, 201 bp, Homo sapiens
tttaccctctttcctgcattaggtacagctaagctttgcaaattaactcacaacaggatccagtgggccttgacccaaaaaccatccacaggagaatgttsacgaggcaacaactgctgcatccatcccacaaaacccctagccacaatgccaagtttgtatccagagtggcgacggtggggacctaaaagctaaaacaag

SEQ ID NO: 6788 - DNA, 201 bp, Homo sapiens
gatagcacttcacactcaccaggatggctaaattcagaagaatggaaataacaaatgttgaccaggatgtggagaaataagaaaccctgtacactgattgygagaatgtaaaatggtacagctgctatggaaaacagtacgacagttcttcaaaaagctacacatagaactcctatatgatccagcaattccatttctagg

SEQ ID NO: 6789 - DNA, 201 bp, Homo sapiens
aatggatcatagacaaaatattagacatccttcaccctttgtcaaaattaaaaacttttattcatcaaagggcactattaagaagtgaaaatacgaccagmctggccaacatggtgaaaccgcatctctactaaaaatccagaaaaaaaaaaaaaattagccgggcaacagtagcacgtgcctgtaatcccagctactcag

SEQ ID NO: 6790 - DNA, 201 bp, Homo sapiens
ttttcattatggtggagaagcagaaggaaaaatgtgctcagaggcagaggcaagatgaggaaactcagtgacaagaccccctttttttttttttttttttytgagacagagtctcttttcgttgcccaggcccaggctggagtacagtggcccaagctcggcttactgcaacctcctcctccctagttcaagagattcccc

SEQ ID NO: 6791 - DNA, 201 bp, Homo sapiens
tcagctttggctgcaatttggaagtacccaaggagctttaaaaactactgaagctggggtcccatgccctgagtttctgttttgatttgtctgcactgtgycctaggatggagggaagttgtaaagttctcctaggtgattatagtatgcagtcaagtttgagaaccactggacttagcctctcttgggatctcagaataa

SEQ ID NO: 6792 - DNA, 201 bp, Homo sapiens
cctggctgctgcttctatcaccagtatggtcccaagcaccagccctgcctgccactatcacttcttgaaaggcaacccaagaggagaagtggacgggagcygacaccaggcaggggttaaattgtttatatgcatcatcttgtttaatttttaagacaaccctataggtacagtacttttgtttatctccatttcacagag

SEQ ID NO: 6793 - DNA, 201 bp, Homo sapiens
aggaaagaaaacagggtatgttcaaaactgacagagagcacaggtgacaactgacagagcacaggtgcgtggtggggagcaggtggcaagaggagagggayaagacaggtgggtaaggaccccgcagttcatgagaaggcacctaggttctagccaccaagatgtcatgagaagcccttaaaggctattcagaagagaagt

SEQ ID NO: 6794 - DNA, 201 bp, Homo sapiens
atgggaggctgagattacccacaggctaagccagtggttctatactggggacacattcccacccccaccccaagggacattggcaatgtctggatgcatgmgggttgtcataaattgggcagggggtgctactagcatggcatgggtagaggctacatgtcctgcaatgcgtattatatccaccccctccaccccacagca

SEQ ID NO: 6795 - DNA, 201 bp, Homo sapiens
acaaaaaacaaaaaacaaagaaacaaaaaaaccgctagattacaaagaaaacaaattatatcaaaatacagtcataatgatgttttaaaacaaacttgtgwtatgtttatgtcggtattaacatgctaaatcacaagatctgtgctgtgtctactaactacaatgatttcaaaataatttggcaaaagtaaataattctga

SEQ ID NO: 6796 - DNA, 201 bp, Homo sapiens
cctggtgaaaagagctagacactgtctcaaaaaaaaccaaaaaacaaaaaaaccaaaaaacaaaaaaacaaaaaacaaaaaacaaagaaacaaaaaaaccrctagattacaaagaaaacaaattatatcaaaatacagtcataatgatgttttaaaacaaacttgtgttatgtttatgtcggtattaacatgctaaatcac

SEQ ID NO: 6797 - DNA, 201 bp, Homo sapiens
agcctggtgaaaagagctagacactgtctcaaaaaaaaccaaaaaacaaaaaaaccaaaaaacaaaaaaacaaaaaacaaaaaacaaagaaacaaaaaaamcgctagattacaaagaaaacaaattatatcaaaatacagtcataatgatgttttaaaacaaacttgtgttatgtttatgtcggtattaacatgctaaatc

SEQ ID NO: 6798 - DNA, 201 bp, Homo sapiens
tgatgtacctacaagccaaagaacgccaagggttgatggcaaccaccagaagttagaagatgcaggggagggtcttcccttagcatccttggaaagagaayagtaatgccagaaccttgattttgaacatctagcctctagaactgtgatataataaattcctgtggttttgagccacgaagtttgcaggactttgttgag

SEQ ID NO: 6799 - DNA, 201 bp, Homo sapiens
tgagggtggcaggcttcagcagcatctttatatttttaaaatctgaaataaatgtgacaaaaatattaacatttgttaaatctgaattgtcagtacatggktgtttgttattttattctctgtacttatcagcatgtctgaaatattccaccattgataaatcctggttttgaaagagaaaaagaaaagatttaaacacaa

SEQ ID NO: 6800 - DNA, 201 bp, Homo sapiens
cagctttaggttagtggtttcctctgaggaaggagataagggaatgaaatgagggtggcaggcttcagcagcatctttatatttttaaaatctgaaataartgtgacaaaaatattaacatttgttaaatctgaattgtcagtacatggttgtttgttattttattctctgtacttatcagcatgtctgaaatattccacc

SEQ ID NO: 6801 - DNA, 201 bp, Homo sapiens
actccagcccaggcaacagagcgagactctatctcaaaaaaaaaaaaaaaaaaaaaaaaaaaaaaaaaaaaaagaaaaaagaaagaaagaaagaaaaaagraaaaaaaaacagtagttggaaaaatatagtactgtttataaaaagcataaaacatactaataccattataccctaggtttgcatgtacatatagaaaaac

SEQ ID NO: 6802 - DNA, 201 bp, Homo sapiens
cactccagcccaggcaacagagcgagactctatctcaaaaaaaaaaaaaaaaaaaaaaaaaaaaaaaaaaaaaagaaaaaagaaagaaagaaagaaaaaaraaaaaaaaaacagtagttggaaaaatatagtactgtttataaaaagcataaaacatactaataccattataccctaggtttgcatgtacatatagaaaaa

SEQ ID NO: 6803 - DNA, 201 bp, Homo sapiens
gccattgcactccagcccaggcaacagagcgagactctatctcaaaaaaaaaaaaaaaaaaaaaaaaaaaaaaaaaaaaaagaaaaaagaaagaaagaaaraaaaaagaaaaaaaaaacagtagttggaaaaatatagtactgtttataaaaagcataaaacatactaataccattataccctaggtttgcatgtacatat

SEQ ID NO: 6804 - DNA, 201 bp, Homo sapiens
tgcagtgagctgagatcacgccattgcactccagcccaggcaacagagcgagactctatctcaaaaaaaaaaaaaaaaaaaaaaaaaaaaaaaaaaaaaaraaaaaagaaagaaagaaagaaaaaagaaaaaaaaaacagtagttggaaaaatatagtactgtttataaaaagcataaaacatactaataccattataccc

SEQ ID NO: 6805 - DNA, 201 bp, Homo sapiens
gtgggcggatcatgaggtcaggagatcaagaccatcctggctaatatggtaaaaccccatctctactaagaacacaaaaaattagccggacatggtggcaygcgtctgtagtcccaactactcaggaagctggaggcaggagaatcgcttgaacccaggaggcggaggttgcagtgagctgagatcacgccattgcactcc

SEQ ID NO: 6806 - DNA, 201 bp, Homo sapiens
taaaatataaatagttaaaataaatccactaaagctacatttataaacacagataaatctcaataacataatactgagtaaaaaagagtaatttgggccasgcgcagtggcttacgcctgtaagcctaccattttgggaggccgaggtgggcggatcatgaggtcaggagatcaagaccatcctggctaatatggtaaaac

SEQ ID NO: 6807 - DNA, 201 bp, Homo sapiens
taaagacctcccggaaaatgtaggtcctgtgctggatataaagaaaagatctgttgaggcaggaagcttcaatcactagagcaaattccacccaaactggsagcttctcctaaatggagatcctgagccctatccttagaatacagagagtgaggccaggcatggtggcttacacctgtaatcccagcactttggaaggcc

SEQ ID NO: 6808 - DNA, 201 bp, Homo sapiens
tgccccaggggacatgaatgatgcttctagccagggagaggggtgggctaagatattccgccttcaggttgctgggagggtaagtgtgaccagggctggckggcggtaaagacctcccggaaaatgtaggtcctgtgctggatataaagaaaagatctgttgaggcaggaagcttcaatcactagagcaaattccacccaa

SEQ ID NO: 6809 - DNA, 201 bp, Homo sapiens
ctcaagtaatttatatccttctataaatgatcatttattttataacataaaacaaccacaaccattatttggtagcagatagatctaggtcccactctccrctagcttgtggatgttactgtctcgatctcagtttcttcatccagaaaatcggggtgataaagtctacctctctagatcattttcagaattcagtaaaat

SEQ ID NO: 6810 - DNA, 201 bp, Homo sapiens
agatgccagtagtactcaccttcactcatgacaaccaaagctgtctccacacattgccaaacagagaacatttgtccctgaaggataaaattacttcacaktgaaaaccattggtgtacaccctggtgacatacagataaaaagatttgtttcctgccctcaagtaatttatatccttctataaatgatcatttattttat

SEQ ID NO: 6811 - DNA, 201 bp, Homo sapiens
cttccatcaccagggtgcagacatgattcaaggatttctggtaagatctggccaggaaaatgtatcccacgagctcaaaactgccaagcactattgttaakaacacagatggcctccttcaggaaagtattattttctttccctaaatagaagcaaggtaaatatgttcttccttcttatgtttaccaagggtctctggct

SEQ ID NO: 6812 - DNA, 201 bp, Homo sapiens
cggctcactgcaacctctgcctcccaggtcccggttcaagcaattctcccgcctccgtctcgccaccatgcccagctaatttttgtatttttagtaaatayggggtttcacaatgttggccaggctggtcttgaagtcctgacctcgtgatccacccacctcggcctcccaaagtgctgggattacgggtgtgagccacca

SEQ ID NO: 6813 - DNA, 201 bp, Homo sapiens
tatgtgtgtatatatacacacatatatatgtatatatatacacacacacatatatatatacacatacgtgtgtgtgtgtgtgtgtatatatatatatatakagagagagagagagagagagagagagagacagagacagagacagagacagagagtgcctcactctgtagcccaggcaggaatacggtggcgcaatctcgg

SEQ ID NO: 6814 - DNA, 201 bp, Homo sapiens
cccactgcttgatcaatggaagggggctgcaatatacatatacatacacacacatatatatatacacacatatatatacacgtataaatatgtgtgtatawatacacacatatatatgtatatatatacacacacacatatatatatacacatacgtgtgtgtgtgtgtgtgtatatatatatatatatagagagagagag

SEQ ID NO: 6815 - DNA, 201 bp, Homo sapiens
cagcttagtgctgaagggttttcaaattgtttcaagcatcttaacctgcccccatcagccaagctacctccttcttaaggtcaaactcctgtgccaaataytccttttgttcagcccctgagcctagatattacagcatttgatgcttaatatacacttgcccactgcttgatcaatggaagggggctgcaatatacatat

SEQ ID NO: 6816 - DNA, 201 bp, Homo sapiens
gcagctgtgggggaggctggcaggtcagagctgtgccgatgagccgtcgtatctatgctctgcgaaagcggccccagccaggaacactcccctctgccgcrggctggaagaggtggctttctctgtgcttatcctaagcccttccttctctgcctccacctgacatcaaagccccctggcaaagtaacccaggttaaggca

SEQ ID NO: 6817 - DNA, 201 bp, Homo sapiens
ggaggctggaggcagctgtgggggaggctggcaggtcagagctgtgccgatgagccgtcgtatctatgctctgcgaaagcggccccagccaggaacactcscctctgccgcaggctggaagaggtggctttctctgtgcttatcctaagcccttccttctctgcctccacctgacatcaaagccccctggcaaagtaaccc

SEQ ID NO: 6818 - DNA, 201 bp, Homo sapiens
acgcagctgcgctccgacactgcatctgcctctgttcctgaataagccgctctggaggctggaggcagctgtgggggaggctggcaggtcagagctgtgcygatgagccgtcgtatctatgctctgcgaaagcggccccagccaggaacactcccctctgccgcaggctggaagaggtggctttctctgtgcttatcctaa

SEQ ID NO: 6819 - DNA, 201 bp, Homo sapiens
tacatggatttggatgtaaaccaaactgattatcatgttttcccttctatggagagaacaggagaaaactgggacagggaaacagatagaatcagaacttytacattatcattaatgttttattgctttcaaaatgttgaaacaaacattaacctttggcaggtttagctttgttccctatgatgaatatcgggttgagta

SEQ ID NO: 6820 - DNA, 201 bp, Homo sapiens
tgctgctttgcatgcctggtaacttttgatgggatggaagaaattataaattttaacttttttcgtgctgatatttttgtattactataaatatcactgarctctgttctagagtgactaagttacttggaaacagtttgatcttttcaaattttgcttttgatatttgttaggcagagtgagagcaattcatagtctaca

SEQ ID NO: 6821 - DNA, 201 bp, Homo sapiens
aaccaaaaactatagaatgagatgatatggatcaattgacattcaattcaaggtgcgatttttatttcagaatttctggatattcacatactggaatataraattcataaaagcagggattttgcctggtttttccttctgctgctttttctcccttgaagaacctagaatactacctggtataaagtagatgctcaatgc

SEQ ID NO: 6822 - DNA, 201 bp, Homo sapiens
gccccaaagaagccatatagcttttccaattgtaaaagaaggcccatggggtgctgcagaagatgaaaaggacattctcagcattttctgaaaaaaatgcytgtttgtgtatgacaaccacgcagcagccaccagcagcaccgaaggttgccagaagatggaattatatcatagttgtgtcctgtgattgccctagaacca

SEQ ID NO: 6823 - DNA, 201 bp, Homo sapiens
cagaatgaatgactgtactagaaaacgcttggaggctatacagtcctatatacatataagggactatgggactatatatatatatatatatatatgtataygtatgtatttatctaggacttatattctgtgtgtgtgtgtgtgtgtgtgtgtgtgtatgagataaaagtatatatacccaagatatttatattatattga

SEQ ID NO: 6824 - DNA, 201 bp, Homo sapiens
atcacgaacacactgatttgctattctttaggggagcctggagttcttggggtgagcctgggctgtgatggaaggcataacaagaaagctgaaactgttaygagccaaacttcctaatctcttgcacatgtcaatcgcactacagtgcagatgcattcttaactgtttttattttgtctgtgtcaggtttacatgcacacc

SEQ ID NO: 6825 - DNA, 201 bp, Homo sapiens
tcccgctttccctctccctctctagcctgatccctctcccgctctccctccggtcgagtctccctcctccctggcccaaggagccctgatctccctctggkacgtacctgtagcccgagaaggtcgaggatgcagtggggcgcgctgcgcgcacgagcatctcggccgcctcagcagccaccgggtttagcgggttcccgc

SEQ ID NO: 6826 - DNA, 201 bp, Homo sapiens
taaggcatcatcctcatactgctcatggtgggaggaaaaaaaaaaaaaaaaagactgttccgagtctccccctccctggctgttttgctaagccccaggcstacaggaggctggatggcccaggggaagaggctgccttgcctaccctgggaaagtggatggagggtagcttcttcctctgccaagaaaatcaggcgtcct

SEQ ID NO: 6827 - DNA, 201 bp, Homo sapiens
ctcctacagcaagtctgaaggctgagagcaaagcaatggagctaaggcatcatcctcatactgctcatggtgggaggaaaaaaaaaaaaaaaaagactgtyccgagtctccccctccctggctgttttgctaagccccaggcctacaggaggctggatggcccaggggaagaggctgccttgcctaccctgggaaagtgga

SEQ ID NO: 6828 - DNA, 201 bp, Homo sapiens
gcactcccaaggaataagtaaatccctacttaaattgcctgggaggcctccctcaattacacaaatctaagacatgacagggtacagcagagattctcctmcagcaagtctgaaggctgagagcaaagcaatggagctaaggcatcatcctcatactgctcatggtgggaggaaaaaaaaaaaaaaaaagactgttccgag

SEQ ID NO: 6829 - DNA, 201 bp, Homo sapiens
gatccagggctggggctactgaggcatctacgggtacagaattcaaggaagaactcattctcagggccatgcaagtgcaggattcagctacccctggcttkgactggtggtagaaatgggtaggttgatgatatattttggaggtaaaatcaaatttgttctaaaaatttctgaagttcagaagcaaataataactttaga

SEQ ID NO: 6830 - DNA, 201 bp, Homo sapiens
acaaaggataatcactattctatctggtttatttggggtatctcttatcacttcctagaaaggttttttgttttttgtttttatttttgttattttttttragacggagtctcactctgtagcccaggctgtagtgcattggcacaatcttggctcactgcaacctccgcctcccaggttcaaatgattctcctgcctcag

SEQ ID NO: 6831 - DNA, 201 bp, Homo sapiens
cattcaattcaaggtgcgatttttatttcagaatttctggatattcacatactggaatatagaattcataaaagcagggattttgcctggtttttccttcygctgctttttctcccttgaagaacctagaatactacctggtataaagtagatgctcaatgcaaatttgtggaatgaacaaaagtctcaactctctgtctt

SEQ ID NO: 6832 - DNA, 201 bp, Homo sapiens
aatccagaataagcatgaatcaaagaggacaggcctgggcaggttcagtgtgaggcacccatggccatgtcaaggagagaagcccaccaagcacctagggraacaggtcaggaacccagggcaagaggttgaggctacaactgtagattgtggaggcatctgcaaagctccaactactaaggactatatctagagaagagg

SEQ ID NO: 6833 - DNA, 201 bp, Homo sapiens
ttgcgcccatgggaacttgcacctgttcttcctatatctgttttcaggggagatgtttccagccacaagtatctctactaaccacttagttctgcaccatygtgaggaaagctgtaagttcagtagaaggagcaaggtgtcaaggtcactcttttcctaatgctgacaacattaaaagacagagtaatagagtttcaggag

SEQ ID NO: 6834 - DNA, 201 bp, Homo sapiens
atgtaaggggccttagaaaggaggatttcatcttcattctgtatcatgttatatttgagatattgttggccaacacaacacaattctgtttctatatctgyatctgttattataaaaacccaaacataaacttggttgaacttaaggggctgcttcttggaggagaaaactagaatgcatataggtctgcaaaaaaagttt

SEQ ID NO: 6835 - DNA, 201 bp, Homo sapiens
gcaaaagactgagtacatgaaaatacagagggttcgttcatatggcaatgactatggtacacaattaggaagtttaggcaaacttctatgatcattgctayatagtcaacacttattagtgtaatgctgcaacccagacttcactgtctttaaattatccttagttcagacctttcctactgggatttgagaacagacata

SEQ ID NO: 6836 - DNA, 201 bp, Homo sapiens
acagaacagaaaatctttgtggtgctgcaatctcaacacttgctgagcttagcaagtcaggatgtttcctgaactaaagtctcaataggaggatgcacccrgtttacctcttttcttcctcaatgtgtgtttctgaatagctactcaaaccctgcaacccttgttatatttcatttcactggagaatgagagagcaggtgt

SEQ ID NO: 6837 - DNA, 201 bp, Homo sapiens
ttcttcctcaatgtgtgtttctgaatagctactcaaaccctgcaacccttgttatatttcatttcactggagaatgagagagcaggtgtttttactcctgycttactgatgtgggaagtacagccctataagggaagattagtgatatatctgagtagaaagaaccagtgggaaattaaaaaaacagaaagaaagaaagaa

SEQ ID NO: 6838 - DNA, 201 bp, Homo sapiens
gatgtactctcttctcacaccactctctttctgttcatcacaaggtttattacaacatggggtcacccatttcttcctggtcgaattgttttctaaccacrtaagttccatgatggaaaggtcctagtcttttgccctccctgttcatccatgtatcccctgtgcccagcaatgtgcctaacatgcaaactgtgcttaatg

SEQ ID NO: 6839 - DNA, 201 bp, Homo sapiens
tcattctgtattaaaacaatttatttataacaattttacttataacaatgtctgtgttatttcactgtaaaggaattcagcaaaaatcattaaaacattcmtgaccccaaaacatggtctgtttcacacaattatgaatcatgatgaattatgaatcatgaatcatgggatgtacacttgcccttccttggtgggccccac

SEQ ID NO: 6840 - DNA, 201 bp, Homo sapiens
tctgtattaaaacaatttatttataacaattttacttataacaatgtctgtgttatttcactgtaaaggaattcagcaaaaatcattaaaacattcctgaycccaaaacatggtctgtttcacacaattatgaatcatgatgaattatgaatcatgaatcatgggatgtacacttgcccttccttggtgggccccacctct

SEQ ID NO: 6841 - DNA, 200 bp, Homo sapiens
cccctcttggggattctagtctaagcgaagatgaataggcaagcaaacaatgccaaagcaagctgttaacactcttacgaattagtatacaggtctgcagaatgaagtggaaaagggcagacccactttgagctacccagatatagaatcaatggaaagggtgtccttagcaaagaggacaaatgtttgaaggggcagga

SEQ ID NO: 6842 - DNA, 201 bp, Homo sapiens
gcagtggtgtaatctcagctcactgcaaccttcacctcccaggttcaagcaattatcctgcttcagcctcactagtagctgggattacaggtacctgccaycactcccggctaattcttatatttttagtagagacagggttgcaccatgttggccaggctggtttgaactcctgacatcaaatgatccacctgccttggc

SEQ ID NO: 6843 - DNA, 201 bp, Homo sapiens
gaactgaatgtcacagcaactttttttttttttggaaacagggtctcactctgccacccaggatggagtgcagtggtgtaatctcagctcactgcaacctycacctcccaggttcaagcaattatcctgcttcagcctcactagtagctgggattacaggtacctgccaccactcccggctaattcttatatttttagtag

SEQ ID NO: 6844 - DNA, 201 bp, Homo sapiens
atgaactgaatgtcacagcaactttttttttttttggaaacagggtctcactctgccacccaggatggagtgcagtggtgtaatctcagctcactgcaacsttcacctcccaggttcaagcaattatcctgcttcagcctcactagtagctgggattacaggtacctgccaccactcccggctaattcttatatttttagt

SEQ ID NO: 6845 - DNA, 201 bp, Homo sapiens
tgggaaaactgaaaaatttagtaaattatcaagaaatttggaaatatccagtttgttatctgtttggaaatgctggatcagggaacaaatgttttggtttygataaagacacttgctcctggggagagccattcacaaggttgcgtaacatgaactgaatgtcacagcaactttttttttttttggaaacagggtctcact

SEQ ID NO: 6846 - DNA, 201 bp, Homo sapiens
taattatagcagttatcatgacaagaactaacacttattgagtaattactatttgctaagcactatcctaaaggcttcatactaattgttgaattaatctycatgacattttctgaattagttgatatttgtacacccattaaacaggtaaaaattaccaactcttaaatttttaagagtttataacatacacaactttag

SEQ ID NO: 6847 - DNA, 201 bp, Homo sapiens
aaagaaaaaccccaagaccacagaatgttagcactggaaggtttgttcacaatcattagctgtactcttctcctatttttcagatgagtaaactgaagttkaaaaggggaagtggctttcccaaggacacactgtgagtacatgacagcaaaagcagaaagtgtccttaattatagcagttatcatgacaagaactaacac

SEQ ID NO: 6848 - DNA, 201 bp, Homo sapiens
gtaaacttcacagttctggaaagcttcttcagaatatcaatgcagaaccccttgcagcatttcttcacattcatcccctcattggttgaattgctgtaaaraaaaaccccaagaccacagaatgttagcactggaaggtttgttcacaatcattagctgtactcttctcctatttttcagatgagtaaactgaagttgaaa

SEQ ID NO: 6849 - DNA, 201 bp, Homo sapiens
tctctagacatatttattattcactatttcccccttagactttaattctcttactgtttcacaaatgccaccataacccatttagtgtttctcaattttcrgttaattttccatctactttgccatttctgaagttcccagggacgtttcctggatcacagtgtcccttaaatgcctccttgaactgcttgggtgtcacag

SEQ ID NO: 6850 - DNA, 201 bp, Homo sapiens
taattatttgagatgttctctagacatatttattattcactatttcccccttagactttaattctcttactgtttcacaaatgccaccataacccatttaktgtttctcaattttcggttaattttccatctactttgccatttctgaagttcccagggacgtttcctggatcacagtgtcccttaaatgcctccttgaac

SEQ ID NO: 6851 - DNA, 201 bp, Homo sapiens
ctccagatttctattttatctctttcgtcttatagtcataagtctcctttaacttccaaaatctaattatttgagatgttctctagacatatttattattyactatttcccccttagactttaattctcttactgtttcacaaatgccaccataacccatttagtgtttctcaattttcggttaattttccatctactttg

SEQ ID NO: 6852 - DNA, 201 bp, Homo sapiens
cttgagcatccacagattttggtgtctgtaggagaccctcaaaccaatcctccacaatactgagggacaactgtatatataatatattgcctttccaaatkaaagtgtttaaaaaatatagactgagagggatttggggccactgtttatccatgccataaattttgcacaagcctatgtgacatcaatgtttgacttacc

SEQ ID NO: 6853 - DNA, 201 bp, Homo sapiens
ctgtatatataatatattgcctttccaaatgaaagtgtttaaaaaatatagactgagagggatttggggccactgtttatccatgccataaattttgcacragcctatgtgacatcaatgtttgacttaccaacaagccattcattatatcttatttccactttgatggttctcttgacatttgactttctctggtttgag

SEQ ID NO: 6854 - DNA, 201 bp, Homo sapiens
tctcaaactccccacctctgttcctctaactgcagagtcagaggaagcatgacattttttctgcccttttgtgctttacctaaaaactttgcattttcttycagaacctacccacatttaataatttttagaaatagttttagtcacttaccataagaggaaaaaatggacattttcccacaaaacaatcaggtaaaactg

SEQ ID NO: 6855 - DNA, 201 bp, Homo sapiens
aagtcatcaatacaagcgggatatggtctccccaaaccaagagaacaggagcacacagcacaagtgggcgtggaccaagggcatgtgaactgtggatgggwtgtagacttgagcaagttcgtttctagcttctaaattccaccccagcaagtaccccagacctggctttaggaaccacgatatggcagcatgaagtgggga

SEQ ID NO: 6856 - DNA, 201 bp, Homo sapiens
agaagcctggagaagcctggggaagccagaaggccctgaacccctgacaaaaagcctaaggatcctcacccagcaatgctgaccacgaccattaaaacatraagcccacccccaaagaggaaaatccttgccctttaatgaagctgccaaaaacctccaaatttaacagtttgcactgtgtctttctgcagacacagaaaa

SEQ ID NO: 6857 - DNA, 201 bp, Homo sapiens
tacaaattttcaaacataagaaaaccatgtaaaaaaaaaaaatcaatgggggagggggtgtttaaatgcatttgagaccagccatatgacagcgatttggmagcccttataacccttagttttaataacataagaattccctatgaaattctaaataaggctgggcatggtggttcatgcttgtaattccagcgcttaagg

SEQ ID NO: 6858 - DNA, 201 bp, Homo sapiens
attttcaaacataagaaaaccatgtaaaaaaaaaaaatcaatgggggagggggtgtttaaatgcatttgagaccagccatatgacagcgatttggaagccyttataacccttagttttaataacataagaattccctatgaaattctaaataaggctgggcatggtggttcatgcttgtaattccagcgcttaaggaggct

SEQ ID NO: 6859 - DNA, 201 bp, Homo sapiens
ttccttcctaacttcagctcattgtggcatcttttcagcccctgtatccacgatgctaactgaaaaatcctattctatttctaattcaaaagcccacattyaagctcatcctttcaaacccagccacagacgtcaaatttcagactgaggactggatatactttcatcggtccaacactcttggtcaaagcagcaatccac

SEQ ID NO: 6860 - DNA, 201 bp, Homo sapiens
ttcaaacccagccacagacgtcaaatttcagactgaggactggatatactttcatcggtccaacactcttggtcaaagcagcaatccacagcaagaagggyggggcaaccacaaagattggcatctctgctacactgtatcacacacactcctacccctgactccgagtgacatcaaccacagacagctacattgagctac

SEQ ID NO: 6861 - DNA, 201 bp, Homo sapiens
acagcaagaagggcggggcaaccacaaagattggcatctctgctacactgtatcacacacactcctacccctgactccgagtgacatcaaccacagacagytacattgagctacaggaaggattaaaccacttccaagacccaggaggtcccctaatcattttgccccatgtcttggctcacacccctggaaatactgggg

SEQ ID NO: 6862 - DNA, 201 bp, Homo sapiens
cagacagctacattgagctacaggaaggattaaaccacttccaagacccaggaggtcccctaatcattttgccccatgtcttggctcacacccctggaaayactgggggaaagtcacctaccttgtttggggacacctttttagaggataactcttggtcctcaagcttagaagctgttatgaggaagatgttggggcttt

SEQ ID NO: 6863 - DNA, 201 bp, Homo sapiens
caatagtttctctcccccactgggtgattattcatgcactgcttctccacattagggcaaagtgagctcacatctctcttacctgctctctgggcctcccrgcctggactcgcacaagggcaccatcccactacccctcatacttccaatcagtgcagaccagagccaccccaaccccactatcatcactcacatgagcag

SEQ ID NO: 6864 - DNA, 201 bp, Homo sapiens
caccccatccaacaatcagcacacagctcaaacaagatggggtcagatctccacttcatacacactggatttccacacatgcatgggaaagaaaagaaggrctattgccccacagattcactgcatctagtattgctaaggggctgcagcctcttgccaaccacagacccatctcagtggacaatgcaaagggtagcatta

SEQ ID NO: 6865 - DNA, 201 bp, Homo sapiens
gacagtgccttccccaatccccttatttggatatcccatggctatgcaacagctgtgccccaactagtaccccatggtggcttccaacagcaaaactaatytggttgtgtcatgctgagatatccatcttctaatacaaatgtaacagattagcatacaaagaatggactgctgttgaccacagggagtagtaagactaac

SEQ ID NO: 6866 - DNA, 201 bp, Homo sapiens
gatataccagctgcatggtatttgtgctgaaaacttggcaatagctatctttggtgtatagctcagaggtatccaccttcaggaagtcttccctgaaggcmcaggaatgtaaatatgacgccatggtttcctctaccataacatcctggattttttttttttttttgtatagaatttgtcacagtggaacgtaattgtcac

SEQ ID NO: 6867 - DNA, 201 bp, Homo sapiens
aatatgacgccatggtttcctctaccataacatcctggattttttttttttttttgtatagaatttgtcacagtggaacgtaattgtcactgggaggtgastttattcagggcagggatcttgttttattctccttgtacccccagtctgtggcacaggtcttggtacatgtggttcatgacattgcaccaactgtggata

SEQ ID NO: 6868 - DNA, 201 bp, Homo sapiens
ttttttttttgtatagaatttgtcacagtggaacgtaattgtcactgggaggtgagtttattcagggcagggatcttgttttattctccttgtacccccartctgtggcacaggtcttggtacatgtggttcatgacattgcaccaactgtggataacacaaggctcctgtctccttgattagtttgtgatccacagatct

SEQ ID NO: 6869 - DNA, 201 bp, Homo sapiens
ttatttataactgctgatgcccttgcagctcttgtctgacccatgtccagtttatgtctgcctgatcatcgctctggcactggaagcccaaccttgtagtmtccccgagggaaaacccagtctgcggtagttcctaggtcttcagatgaaaggtgcaaattcaatacaccaccatatagaaaataagctcaaagatttatt

SEQ ID NO: 6870 - DNA, 201 bp, Homo sapiens
gaaagcatggagcctggtctcccaggttggggagatgcctctgagttcttatctctggccaggggcttcagccatttgggtgtgatgcttctcttgtaacyccaaggtaacctatgctgtgttgctcagttctacatgccaagaaatagctcctcttttcagcaagtaaaattatctcactgcttttcagtttctttttta

SEQ ID NO: 6871 - DNA, 201 bp, Homo sapiens
ggagaaaatggtgtctgcactaaacatatacagacttttttttcttgtcattgtttcctaaaccatacggtgtaacaactatttagatcgcatttatattscattaggtattataagtaaactagagatgatttaaagtataagatgtgcatagattatattcaaatgctacaccattttatatcaggaacttgagcatcc

SEQ ID NO: 6872 - DNA, 201 bp, Homo sapiens
aattaggcattcttgttcttctcagtatcttttgttctggcccccagatatgagaagggtttgacctttatggtctttcttctgcttcttcaaaccccacratcatttttttgaaaatcacaaaatgcatgagatagatgggacttatgggatcccctgttcacctttacttcaaagccagaaatgccattctttaagtcc

SEQ ID NO: 6873 - DNA, 201 bp, Homo sapiens
cagtcttcaggttctcactcaagtgttaccttttagggaccaagcagaatcgaggtactcaataaagagttgctggttgctggatgaataaatggctgagkcttctgtgaaccctggcccattctattctttgtctaaatcttgccacacgtgttttctttatgaatcattctgtcctttattcttaaagatactagttat

SEQ ID NO: 6874 - DNA, 201 bp, Homo sapiens
tatgtctcgtatttctccttgaccattctcttatctacccaacacacctaagaatatatatgtatgtatatatatacacatacataagaatatataccacrtacataacacgtgtgtatatgtatgtctacatatgtgtatatatacacgtgtgatataaatttatatatgtgaattactagaaacgtttcgattttagga

SEQ ID NO: 6875 - DNA, 201 bp, Homo sapiens
tttctccttgaccattctcttatctacccaacacacctaagaatatatatgtatgtatatatatacacatacataagaatatataccacatacataacacrtgtgtatatgtatgtctacatatgtgtatatatacacgtgtgatataaatttatatatgtgaattactagaaacgtttcgattttaggattagatatttt

SEQ ID NO: 6876 - DNA, 201 bp, Homo sapiens
cagaactccatttctcaatagtcaactaactaacctctcaaagacatggactacctacatctgaatcactagaagcactaataaaaatgtaccttcttggscgggtgcggtggctcaggcctgtagtcccagcaatttgggaggccaaggcaggtggatcacctgatgtcgggaatttgagtccagcctgaccaacatgga

SEQ ID NO: 6877 - DNA, 201 bp, Homo sapiens
gaaaaagaaagaaaacaacccattttgtgctctggttaataaatggagggagagaaagccagctaggcatcaaccactgtctccaaccattatcatctgcrtttgtgcgcatggtctgtccaaaacaacagtatatgttgattaaaagaccacaatggaaacaaacaaaaatcccaaacccatggctaaactgtaaagtca

SEQ ID NO: 6878 - DNA, 201 bp, Homo sapiens
acatcttcagctatggagtctgtgttacactccacaatgccaacagacagagaggaatgctaactgtaacttgaatgatttgagttctcattgcttttctsccatcttttctttctctttcatcaatgttatacaattagttttttcataaagctcctactagcaagctactcctccccacactcagaaaacctcctacct

SEQ ID NO: 6879 - DNA, 201 bp, Homo sapiens
atgactctgaattcagaaaatccacagctctcattcaggtattcttatgtctcctctccagcgtcatccctggtctctatcttctctcaattagtctattygttcatgccttcatttcttcccgattccaacttagacctctttatccataacattaacagatttcttgtcatacccacaattttcctgcccccactttgt

SEQ ID NO: 6880 - DNA, 201 bp, Homo sapiens
tctctttatcacagcaacagatttcctgccacgcccacaattttcctgctcccatcttgtcctcctgtcacacccacctggcaccaccttccacccagctytgagtcaatccaccacttcctcacctgtcaaccaccaagcctcattcacaaattacagcaaatatgtgaaagaaccagaaacagttttctggctcctgga

SEQ ID NO: 6881 - DNA, 201 bp, Homo sapiens
agcgtaaatgttgatcaaactcgctctctaaccccaaacagctcagctcctaaccggtgccatgctcagtgaaacaggggaggaagtcgccagcccacttytcctgaccatgatgctgttctctctttgtctacgtagactagtcacttcatctcttggcattgattttgtattttgggcttctgatcagacacatctgtg

SEQ ID NO: 6882 - DNA, 201 bp, Homo sapiens
attacttttgccccaacctaatagctgcacaaaactttctacttttaaaggggtcatgtgattgggtgaggctcgccccaataatctccttgttgagtaaytcaaagtcaactgagaagtcctttctgccatgtggcctaataaaaccaaggagtgacagctcatcatgtcacatactcccaggggagaggcttagaaaag

SEQ ID NO: 6883 - DNA, 201 bp, Homo sapiens
cattgatcaaaaatcatttgaatgtgcctatgtggatctattttcattatttcatcattaaataagatataagcttatttaatatatatattttatgcacygtagtctaacttagaataagacagaaaaacttaaaaattgtcaaataaagcatctcatgatatgcgtatgtgcatataatatatataaatcgatatatat

SEQ ID NO: 6884 - DNA, 201 bp, Homo sapiens
ttatttaatatatatattttatgcaccgtagtctaacttagaataagacagaaaaacttaaaaattgtcaaataaagcatctcatgatatgcgtatgtgcrtataatatatataaatcgatatatatattataggtttttcatagataccctttatcagattgaggaatttaccatctttatcataactggatattgaatt

SEQ ID NO: 6885 - DNA, 201 bp, Homo sapiens
aaaattgtcaaataaagcatctcatgatatgcgtatgtgcatataatatatataaatcgatatatatattataggtttttcatagataccctttatcagaytgaggaatttaccatctttatcataactggatattgaattttgtcaaatgctttttccgcatctattgaaatgaccatatttccccctttactctgttaa

SEQ ID NO: 6886 - DNA, 201 bp, Homo sapiens
aagcatgggaaaaacccgcccctatgattcaattacctcccaccaggtccttcccacaacatgtggtaattcaagatgagatatgggtggggacaatgccmaaccatatcagggagcttccctagcacaacagaaagaatgaaagccagccctaggttgagctgtccagtagatctttctagcacaatggcaatatatctg

SEQ ID NO: 6887 - DNA, 201 bp, Homo sapiens
tgccacttgtaactatgttggtggcacttaggcccttccaatataaatgttctggggcctccactagatgaggagcaaaatatccaaggcctcttcccaartggatatatagacaataaataaatcatacaagtaaatatatatttatcaattttgttgaattctatgaaggaaaaaaatacagctctacaaagaaaataa

SEQ ID NO: 6888 - DNA, 201 bp, Homo sapiens
ctgctgaggcttgagaaccactgcctagaaattaggtgctattatcatcactttgcaataaacacctgaggcccagaaaagtaaaatgatgtgcaagtcawacagaaagtggacgagacaagctttgaacccagacaagtctaactccagagttgaggcccttaatcacagttctacactgctcattatctgaggaataaa

SEQ ID NO: 6889 - DNA, 201 bp, Homo sapiens
aacagaagagaagaaggtggggtttctgtgctagcaccagaagacacaaactggaggcagcaatcccactgcagttgatgtgacagaagcccctggagaasagttcaccaaaacgtgaaaggggagtccagcagctgcgtgctaagggggtgtggctctcagctcaattctagcctgaccttcttatagatggctgagaga

SEQ ID NO: 6890 - DNA, 201 bp, Homo sapiens
gtgctagcaccagaagacacaaactggaggcagcaatcccactgcagttgatgtgacagaagcccctggagaagagttcaccaaaacgtgaaaggggagtmcagcagctgcgtgctaagggggtgtggctctcagctcaattctagcctgaccttcttatagatggctgagagaaccctagaggctatttcacgctgtcaa

SEQ ID NO: 6891 - DNA, 201 bp, Homo sapiens
atggccataatgtagatatgttgaccaaagggtaccaactctccattataaggtgaatgaataagttctgaggatggtgactacagttagtaatatcataytatacacttgaaatttgtgaagcgattagatcttaattatactcacaccacatacacagacacccaaaatggtaaccaacagtcgtgaaagatgtgttaa

SEQ ID NO: 6892 - DNA, 201 bp, Homo sapiens
cctacaaacagaaataatgtgagaggtcacaagtccactcatttgcactggacttccaaagagttttgtcatgcagtgtctcagttaatcccccaatagcycagggaggtggacatgggcaccattttacatacagagaaaacatcccaaaacattgcagtgatgacacatatttattaagcataaaccttaggccaggta

SEQ ID NO: 6893 - DNA, 201 bp, Homo sapiens
caggaacaactgcacttccagtcccctctctttctcaatcacagaaacgatcaagttctctcctattccacctgcctgttctcaagtggaccctcccgtgragatggctctatttcaaatcaaaaccccatcgcaccaccacccaagggcttccttttgcctttccctaatccactttttgcctagtgcttattatcagct

SEQ ID NO: 6894 - DNA, 201 bp, Homo sapiens
tcttcctttaaagacctgtgggttggatgtgctatcatcacttcacagttaaggagactgagccccgtgggccagttttgcagagctggtgtttgaacttkggcagctacaaagcctgtgctccttcccatgctcaccctaagtccttttacatatcatgcactgaacttccaacaggaacggtcaagtccccaagaccta

SEQ ID NO: 6895 - DNA, 201 bp, Homo sapiens
tgaatcttctgacatgactgttcaagaaaaacaaaccaaagaaaagaaaacccaaatggccaataaatgtgaaaatatgttcaacttcttaataagataawtgcaaattgaagaccatggttagattccgttttacatctatcatataagcaaaaatgaacaggactaatacaaagatttaaagagatataagaaggttgc

SEQ ID NO: 6896 - DNA, 201 bp, Homo sapiens
agttaacagcatttctgaatgcagagaaaaccaggcaacaaatacttaatgagcatttcctaaatgcagtgtcatactaataacagagaagataaatacaygtaccagaatttctactctgaagaaattaataatataattgattcacccatacatatatccaagcaaccaaccattcatccctccacccatttacccttt

SEQ ID NO: 6897 - DNA, 201 bp, Homo sapiens
gggcctccactagatgaggagcaaaatatccaaggcctcttcccaaatggatatatagacaataaataaatcatacaagtaaatatatatttatcaatttygttgaattctatgaaggaaaaaaatacagctctacaaagaaaataacaagggtgcaggggacagggcactaattatgattagggagtaacagaaagcctc

SEQ ID NO: 6898 - DNA, 201 bp, Homo sapiens
ggtgggaacaacccaaatgtccattgacagaagaacaggtaaacaaaatgtaaatacatacaatgaaatattagccagcgttcaaaaagaaaggacattckgatacatgctacaccagcacactccctagctcacgatattttaagtggatgaataaatgaatgagcaaaaaaagagcaccctacctctaactggatcccc

SEQ ID NO: 6899 - DNA, 201 bp, Homo sapiens
aaatgtaaatacatacaatgaaatattagccagcgttcaaaaagaaaggacattcggatacatgctacaccagcacactccctagctcacgatattttaaktggatgaataaatgaatgagcaaaaaaagagcaccctacctctaactggatcccccagctgtgaactctctcacattttttctctagcaaattccctctt

SEQ ID NO: 6900 - DNA, 201 bp, Homo sapiens
agtgacctgatccaatttaccctggctgcaaaggaaaggatgaagtaggggaggagtagaggtagaagcagggagaccagtggaggctgcttcatctacarctccagatggtgatgatggtggtagcactggagatgaggaaggatctgagatatacatttgaaggagaataattatacattgcactagactctggtgggg

SEQ ID NO: 6901 - DNA, 201 bp, Homo sapiens
cacagccaagccctttcctgtattgtctgtggctgcctttgtgctatagcagcagaatgtgtggcctcttggtttgccaagcctaaaatattgactatctrggcttttaaataaaacacttgccaattgctgctttacaatactttctggtagcttatcaaaataatcttgggatcttttaaatatgcagcaccttaagcc

SEQ ID NO: 6902 - DNA, 201 bp, Homo sapiens
cagttcactgctgtaaataagattcactggagacctgaaacaggagggcccaaaataattttggttctgattccgacaacaaagaaagagttgactctccrccttctctaactgatcatagtgattaatctctcaccagccagtttattacatagtcctgctcaatctaaagctggcatgcaagacaccattttcaaaaat

SEQ ID NO: 6903 - DNA, 201 bp, Homo sapiens
ggaggatcgcttgagcccaggaatccaaggctgcagtgagccatgactgtgtcactgcactccagcctgggcaacagagcaatactcttggagcaagggasggaggggggagggagggaggactgaccggagtttgagtcctgggtttatcatttgctaattgagtgattttaggaagttatttaagccttgaagtctcca

SEQ ID NO: 6904 - DNA, 201 bp, Homo sapiens
cgcacgctaggtgctctgtatacagcgtaccacccactccaaagctgagagtggaaggcagagctcaagcaatcattaaccacagcacacgttcaggcagytttgccactaaattttaaccagtacatatataaaagtgtcccactctcctcctcatatcccatatgcacacgtgcacacccatgtgtgcatgtactcaca

SEQ ID NO: 6905 - DNA, 201 bp, Homo sapiens
cactaaattttaaccagtacatatataaaagtgtcccactctcctcctcatatcccatatgcacacgtgcacacccatgtgtgcatgtactcacatgtgcrcacacacacatacacacacacttcaattcggtcggcttttccttggggagtagactttggtgagtaaatacctctcttagctcaatctcagctccaagca

SEQ ID NO: 6906 - DNA, 201 bp, Homo sapiens
tgctggctgtgccatatattcactggatgattttggacacattcttcacctttctgagccttttcttccatgcaaaatgaggcagttggatgttatacttstaaacatgacaatgctacagcataacgaaagcaccaactgataaagaaaaagcaatgggttgtcagttcccaatgcaagttagagttgtgtgtgatttgg

SEQ ID NO: 6907 - DNA, 201 bp, Homo sapiens
ggaaaattcctccagaaggatttttatcacatttccctttgaagaggagcaaggaatcaacaattggcatcccttggaagatgaaagcaagttcctctgtmttcggaacggatgttcctctggaatcagagtaatctcttaatggaccctgatgacataacgtggcacgggcttctcgtctgaaatggcaggttactcagc

SEQ ID NO: 6908 - DNA, 201 bp, Homo sapiens
aaattcctccagaaggatttttatcacatttccctttgaagaggagcaaggaatcaacaattggcatcccttggaagatgaaagcaagttcctctgtattyggaacggatgttcctctggaatcagagtaatctcttaatggaccctgatgacataacgtggcacgggcttctcgtctgaaatggcaggttactcagcaag

SEQ ID NO: 6909 - DNA, 201 bp, Homo sapiens
ttctaagacattaaaaagtagtgcccacatttccgactcccacaacgaaacctgtgaagaaatcctgacgttgatttcaggagcatgtgggatcttgcctmtcttacaatgcgggtccctcactctggttatgccaagcacagcttaaactgacccctctggttgtgagaaagtaagccaagaggagactaagattctaac

SEQ ID NO: 6910 - DNA, 201 bp, Homo sapiens
atgttcattttatatggtcccgcatttagaatagaatgaaattttaatttattattttggtttttacctgcctttatcattaggaagtgatgtttattagwcagtgaattaagaggaaaatatcaaggagacatctgcactcccatatttgttgcagcactactcacaatagccaagatttggaatcaacctaaatgtcaa

SEQ ID NO: 6911 - DNA, 201 bp, Homo sapiens
aatgtttattttgtcagtattttatctttcaagatctagatatcaccttttccttcttccataaatactacaacctcacataggtattttctgtcctccarttgtgtagagtgctagtaattcaataacttagcatcaaaatcaccctaatgagcttttcagtgtgcatatacccgagtttccttccagcaccactgaatc

SEQ ID NO: 6912 - DNA, 201 bp, Homo sapiens
atgtctggggagtgtgtctctcctgaacactgaaggaaagagatccataggggtgtgtgtgtgtgtgcgtgtgtgtgtgtgtgtgtgtgtgtgacacagaragaggtcttacaaacacacatttttaaatttttaatacataaaaacagtggacaaattataccactcaattttctacaatttgaacacatccatacaacc

SEQ ID NO: 6913 - DNA, 201 bp, Homo sapiens
ctacagcacctagcacatagactaatcactcatcaaaaattctcaatgatggagagatgaataggggtggggatttcaaaccaggactcacagttcttaamaaagaaaacagaataaaaataaaatgttcatttttctggtctgattcctctaacaccaggtgtttttttaaatcataaaattatctctcacatattaagt

SEQ ID NO: 6914 - DNA, 201 bp, Homo sapiens
ctgccctacataccctctgctgaaactatcttatggctggtgccccatcgtgaacacaacatgggaacctgccaacattccacaagtgcttccatgcatgytcttgtatctttagaaggttctcagaagccctccaataaaatctcccatctcatcgttcttaactatgattcatgctaatcaatgagccagtcaccatgg

SEQ ID NO: 6915 - DNA, 201 bp, Homo sapiens
tttcctactggaaaccataaggccttttattcttgtcgaaattcatcagtactttgtaaaatggaataaacttttaagcattaactagcagaaaaatctgscatattgctgctgagtgagtgtgtagcaactgacaattatggacagtagaactcaaactagctcttgatgcatgggaagcgaatacgaggcaatcagttt

SEQ ID NO: 6916 - DNA, 201 bp, Homo sapiens
tatttcaggtaatggatcatgcagtcacacgtccgcattgcctcacctgctctattttactgtgtctctcctgggaagaaatcttggaaaagggtaagaargttgtttactgtcctggttccctgtgtgtgctgcctctcactattacccatgaaagggaatcaaaagggggctgggaaagtttcacggagagggttgaga

SEQ ID NO: 6917 - DNA, 201 bp, Homo sapiens
tgcattataaattagatgcccatgaattttattgaaaagacaaaagtaaaacgaaaatttatttttataaaagctctgtgtttctctgaatttacaaagtkttgaggctagaatatatggggcactggtaagtatgtaggttacaagcatgaatcaaataaaataatcatttgaaaaaattgcatctagcaacatgcatca

SEQ ID NO: 6918 - DNA, 201 bp, Homo sapiens
acttatattctgggccaatgtacccttaaaagttgatttctctcctgctttctctcagacaactgctgtttatatttgtaagcttgtgcaattccacaaaytaacaaacatgagtataacattttttattactcacattaactgctatttttcaatccaaaggaaaatgaaggagaaatttcagagcgatggtcacaaaac

SEQ ID NO: 6919 - DNA, 201 bp, Homo sapiens
catctgaatactgccatttcaacagacagtatcactggagcttttaaatctttaagagaagtcaaatatccagaatttcatgtaacatctcctgatttgtmaatgttggagactaagtcaaagcaccatgtgggctgaataaaactcattcatcctgtggcctgtcactttgcaaattccattataaattctattaagtac

SEQ ID NO: 6920 - DNA, 201 bp, Homo sapiens
attctattaagtacttttcactttttaaacctaagacaaaaaggggaagttttcatccagtgaaatgacatgatcacatttgtgttgaatttatttctaakgcaaccacatatacacagtgacacacacatttacacaaacctctgagtgtatgaataaactacctttgaaaccataagttcttaagggatagctttttac

SEQ ID NO: 6921 - DNA, 201 bp, Homo sapiens
tgccaatctggtctttcctgcagtaaatgaaaactagctctgttcctgcatagaacagaagagtccaggcagctaagtcacatgaccggagacaaaccagrcagaaagaagtcacgtgggaccacaatgaacaagaggcagagacaggccggatgatggccaaatgcacaatgaaactggaactgaggttcctaaagatgc

SEQ ID NO: 6922 - DNA, 201 bp, Homo sapiens
atcagtaattacagatgtatgttaaactaagtttttaatgctaagattatcttcccaggtgtttacattagaaagaattctagatttggagataagtggasacaagttcacccctgaatatttagtaaggtgctaaggtacctgtgggattgcctgagttgtgactcttaagacattgcaagtaaaaagttacaactgaca

SEQ ID NO: 6923 - DNA, 201 bp, Homo sapiens
tttctgacctgcagaactgtaggataataaatttgtattattttaagccagtaagtttgcggtaatttatttcagcaataggcaactaatacaccatgtawcaactgcaaacaattgttgcagttctagaaagctggcccaatttaccagttcttgggtgggaggcggtagaggagcagaaaagataacttttgagtactg

SEQ ID NO: 6924 - DNA, 201 bp, Homo sapiens
tccccgtctagattgataagctctgtgagagcagagtgcaagcctgtatagcctagcccagctaataaatgggtaggtggtgagttgtgagtgaatgtgtrggggagtctgacttgtcaatattctgctttattatcagaacaaatgaaaactccagtttttggtcattttcatatggctggataccttccccttctcaac

SEQ ID NO: 6925 - DNA, 201 bp, Homo sapiens
tatcaacaagtaatgggttattaataggaacatgacatttatatttcagaaaaaaaaatttagcatctacaggaggatgagtgaatagaaaagcaggaggrcattagaaggttgttataatcatttaaataagaaataactggacaggtgtggtggctcatgcctgtaatcccagcactttgggaggccaaggtgggcaga

SEQ ID NO: 6926 - DNA, 201 bp, Homo sapiens
cctgggggaaggagaagccaggccacgtagtcatgtccccatggagaatgcagctgctcctctgtgctctgccctcggttgctactgccctgcgaggcaamctcgaggctgggaatctcctcctttctctgtctgcagcagctgcagtgaaacaaagggcacagcccccttcaggccaagagaggtgagaagctgctgggg

SEQ ID NO: 6927 - DNA, 201 bp, Homo sapiens
actaggtgtcaggcaccatcttagcacaaataagatacacaaggcctgtgcctttgggagcttaatttctagtagggaatggaggagaggggcatatggayaataacaaccaaaaaaaatggtaatgtcacagtatgataaaggctgtgaaagaaataaagtgcaagctagagaataataggagagaactgactgggtagt

SEQ ID NO: 6928 - DNA, 201 bp, Homo sapiens
ctgattaccttatctttaagccaccaaaaggcacctttttatgattaggcttcctttgcaagcaatgtgactctgccaggccctgggcttttgcagaaagmgaaggtggaagggagatggttattagccactgtctctgcaaacgacaagccatctgcaccccgttacctaagcatagacctctgtgggtgccaaacttca

SEQ ID NO: 6929 - DNA, 201 bp, Homo sapiens
ttgcagatccttgtattgcagccagatgacaatgcctgggaccctcttaccatccaaacacccacctcaaggaggcccagccctgtcatatgactgtcccyattatacttgaacagcctttgaagggctttcaaagtgtttcccagccacatctccaccctccaagctcaggtagcccattccttcattcccgtctcgaat

SEQ ID NO: 6930 - DNA, 201 bp, Homo sapiens
ccctattatacttgaacagcctttgaagggctttcaaagtgtttcccagccacatctccaccctccaagctcaggtagcccattccttcattcccgtctcraatgttctgccccagtgaatatcttcgcctccctgttagactctgagatcttgtactgcagaatccactgttgctcatacaattctgagttgtacctgag

SEQ ID NO: 6931 - DNA, 201 bp, Homo sapiens
ctgctccttacatatgcccccagaaagttgttccaagtgaaggcagcttaattaaaaaccacattcaatcaaactgtcactttgtttatgaaaaagtgtckagtggctggaaatggcaagaacaagcactgaagattaatgctctaaattttttctgattaaaagtatgattgaggcattaagaaagctagctccatgaac

SEQ ID NO: 6932 - DNA, 201 bp, Homo sapiens
tctgattaaaagtatgattgaggcattaagaaagctagctccatgaacccagggcaggccttaagcccaacattttgccatcttcaaatacaactggggayagttgtaaaaacaaatagaacttctctctgcctagaggtttcctttcatgaagataaagtttctagctggaactggctgtttttgcagggaagcacacat

SEQ ID NO: 6933 - DNA, 201 bp, Homo sapiens
ccaaatctgatgctcactggaccagggtcaggctatggaactgattaaaataagtaggaacctccaaggccctatgtccctactctccattttcagattgrtcagctgagacctatgtactggaaaaataagctcaagggctccaagtagaaatagttgtagtcctggagtcagccttgggtttagctccacttccaaaat

SEQ ID NO: 6934 - DNA, 201 bp, Homo sapiens
aaatctgatgctcactggaccagggtcaggctatggaactgattaaaataagtaggaacctccaaggccctatgtccctactctccattttcagattgatmagctgagacctatgtactggaaaaataagctcaagggctccaagtagaaatagttgtagtcctggagtcagccttgggtttagctccacttccaaaatgt

SEQ ID NO: 6935 - DNA, 201 bp, Homo sapiens
ctgcctacgatggaattatgagagagctttggaaaatggctgttccaaaagtgatagtcttaacacaaagatcaggaagaatatttgatttggattaccasccacagcaggcagaattctaagatgttcccaaagtgatagtcttaatccacaggaagaatatttggtttggattaccagccacagtaggcaaaattctaa

SEQ ID NO: 6936 - DNA, 201 bp, Homo sapiens
cacataagatgtttgtggcaacaactaacagctgtctggccagacttaactgcaagtgagcaaatcccgccttcttcactagctcagaagctgctgtaaarttacagaggagccccaggagaagctgcaccataccagggggtggagcagctccaaaaaaaaaaaaaaaaaaaaaggaaacagagaaaaaaatatctggct

SEQ ID NO: 6937 - DNA, 201 bp, Homo sapiens
tttcttaacagtacacaggaccatgtaccaggaccaggcaagcaaagcgtaggcatatgctacccctaggctaatccacagacctcggggaagagcaagcsgcagtgctaggctgccaagctctaaaaatacccagctcattcccaccatgacactcatggtaagctcttagtgggcaggaatcctgccaaacaaatgcct

SEQ ID NO: 6938 - DNA, 201 bp, Homo sapiens
ggaccatgtaccaggaccaggcaagcaaagcgtaggcatatgctacccctaggctaatccacagacctcggggaagagcaagcggcagtgctaggctgccragctctaaaaatacccagctcattcccaccatgacactcatggtaagctcttagtgggcaggaatcctgccaaacaaatgcctacctagctggatgatcc

SEQ ID NO: 6939 - DNA, 201 bp, Homo sapiens
gtgctcggtaaaatgttagttgtactttgtcaactactgtagtaatcaatagggacaaaacggtgagtgaaaactaatacagttcctgcccctacgaagcygatgatccccgaggagaaatatacattaatcacataccctggaggttaaagatatattcagtactccttgattttggtgatggtatcacagatgtatgca

SEQ ID NO: 6940 - DNA, 201 bp, Homo sapiens
acactgttagacatataaaacccttgataataataatcaaataatcagataataataacagaggtctaaacgggaaactataagatttcaacagcaagctrtcttgataaggttccatcatctctcaaaaatttataactaacaacaagacaattacttcccaaatccccttgaaattaattccatcctcctccaggagct

SEQ ID NO: 6941 - DNA, 201 bp, Homo sapiens
aactaacaacaagacaattacttcccaaatccccttgaaattaattccatcctcctccaggagctatgatgggtgggaaataaaaccgatgagggggaggytcaagtagtagtgatcatatcagagcatatcaaaaccttggtgaatttttactctttagtttgacatggaaattttccctaatcccaagacatagatgat

SEQ ID NO: 6942 - DNA, 201 bp, Homo sapiens
ttctttgccgagattaaagcagtgccactctgggtctggagccgaactggtagctggggtctagaagaattcagagttcatcccgagtcttctctagagayggaagccggagaagcctggagaagcctggggaagccagaaggccctgaacccctgacaaaaagcctaaggatcctcacccagcaatgctgaccacgacca

SEQ ID NO: 6943 - DNA, 201 bp, Homo sapiens
cctgtgtccatgccatttcagcactagataacaagatatatccatgtaggaagatggatgaggaaagcagggtggatctgtctcccccaaaggaaaccacraggcataaacagcagcagtccccagaggacaatgtacacacaacctctttcctccaactctggtgttgaaactgccctgagctgactttaaatccactgc

SEQ ID NO: 6944 - DNA, 201 bp, Homo sapiens
gagtcctgcagcctttgaataaatacctgccaggccaagctagcaaatagcacagtttcatgtctggaatttgcagaccagggctgaaggaagttagacaygcttctgtgaagaaaactgatattctgctggggtttgcaagatccctaaaggtcccgtcctccccctgggaatcccagcagtttagaagattcctgaaag

SEQ ID NO: 6945 - DNA, 201 bp, Homo sapiens
gccaagctagcaaatagcacagtttcatgtctggaatttgcagaccagggctgaaggaagttagacacgcttctgtgaagaaaactgatattctgctgggrtttgcaagatccctaaaggtcccgtcctccccctgggaatcccagcagtttagaagattcctgaaagggaaaggagcagctcacctgagacaagcaaggg

SEQ ID NO: 6946 - DNA, 201 bp, Homo sapiens
cagagtctgttggtggtggggaagggagagcatcaggataaatagctaatgcatatggggcttaatacctaggtgataggttgagaggtgcagcaatccaytatggcaaatgtctacctaggtaacaaacctatgttctgtacatgtatcccagaacttaaaattaaatagaaatttttaaaaaggaaatagaaccatgga

SEQ ID NO: 6947 - DNA, 201 bp, Homo sapiens
acaggtgaattcaggacccaaaatctgtcatctggatttcgtgttcctccttcttgctgttctgctgccacacagttggctctagttgttggctccaattsttggctccaagtggaagcaagatggtagcagtgattttattccctacatcttttcaggttcacttttaatagaaaataccaagtcttttcccccaggagc

SEQ ID NO: 6948 - DNA, 201 bp, Homo sapiens
tatactccataatgagactgctgggttgattgataattctgttttaagttcttttaggaatcatcacactgctttccacaatggctgaacaaatttacatkcaactgggggagatttttaccaccaggaaatgtttgtctatggctggagacatttgttgtcacaactatggactgctacctgcatttagtgggtagagtc

SEQ ID NO: 6949 - DNA, 201 bp, Homo sapiens
tagcaaagcatacaggcaatcgtgtagagaaacctgttctccccaggaaaggagggtgagcaaatgctaaaagttttgatactttaatatagcactggccktggctaattttacttaatatgaaagatttcaaataatggaaacactgacaggcaaaaacattaaaagtttgcataaaatctcaaaaaaccctgcaaacaa

SEQ ID NO: 6950 - DNA, 201 bp, Homo sapiens
cggggaggtaggggcacggctgcaaagtgatgaacattgcagcaggttcggctattcagaatgagctattttctcccaaatcctgtaattgcctggagcaygtgatctttttgaaggtcattagaggcatgcggctgtcagatgtctcccagaaagtttcactttgattagttagttcctgatgcttatttcctaaaaggc

SEQ ID NO: 6951 - DNA, 201 bp, Homo sapiens
aggtcattagaggcatgcggctgtcagatgtctcccagaaagtttcactttgattagttagttcctgatgcttatttcctaaaaggctctttttgtccccmaccccccaaaaaaatggggagcattaaaattttaaaaaaggaattagatgaatatcctgctaaatgtaacttggcaagatgaaaggaagcagcaaagaaa

SEQ ID NO: 6952 - DNA, 201 bp, Homo sapiens
agtcctttttgtcctctcacatttgcagatgtgtaaattccaggcagatctaatgaaggagttaccttttcaatccctagattgtgtttgccaaaacttcmcttgcaatagggacactccagcaaccctggctcggggctccctgcgtacttagatgtaatactatgtcaacaacatcctgcaggctgaagcagcctcttt

SEQ ID NO: 6953 - DNA, 201 bp, Homo sapiens
gggcagttcttctcaaactttaacatgcacgtgaatcgccgagggatcttgttaagaggcagattctagctcggtcagtctggatgggacctgagattctrcattcaggctcccagaggatgtcaaagctgctggtgcatggaccacactttgaatgatgagatctgtttagctggttggtaggtacctggtggctgagct

SEQ ID NO: 6954 - DNA, 201 bp, Homo sapiens
ttctcaaactttaacatgcacgtgaatcgccgagggatcttgttaagaggcagattctagctcggtcagtctggatgggacctgagattctacattcaggytcccagaggatgtcaaagctgctggtgcatggaccacactttgaatgatgagatctgtttagctggttggtaggtacctggtggctgagctttcaaactc

SEQ ID NO: 6955 - DNA, 201 bp, Homo sapiens
gggaagagcattccaggcatagggaaccatgaggacaaagcccctagggttggaaagaacaaggaggaaaatgacagcaaacaaagccccaaaaaagcacstagtgcccaaatcatgcagggtctcttcataggccatggtgaggatgttggattttattccaaaggctacaagatgccatgaaagggttttaaatctgtc

SEQ ID NO: 6956 - DNA, 201 bp, Homo sapiens
ggaaagaacaaggaggaaaatgacagcaaacaaagccccaaaaaagcacctagtgcccaaatcatgcagggtctcttcataggccatggtgaggatgttgkattttattccaaaggctacaagatgccatgaaagggttttaaatctgtcttacaaaaccataaatttcacactgcagcaatcaagtcccacaatgtcctg

SEQ ID NO: 6957 - DNA, 201 bp, Homo sapiens
gaccttctgagtcacactctgaagtcctgacctcaccataaacaaagagccttttctgggggagttggagctgccctaagccagtgaaagccaatgctcayacgcttgccctatccaactgctttcattagctccattctttttagtctaaaagccttcctgacagcaacaggggccaagaatttctctcatgaaccccat

SEQ ID NO: 6958 - DNA, 201 bp, Homo sapiens
gctcatacgcttgccctatccaactgctttcattagctccattctttttagtctaaaagccttcctgacagcaacaggggccaagaatttctctcatgaamcccattttcttgatttcaaaatccacttgccttgggagaaacgcttgaacctgggaggtagagattgcagtgagcagagatcgtgccactgcactccagc

SEQ ID NO: 6959 - DNA, 201 bp, Homo sapiens
aagaatttctctcatgaaccccattttcttgatttcaaaatccacttgccttgggagaaacgcttgaacctgggaggtagagattgcagtgagcagagatygtgccactgcactccagcctggcaacagagattcagtcttgaaaaaaaaaaaaatccacctgccttggtacaagatgggaaagtctttgggtgtttattg

SEQ ID NO: 6960 - DNA, 201 bp, Homo sapiens
tctcatgaaccccattttcttgatttcaaaatccacttgccttgggagaaacgcttgaacctgggaggtagagattgcagtgagcagagatcgtgccactscactccagcctggcaacagagattcagtcttgaaaaaaaaaaaaatccacctgccttggtacaagatgggaaagtctttgggtgtttattggctgtatgt

SEQ ID NO: 6961 - DNA, 201 bp, Homo sapiens
acaagaaagtaagaaggagagataggtatggggacatgctaaagacaatgagactcagaaaagccaagagactcattcaaggttacatggctgggaaatgrtagaggcagacttggaacgctggtccctgggactccacggcagggttcaaatggtaaagcaagctgaatttccaggccaggttcagggaaacattgaggg

SEQ ID NO: 6962 - DNA, 201 bp, Homo sapiens
tagaggagaatccatttcttaccttttccagtttgtagagtctgcccacattccttagctcatggccacatcactctaactctgtttccatggtcacatcyccttctctgactcttccatgcccgcctcttataagtacagtcacaattatattgggcccaccagataattttggatgaggctctcatctcaagacggatc

SEQ ID NO: 6963 - DNA, 201 bp, Homo sapiens
cttttgccataaatcataacatttatacaggagtcagagtttagaaggtgaacatctttgagaggtcgtagttctgcctgccaggccaccatcttgctccsaaagattcactccatctccccaaaactaactcacgatagtgtcaaagtccaaaattttcatcaaaatctcatcagaccaggcacagtgactcatgcctgt

SEQ ID NO: 6964 - DNA, 201 bp, Homo sapiens
aatccctgtaatcctaacactatgggaggccaaggtggttggaatgcttgagcccagacattggagaccaacctggacaacgtggtgaaaccccacctctraaaaagaaaaaaaaaatacaaaaacagattagctgggtatggtggtgcatgcctgtagtccaacctactcaggaggctgaggtgggagaatcacttgaga

SEQ ID NO: 6965 - DNA, 201 bp, Homo sapiens
gcattcgtatttccactcacagtctgttgaaggatgtctagtctttttctctgatgtgtctccaaattattctagcctctgcccaacacacaattccaagrccactgccactttttaaggtatttgttacaacagagccctattcttggcaccaaaatctgtattattgagggttcaattaaaggaacagatgagcgggag

SEQ ID NO: 6966 - DNA, 201 bp, Homo sapiens
gatgaatttatctgtcagtggaaatgtcttgaaagaataagttcactccaccttcacaaggatggtaatgatgatgatgtttatagcagctaccatttatsggggaactgaccttgggcctcacgactgtgctaagcacttaacatacaatgtttcgttttatcattattatgacctgaggccctgaaaaagaatttgagc

SEQ ID NO: 6967 - DNA, 201 bp, Homo sapiens
ctccaccttcacaaggatggtaatgatgatgatgtttatagcagctaccatttatcggggaactgaccttgggcctcacgactgtgctaagcacttaacakacaatgtttcgttttatcattattatgacctgaggccctgaaaaagaatttgagctcccagtggtttgagaaatgatcccaggaaacactggtaagagga

SEQ ID NO: 6968 - DNA, 201 bp, Homo sapiens
gtatgccttcctgccccagccctggcctacatttccttaattcaactcacgtgccatttttcttcttttcaataaaaattcactgtgcacctattctgtgygagacactatagtttcctcctctgtaaaatgggggtaattgtagggttaagagcattaaatgagagagtgtgacatgcttagcacaaagtaagggctgaa

SEQ ID NO: 6969 - DNA, 201 bp, Homo sapiens
ggctctgtagataatgcttcatgaaaagtgggctgtttccatcaagcctaaatcatataagtgtgtgagatggttaacactgaagactcagaagtcagagmgggctgagtttgaaaccacattcgatcactattcaactgtgagactgtattggttcattttcacaatgtaaagaactatctgagactgggtaatttataa

SEQ ID NO: 6970 - DNA, 201 bp, Homo sapiens
ccctgacacgtggggattacaatttgagatgagatttgggtggggacgcagagccaaaccatatcagagacactgtgcactctgtttccttctatgagccycagttttcccatctgtcaagcaggggtaagaatagtgccagcatcccagacttactgtgaggattaaatgagatatttaaagtacctggcatagtttctt

SEQ ID NO: 6971 - DNA, 201 bp, Homo sapiens
actgtttttcatatcagctgcattattttacattagcaccaacagtgtacaagggttccaatgtccccacatccttgccaacacttgttatctttggtcawttttataatagccatcctaacaggtgtgagataatttcacagtcactcgttgtggttttgtgttgcatctccctgatgattaatgatgttgagaaccttt

SEQ ID NO: 6972 - DNA, 201 bp, Homo sapiens
aactcaaccctggagacctgccttgcttttccctcaggccacccaggtaccatgtgactttcttatgagatgatcaaaacagtactttgtaaaggaacacwtctattcaccaactcactcagcaaaatacttatggcaccccctgtgtatgccaggcatagtattaaagaccagggagaacaagaagagtaaatctagtcc

SEQ ID NO: 6973 - DNA, 201 bp, Homo sapiens
tcgagaccaggcttgggcaacatggtgaaacaccgtctctactaaaaatacaaaaaaaaaaaaaaaaaaaaaaaatagccaggcatgcaggcatggtggtrcacacctgtggccccagctactcaggagcctgaggtgggaggatctcttgagcctggtagggcagagcttgcagtgagctgagattgcaccgctgctctc

SEQ ID NO: 6974 - DNA, 201 bp, Homo sapiens
aggccctgtctcaaaaaaaaaaaaaaagaagaagaagaagaagtgtatacagggtccaaccatagcaaaatcatgaggaggatcaccccaaaatacaagcrtagcttctaccttaaaaacagaaatgaaaacccttatgtgacctcgtgtccctctgtagataattctccatttctctctgttcccttttatagcaaaaat

SEQ ID NO: 6975 - DNA, 201 bp, Homo sapiens
gtagataattctccatttctctctgttcccttttatagcaaaaatgatctagagagttggctataaccaccctgcctacttctgtgctattctttcctctrcgaactctggtcaggtgtggccacgacggtgctactgaaaggtatcctgcaacctctgtgttgtcaaatccacaggacaattctcattccttgtcctacc

SEQ ID NO: 6976 - DNA, 201 bp, Homo sapiens
acatttgcatgcctctgtcaaaatatcccatatacctaacaaatatatacacctactatgtatgcacaataattaacaattttaaaaatttaagaaagaamtctaggactttgcccagtggggcaacctgggtgaagcatatactgaaattctctgtactaattttgcaacttttctacaactctaaaattatcctcaaat

SEQ ID NO: 6977 - DNA, 201 bp, Homo sapiens
cttttctacaactctaaaattatcctcaaattttaaagttgattaaataaaagccctaagaatcattctttctctctcattcttttctttctgttactcckcacatcaaatccatcagcaagtacagagcagtccactttccaagcacatccccaaactggtcagtttcaccacctccaccagtacctcctcacccaagta

SEQ ID NO: 6978 - DNA, 201 bp, Homo sapiens
ccctccagtggttttccatcacagttgaaataaaacccaaactgctcttttaaaaagtttaattgtgtttaattgaacaaagaatgattcaagaattgtasagatctcgaaccagaacaggtgtgaagaggctccatttctaccacaaagaaaatttatggacagagaaggaaagtggcagacagaaaatggaagcgaggt

SEQ ID NO: 6979 - DNA, 201 bp, Homo sapiens
cccatagaatgtacaacaccaagggtgaattttaatgtatactatggactttaggcgataattttgtgtccatgtaggcctatcagttgtaacaattaatrttgttacaagttggtactattctggtgggggatgtggatcacagggatggctattcatgtgtagggcagggggtatttgggatatctctgtacattctgt

SEQ ID NO: 6980 - DNA, 201 bp, Homo sapiens
ttaatgtatactatggactttaggcgataattttgtgtccatgtaggcctatcagttgtaacaattaatattgttacaagttggtactattctggtggggkatgtggatcacagggatggctattcatgtgtagggcagggggtatttgggatatctctgtacattctgttcaattttgctgtgaacctaagactgctctt

SEQ ID NO: 6981 - DNA, 201 bp, Homo sapiens
ctgcatagctttccctccctctgccaaccagtccacaagtactggatatattggccatccatcacttgccaggcagtatctaggtgctggggggactctaygaaggggatatgctcctgcccaggtggagtttagcagggaatctggacagtgatgaagtcatttcaaatatgataaacccatcaggtatacacaaggaga

SEQ ID NO: 6982 - DNA, 201 bp, Homo sapiens
gatgaagtcatttcaaatatgataaacccatcaggtatacacaaggagaaaagctaattttcatttttataggtattttataaacatttttctaaacactstactatagttagggtgattttacatatttctgccttgtttcttgtgctagaacataagatcctggccttgagtcagaggacaagtcaaaataaattttgt

SEQ ID NO: 6983 - DNA, 201 bp, Homo sapiens
gtggcaatcaaatgtgagctgaagcccttaagagccagcgtatgactcaccacatccccctccccacctacaccacaacaaccagccatgctccatctggkcccacaagtgaggcgatatggcgcagaagtcgtagccaaccctcggtgggcacgttgcatgaacgagaaataagcctttattgttataagccattaagat

SEQ ID NO: 6984 - DNA, 201 bp, Homo sapiens
atctgtatgatggttcaagttaaatagtggacatcccttctacagtccctgccaattctcctggcagataatgtgactgcaataccatccatgattataaygtttggtataacgatttaatgtattatcttttccactgaaagagctctgtattagtctgttctcacactgataataaagacatatcggagactggtaact

SEQ ID NO: 6985 - DNA, 201 bp, Homo sapiens
tagtggacatcccttctacagtccctgccaattctcctggcagataatgtgactgcaataccatccatgattataacgtttggtataacgatttaatgtaytatcttttccactgaaagagctctgtattagtctgttctcacactgataataaagacatatcggagactggtaacttataagggaaagaggtttaatgga

SEQ ID NO: 6986 - DNA, 201 bp, Homo sapiens
gaagctacaattcaaggtgagatttaggtggggacacagccaaaccatatcaagttcaaaggctcaaaggacttcaaaagaaggggcaagaataaataatygcacagaaatccattttaagtggtaggagggaccctggacgatgaaaagggtgatctagcccagggtccaggaaaactgtcaggcttcctgcccatctgc

SEQ ID NO: 6987 - DNA, 201 bp, Homo sapiens
cacttaaaacttaaaggacttaaaggcaaagcgggactaacaatgacatgtttcacacttgtatttcttcttacagttttcagggttttcatacaccttayttcattcgatcctaataagaaccctgagaggtagatttcaactgtgctttccaaaagtaaagatggaggtgggaggaagaactcagcgatggagctagaa

SEQ ID NO: 6988 - DNA, 201 bp, Homo sapiens
tttaatattactactgtaatctttatttttggtttttttactagtggcaagattttgtttgtttatttgattgttagtttgctgttatcttctgcttatcrtaagtgaaactggttttcattattggcagtgatataccattctcttttaaactatatttatttttatttatttatttatttattttttgagacaggatct

SEQ ID NO: 6989 - DNA, 201 bp, Homo sapiens
cttcactttcctcctctctacaatgagggtggtggtcctcggatccctgcctgcaacactctgcctgcacatcagggagctcaatatacatccgtccttcrtgttccttccaagcaaggaaggcttggacaacaggaataccattgacagagagaagaaatccagaataagcatgaatcaaagaggacaggcctgggcagg

SEQ ID NO: 6990 - DNA, 201 bp, Homo sapiens
ggatgcttggagggctctcgcctgtacagaggtgtaggtcccccaagcatgcaaaaggcagatcatcatcaatgaggctggagtgactcctgacttccaasaagcagcggagtctgtcaaggagtggaccttagcccaatcccattttacagatgaggaaaggtaaggtccagaagggagagaggaaggaagaagatacac

SEQ ID NO: 6991 - DNA, 201 bp, Homo sapiens
aggtgtcagtgatttttggaaatcacaacttacattttagagtgagtttatttttgttttggcaaaagagtcactgttagggaccaatggaaacaattaasctttttcaagtcagggattgtagttttcaagtcagggattgtagtttaagagaagatcctttccatatgccgacttcagcaaaaaaaaatcacaaacaga

SEQ ID NO: 6992 - DNA, 201 bp, Homo sapiens
ggagaagtggataaacaacagaatagtatctagagtattttctgccataagcagatgttccaaatgcaggagaatacaactgactaaaaagaataatttgycaactgaaaaaccagagaggagtctggctggctctttagaatacaaacatattactacagtaagatgtgcaaaacaagctgaatatactttattaagtaa

SEQ ID NO: 6993 - DNA, 201 bp, Homo sapiens
tgagcaccatgatctcaaatactcacagaaaccatatcattaacataaatgtatgaatcaccctagatatgggataacagagtggggacagctgtagtgawtttgaaaatgcatgctgtctaaagacattaaaattcaagcatttaaaaatgctgtactggtgaaacaaaatgcatctatgagccagattcagcgtgcagt

SEQ ID NO: 6994 - DNA, 201 bp, Homo sapiens
agctttgaacaatgcacaaattactgcaactcccagatcctttatttcctcatctgaaaatagagattctttaaacaaataccgttggagctgccaggttycccaggctatcactgagttattaatccttggcagagataaaatgagaaactatatatgtccacactctaaatccctaagcctcgtgcaaacatatggtcc

SEQ ID NO: 6995 - DNA, 201 bp, Homo sapiens
actatatatgtccacactctaaatccctaagcctcgtgcaaacatatggtccagttggtggagtcatttagtgcaaaggtcaatgagatagtcttctcctrcgatcactttcatgctggccacatttagcttccgtttgccaggataaagctctcagcaagtcctacaaaggcaaaggaagcttctgattgtctcagttaa

SEQ ID NO: 6996 - DNA, 201 bp, Homo sapiens
acaccctcacagatacagggcataagaaatcataaagttgccttgaaaataagttcacaaacaaaaattaaagaacatatgtgaacatccaactaactgaytctacaaatgaaggacttcacaactgaagaaggaaagatgctagagcaatcagagaagaactttataatacatattttttaatctttgaagggacagggg

SEQ ID NO: 6997 - DNA, 201 bp, Homo sapiens
tcctaagtgctctacaatgaaaaggcattatttttatatgtctgcggaggagagaagcatttgtcatgtcaaatacacatatacagataaacagttttttwaaaaatctgccctcaaacgacttacactctggcagaagacatgaggcttgcataggaataacatagaaaacgaaacccaagtgataactggcatggatgg

SEQ ID NO: 6998 - DNA, 201 bp, Homo sapiens
aaaagaggccgtgatctttgtcagtgtgatcttgtgaaccagagctgataaatggggcaattaaatctctttcctgaagcagactcattcttgctgggaasacacaagctaaatgctctcttgggaacagatggagcctgggaagttttggggttgcagtcaaaccacactgcctttgtctccccaccggagaggactggt

SEQ ID NO: 6999 - DNA, 201 bp, Homo sapiens
tagtagctttaatatcctcacaggaaccccaaggggtgggtattatcattagctccattttgctgttggaaacaaagaatgacagatttccagaattagcsggagtctcacaaatgttacccctggccaaactcaacagcgtaaatgttgatcaaactcgctctctaaccccaaacagctcagctcctaaccggtgccatg

SEQ ID NO: 7000 - DNA, 201 bp, Homo sapiens
agtagctttaatatcctcacaggaaccccaaggggtgggtattatcattagctccattttgctgttggaaacaaagaatgacagatttccagaattagcgrgagtctcacaaatgttacccctggccaaactcaacagcgtaaatgttgatcaaactcgctctctaaccccaaacagctcagctcctaaccggtgccatgc

SEQ ID NO: 7001 - DNA, 201 bp, Homo sapiens
aaacaaagaatgacagatttccagaattagcgggagtctcacaaatgttacccctggccaaactcaacagcgtaaatgttgatcaaactcgctctctaacyccaaacagctcagctcctaaccggtgccatgctcagtgaaacaggggaggaagtcgccagcccacttctcctgaccatgatgctgttctctctttgtcta

SEQ ID NO: 7002 - DNA, 201 bp, Homo sapiens
acaaatgttacccctggccaaactcaacagcgtaaatgttgatcaaactcgctctctaaccccaaacagctcagctcctaaccggtgccatgctcagtgaracaggggaggaagtcgccagcccacttctcctgaccatgatgctgttctctctttgtctacgtagactagtcacttcatctcttggcattgattttgtat

SEQ ID NO: 7003 - DNA, 201 bp, Homo sapiens
aggcatctataatcccagctactcatgtggctgagacaggagaaccacttgaatccaggaggtggaggttgtggtgagtggagatcgcaccattgcactcyagcctgggcaacaagagcaaaactccgtctcaaaaaaaaaaaaaaaaaaaaaaaaaaaaaagtcaagacagaaaaataataactccaacacagagatact

SEQ ID NO: 7004 - DNA, 201 bp, Homo sapiens
aaaaaaaaaaaaaaaaaaaaaaaaaaaaaagtcaagacagaaaaataataactccaacacagagatactctaaaatgggctcagaaaccacaacataaagraacagaaagaagaaaaggatttttataaggagaaaagtattgtttattctttcaacacaaattctattgtggtcaattaaaaaaataatgttagttgtct

SEQ ID NO: 7005 - DNA, 201 bp, Homo sapiens
ccctacctccctcgctcagcagctcccggtcgcacaactcccagcagccggcgctggggaggtggtagggggtgcgggtggaggtgcccagttagcttctygtgggtggccaacctggggctcccattctcctgtgcaccctggagtggagctcccgctatcagccacaggggctgaggatccgcactgggggcgtcgtgg

SEQ ID NO: 7006 - DNA, 201 bp, Homo sapiens
aatgccatgtggggacgtgggtccagtgttgacagttcttccatgttttcaggaagaaactgaaaattggaattttaagtgaaataaccttagttttacayagaaaatatctaaacaaaaaatttttaaaacagcatgcagacctggcacatcgggggcgtgactttgccccattaaatgaagcataaattctctattttg

SEQ ID NO: 7007 - DNA, 201 bp, Homo sapiens
ttgccagtgttcctatttggctcatataggacactttaatttgtgattctttggttattagatcactagctttttaagcacaggctttgggctctgtttgycttcttgggaaatactgtcagaaatcagtgggttcataaccttttgaagaagtcactcttattttggttgagtgggcagtgttcttagctacccaaaaca

SEQ ID NO: 7008 - DNA, 201 bp, Homo sapiens
ttcctgggatcgctgggaccggtgcctgcgggtttctggggacacagaagatacatcttcctcctccctctcctgtgtttacacaatctgctttgaaaggytatgattcttctgtgggcgactggcctacagcatctgcctgctttgcttgatttggttcatttcacccaggctggcatcttcgagtctggggtccttttg

SEQ ID NO: 7009 - DNA, 201 bp, Homo sapiens
taagatgcccttcaagactctactcctcaaggtcatgaaatagtcttttaaatttgttaaaaataatgctgagtgtattttattttcaactcaataacgcygtcacacatattaaacaataatggcattttcccatttatttccttctgcatatatatgtgtgcattgatgtgcatgtgtatgtatgtatctgtatttata

SEQ ID NO: 7010 - DNA, 201 bp, Homo sapiens
acattccccaggtaaaaaccatgtaatagcgtccattagaatttattaaaaaatccaaactatttaccttgatgaggtcctgtgtgatctagccttgtctrttctccagtctcatccattaccacgttcccctaactcgttaaatgctattccaaatggtttccattcaacttttcaaatttgccaagctctttcttaccc

SEQ ID NO: 7011 - DNA, 201 bp, Homo sapiens
cacaggaaggggaacatcacactctggggactgttgtggggtggggggatgggggagggatagcattaggagatatagctaatgctagatgacgagttaayggatgcagcacaccagcatggcacatgtatacatatgtaactaacctgcacattgtgcacatgtaccctaaaacttaaagtataataataataaaattaa

SEQ ID NO: 7012 - DNA, 201 bp, Homo sapiens
gactggcctacagcatctgcctgctttgcttgatttggttcatttcacccaggctggcatcttcgagtctggggtccttttggctttacccgcacataatmtcttgggtggatcaaaacctcttcaactctctcttgagtttccaagcaggctcccctgtggggcttttctaagagtgtttagcattggcattgctgcaga

SEQ ID NO: 7013 - DNA, 201 bp, Homo sapiens
tccttttggctttacccgcacataatctcttgggtggatcaaaacctcttcaactctctcttgagtttccaagcaggctcccctgtggggcttttctaagwgtgtttagcattggcattgctgcagagcacagtctcactgtgtggttttatgaaggatttgttttttaaaatttattttctatttttgtgtctttagagg

SEQ ID NO: 7014 - DNA, 201 bp, Homo sapiens
tcaaaacctcttcaactctctcttgagtttccaagcaggctcccctgtggggcttttctaagagtgtttagcattggcattgctgcagagcacagtctcaytgtgtggttttatgaaggatttgttttttaaaatttattttctatttttgtgtctttagaggcagggtcttgctctgttgcccaggctggagtgcagtgg

SEQ ID NO: 7015 - DNA, 201 bp, Homo sapiens
gtgtctttagaggcagggtcttgctctgttgcccaggctggagtgcagtggcatgatcatagctcactgcagcgttgaactcaggctcaggcaatttttcytgcctcagcctccagagtagctggcactacaggcacacaccaccatgcatggctaattaaatctttttttttcttttttttttaagaacgagggtctttg

SEQ ID NO: 7016 - DNA, 201 bp, Homo sapiens
cctccatctcctgagctcaagcaatcctcctgcctcagcctccctagtagttggtactacaggtgtgtgccaccatgcctggctcatttttgtgttttttwgtagagatggggtttcaccattttgcccaggctggtctcaaactcctgggctcaagagatccacttgccttggtctcccaaaatgctgagattaaaggca

SEQ ID NO: 7017 - DNA, 201 bp, Homo sapiens
ttctgagaagacatttaggctgagaagctaattaagaaataacagagaaaactaatgaaacccaaagctgattctctttaaaaaaaaaaaaaaaaaaaaamaaaattgataaacctaggtagactgatcaagaagaaaagagactatcagaaataaagtctggtgcattactacagactttaagatattaaaaggattaaa

SEQ ID NO: 7018 - DNA, 201 bp, Homo sapiens
gccactgtactccagcctgggtgacagtgtgagattctgtcttgaaataaataaataaataataaaataaacaaagctactataaccctaaaatggtaacyagaattattctcaaagcattttttttcaggtagaataagtagttcagcctagagcaatccaatttattactcaaggctcaactccaatacctctagcttt

SEQ ID NO: 7019 - DNA, 201 bp, Homo sapiens
agaagtcacgtgggaccacaatgaacaagaggcagagacaggccggatgatggccaaatgcacaatgaaactggaactgaggttcctaaagatgctggcayagcgttgcacagtcacttgtcttgggccagaccaaagcacagtcccctctactctacgagtgaggagcaaggcccaaagaaacaagcacgactgtgaatt

SEQ ID NO: 7020 - DNA, 201 bp, Homo sapiens
aagcccctggagaagagttcaccaaaacgtgaaaggggagtccagcagctgcgtgctaagggggtgtggctctcagctcaattctagcctgaccttcttayagatggctgagagaaccctagaggctatttcacgctgtcaacactaatgatacttctgctgagagaggggtgaacctctggtccacctattgctgatgct

SEQ ID NO: 7021 - DNA, 201 bp, Homo sapiens
tccctatatcggctggcagagacaggcaggctaggggatgcaaaatctcatgggtagagatgcagccttgcttcagagaaatcttactgcaaaccctggakgccagactttagacaggattgcaatgaccttatgtatccgaggcagtggaagtttcctctaaagaaaaaatgggaggcaagtggcttgaggaagtcaggc

SEQ ID NO: 7022 - DNA, 201 bp, Homo sapiens
tgaacaaataactaaagagctgtgaccttcaaacaagctacttcaagcttgttgagccttgggtaacgatggctatgccagagagacatgggagacttcartgacataaaatggatgatattttataaacaacaattggcgcacactgtacaaattaagtgattttttttaaatgtgggtctacccacctctaagcctttc

SEQ ID NO: 7023 - DNA, 201 bp, Homo sapiens
ggttttgcaaactggctatgaattgttcagcggttggattagccagttctgcagactgcctcacacgcagaccatctggaccgcttatagagaagacatgwtccaagtaccctctttcctttgtctgcttttctcatgggtactttgccctctaagaagcctactttcctcttttcctctcctcctctccctatttctctt

SEQ ID NO: 7024 - DNA, 201 bp, Homo sapiens
cttcttccctctcagcctgacaaagcaaagtgggctagtcccatcttccttacctccaaaaccagtacagcattaagaaattcctaatctaccgtgatgtstgagggtcaaaaaagtgggcctagaggtgaaaaatggatcatagacaaaatattagacatccttcaccctttgtcaaaattaaaaacttttattcatcaa

SEQ ID NO: 7025 - DNA, 201 bp, Homo sapiens
agttcattccgagacccatctgcaagagtgaaaaatgcgcccattgtgctacctgtaaaaagcatggcaaaatgtgaatgttccttaggatcggacatagrgctaaccagaccattctcccagcccagcacctgggacatcaggaagcaaagtgggttgaggatcccatccccataggccttcctctgagtcactggtgca

SEQ ID NO: 7026 - DNA, 201 bp, Homo sapiens
tgaggctctaccctctgagtaaccagtcctttctcatgaagggtaatatgtgtttccagcctaagagttttaaccgtcatttcctgcctgtagaatttggrgagtatatcataggtgataattgaacaatgagaacacttggacagaaggcggggaatatcacacaccggggcctgtcagggggtagggggctgggggagg

SEQ ID NO: 7027 - DNA, 201 bp, Homo sapiens
gaccagggagaacaagaagagtaaatctagtcccacactctaggagcttaacgagcagcaattttgccctccccccagcaaataattgtctggcccataaygtcacgttcaaagactgagaaaccctgctaaaagaagacacagattttaaagaaatgataatgtgaaagaattaattgtagaagtgtactgtaatcccag

SEQ ID NO: 7028 - DNA, 201 bp, Homo sapiens
acaaaccagagattcagttcctgtttctcttctgcacagccctctttctctctctttccccactcactctgcctacagtagcattttccatctgaggctakgagaaagaagataaacaccgctgcaaacccaccagaccacagctcttcagggcccaaacgattgtcagcaacccctgagggctacttggagtgtgagtca

SEQ ID NO: 7029 - DNA, 201 bp, Homo sapiens
gtcttctcattttctactctttctttcttttagaaaacaactgtttacgttcacttaaaagtagctgttcaactgttatcaagggaagagcccttgattcmtaccacaataacaggcaaaaggacgtctggaacattttgatctgtggcttcccctgcttctccccactcctaccccagatttcagcagccgtacctacag

SEQ ID NO: 7030 - DNA, 201 bp, Homo sapiens
tcttttagaaaacaactgtttacgttcacttaaaagtagctgttcaactgttatcaagggaagagcccttgattcctaccacaataacaggcaaaaggacrtctggaacattttgatctgtggcttcccctgcttctccccactcctaccccagatttcagcagccgtacctacaggaaacagtcagatcaaggctgcagg

SEQ ID NO: 7031 - DNA, 201 bp, Homo sapiens
aagaaacatcatctcgattcttttcaggatgtaaataaaaagatttccttctgccctttgcccaaacaatacctctttttagaggaaatcaacatggtaamgcagacttcaatttcaaaaaaaaaaaaaaaaaaaaagagcaaatgcacatttctcattaccaattacagcctgttccaatcattttcaaattaatcattt

SEQ ID NO: 7032 - DNA, 201 bp, Homo sapiens
tgggaaggttatgaggactttttaatatcacaaaggagttcttgtgttttaaacacatacagatttaagaaaaaaaaggatagcaataacttcagatcccrtgctgttttgagagccactggctaaactgggtttccagtactacagcagctaacaaccctgccctaatgaccaacgaggggaagtaaatctgggtgttta

SEQ ID NO: 7033 - DNA, 201 bp, Homo sapiens
gtgccttgtaccaacacaccggagccgaggagaagcacggatggctctgagacatcttcaatttcatctgcagcatggctaattctcagtttaataaaacyagcctgctctgtggatgcacaggctaaacattgcctgaactatcacttagcaaacatttcttacctctcccactccttctttctttgcctctctctccct

SEQ ID NO: 7034 - DNA, 201 bp, Homo sapiens
atttgtcaagtaactggaatagtgcctggaccagagaaagcattcaaaaataaagctatgattaccgtctgttattatcattatgagtgaaaaaggaaccygaacctcatttttctatgaaacattgaattctggaactagaaagtaataacaacaatgactaacactttttgggaacctagttgggtccagcactatgcc

SEQ ID NO: 7035 - DNA, 201 bp, Homo sapiens
gccagggtaagtgtccaaatttacccaagagtcaaaccagctagaaacattattcttttttccagactcacacttcacttcactgttaattaaaatttccmgttgaaaatcgttttccctaaattaggcatgctgctgcctaatatgcagtcataactggatttgggagaagtggccatccattttccaaatgagatcctc

SEQ ID NO: 7036 - DNA, 201 bp, Homo sapiens
gtgacagggatggagcaagaggaaggaaacgtgggagcaggtgagataacacagggctttgtgtgccatggtaagtaaagtgacccttactcaagcctcartcggaagccatcagagagaggtgaggcactctcatgcctttgtggaaatgactccatctttaaccccaacccctcatcagctctcttgacaagattcttt

SEQ ID NO: 7037 - DNA, 201 bp, Homo sapiens
aaaaaactctctgctccttttgtgtgccttgaagacatttcaggtgagtcagaagcgctgatgctgagactgatttggctgtatggaaaagaggagctgtsagataattttgtctctgggtagggcttaaagatgactttttttcaggtcatagatgaggtacccacagcctacagtgctccttcaccccaatttcttctc

SEQ ID NO: 7038 - DNA, 201 bp, Homo sapiens
aaaaaaatcaactgatgccctaatttcatagggaaggtttccctttaacaggaggttaatttttatgtcatttaagtaaatgaagatatgaaaaaatgatstactcagatgtcacctgccaatataagcagagtgggcaataaataaagtggcagaagcaaattcacattaatggaagttatgaagtgctgggcaggaagc

SEQ ID NO: 7039 - DNA, 201 bp, Homo sapiens
atcttctgggcttattctcaagaggcaggaaattcttggggaaaacttagagttaatccagtcaactttatgaacgatttagtttttttagggatgcacaytgatcagaaatgacagctatttaggaatcagatgtaggcagttcagaaggatcggtccaagacttctaggaattcctgattcatgaatactatgactggg

SEQ ID NO: 7040 - DNA, 201 bp, Homo sapiens
gcagatgagctggaaacagagagcctggagagaatggaagggctgaggagtttgcacaactgatgccatcctttacaatagtctttccagcatgcttcagkcaaaggagaacgtattgcaaggatgggctgtgggtggtttttaccttccaaaatgtaactcagatttacctgattatctgtattttcgttgttcttgaca

SEQ ID NO: 7041 - DNA, 201 bp, Homo sapiens
gaaactgtctcagattccaccctgttggaaatcttcttagaggttaaattaccctttaaatgaaggcttgcaatctcccattaaacacaacatcattattwatggcattgtttagtatctggttgattgaagatggtttatgtggtaatcaccactcttcaatggtgaggaagaagttgaaagatttcaataaaactaggt

SEQ ID NO: 7042 - DNA, 201 bp, Homo sapiens
atttagaaggtagtgcccactgaggaaagcccactcaaaatggcataacgtgtatgacataaaccctggctagagtgggatccttttaatgagttatagcyaacgaatgcctcccaattttatttcctatctactgattgtccctttatcaactacaatgcactaagatcaatgcattttattttagcacacttgatttcc

SEQ ID NO: 7043 - DNA, 201 bp, Homo sapiens
tcattttctttgcatagactgaagttgaaacccatgacaattttagcatttgacaagcattttttaaattaattgtcagaaaagttccttcaaatctgctytcccaacaaattgaacatcagtggttttcacctaacaactattgacttcaggttatgacaagattaaaatatttcattttgttttatccatcagttgaag

SEQ ID NO: 7044 - DNA, 201 bp, Homo sapiens
gcttctgatgtgagttaatggagtttgtggaggagagaaaataggaaataatgaacagcaataaaatcagattttgaatgttttggctcttccagatgacwaagccagtgaatggaaaaatgtagcttagctggttcattatgactttcaaaatctgtagataatgaccgtaaataagggggtgcacagtcaatcaaatag

SEQ ID NO: 7045 - DNA, 201 bp, Homo sapiens
cattatgactttcaaaatctgtagataatgaccgtaaataagggggtgcacagtcaatcaaatagggatgtaatttagtgactaggaaaaatattaagccyactgggtaaaaacagctttgaaaatagtttcctctggttacaatttattttacttttaaaaatgcagcaggaaaagtgtggggaaagagaggttttgcta

SEQ ID NO: 7046 - DNA, 201 bp, Homo sapiens
caactgatcagccttcctcaaagacgttccctataggaaatgcaattgatctaatcttctttaatgttgggattagtggatcctagcaattctctattgcyctcacgagtcagactttcatttcatccagacacagtaaactcctcatatccccaagcggaagaaggaaagctgcaagctactatctcctcacagaaacca

SEQ ID NO: 7047 - DNA, 201 bp, Homo sapiens
atccttaatttgatttaaatatctaaacatcatttgcttcacaatattatacctcaataatctacaataatctatgtgtttatgtatatgttttacttatsagactatgatttcccagtctaccaggaattttatatgcgtaatgattggtttctatgtccacagcttctaactcagggcatgccacatggagggacttaa

SEQ ID NO: 7048 - DNA, 201 bp, Homo sapiens
tgcttttaggaaactaattgctcttcagctcctagaaagattttttttaaagggcagtgattacttatcaaaatgttcagccaatatgttcttagagcagrgataatttcatctccagaaattgtatgtctcaagttaatatacacctcttatgtccggataaattcagagggatgttgccaaggctgcaaaaggctggaa

SEQ ID NO: 7049 - DNA, 201 bp, Homo sapiens
agtgcctgcttcctctgaatgcactgttttaaatgcaacgattggaggtggtgggattatgaagctttggcatgaataagaacctttcctggaagctgatwaagaatgcagactcctgtatctctggagtgttggaatcagtagatctgggataaggtgtgggatcctgacttttcaaccagcgtcctagagtcattctgc

SEQ ID NO: 7050 - DNA, 201 bp, Homo sapiens
ctccacagtctccagttatcacctctcttgacagcccctgatctgctgcctttcccccattcttctctactgcctccgagaaacctcaaactcagtaggcwtagagaagaactcagcctcttatcttccaccgtaaaaaatagtttctctcccatctgccatataggagttcttgaaatcccaaccatggaaatatccatt

SEQ ID NO: 7051 - DNA, 201 bp, Homo sapiens
tctctactgcctccgagaaacctcaaactcagtaggcttagagaagaactcagcctcttatcttccaccgtaaaaaatagtttctctcccatctgccatayaggagttcttgaaatcccaaccatggaaatatccattaattcatctctcttctgccacccccatatatattaaatcaatcaccaagccttgatagttcta

SEQ ID NO: 7052 - DNA, 201 bp, Homo sapiens
tgagaacagacatacagcgcaccacacaattaccacagttcacccagagaaagcattccaattgcaccttacagatttagtctgccttgttgcaagaaagrcgtgctcttggctgtgagatgggatctagagcagctcaacaggaaatgcgtgggagaaagaagcactgtgagcccctttattgcccatgctttcttccct

SEQ ID NO: 7053 - DNA, 201 bp, Homo sapiens
gcagaccagagaggctgaagcagagaaagacaggaaaatgtgagatcaggtgaggctgagaagatgaataggaacagaaagtgcaggattttagagaccaygttaaatgtctgtcttaaaaccgtgggaaggtgcaggcatggtggctcacacctgtaatcccagcactttgggaggctgaggtaggggaatcacctgaag

SEQ ID NO: 7054 - DNA, 201 bp, Homo sapiens
ggacacactgaagggtttggatttgttcagaaggtcatggtgagccaggaaagattttaagtagaggagtgatatactcagatttgcagccaataggggcrgaagtgaaaatgcttctctgcacttgaggggacttgaacatttttgttcacggcttaaaaaccattcattatctagacaattgaaacttttttttctctc

SEQ ID NO: 7055 - DNA, 201 bp, Homo sapiens
gtgctccacctcacacctcttattgagactctaaagaagatatttgcatggactgtttagtggagaactggagtcaaattcctcattattagcaggacttyaaagtaactaattgagcctaagttaagctgtttttattttttaagctgacattttggttccatttcccagggttatttttagccccgtcacattgtctgg

SEQ ID NO: 7056 - DNA, 201 bp, Homo sapiens
caatggcctttacctcagctagcgaaaataagttaccagtcactctgtacctgctgccctaagttgataattagggtggccaactcactgaggtgtttctyattgagtacaatgagatcttaagccaggtttcaattatccaacactttggggtgaatgtagttcaggttgagtctacctagcgccccaaatgtgggaaaa

SEQ ID NO: 7057 - DNA, 201 bp, Homo sapiens
gaaataccattttacaccacattgatcagttcccattaacacctgctgggcacttgtattaaacagtaaaatcttgtcattgttttgcttatctctacaawattgatcataaagctttagtggtcagataaaatgtcagaaattctgactgcttctaagcctcaaattacagcttcaatatctccatcaggagcaataagt

SEQ ID NO: 7058 - DNA, 201 bp, Homo sapiens
ttaacacctgctgggcacttgtattaaacagtaaaatcttgtcattgttttgcttatctctacaaaattgatcataaagctttagtggtcagataaaatgycagaaattctgactgcttctaagcctcaaattacagcttcaatatctccatcaggagcaataagtacacagaagcatgctggcaaatagagaaggggaag

SEQ ID NO: 7059 - DNA, 201 bp, Homo sapiens
aacaccctactacaaatgcaatgctttttaaagccatgcttccccttgccatttagtatactcatttccagagtccctctgtccttgtgtgaacagccaamcataatgggctgcataagcttctttaactatgacttaaaatatctcattcctccagatttctattttatctctttcgtcttatagtcataagtctccttt

SEQ ID NO: 7060 - DNA, 201 bp, Homo sapiens
taaatgcctccttgaactgcttgggtgtcacagtttcttcgtttgtcatttaatttacatgtttttgaaaacacagtcagttttctttaacctcttttcarttctcaagatactttcattttcacagagtgttttttttttgttttttttttttctcttacaagcattctcctggtgtttgcaaatcccttcaactttgat

SEQ ID NO: 7061 - DNA, 201 bp, Homo sapiens
tttgtggctttcaacctcaggtaagtatcctcagttctcagagtatttgtttccttttctgtaaaagtgaggtcataacagccatgtcactgggtaattayagggatcacactaaatgacgtctaatgagatacacaacgtgataaaggccagcagagtgcttggcacattatgggtgtctgctaaactatggtaggggta

SEQ ID NO: 7062 - DNA, 201 bp, Homo sapiens
caaaaactatagaatgagatgatatggatcaattgacattcaattcaaggtgcgatttttatttcagaatttctggatattcacatactggaatatagaaytcataaaagcagggattttgcctggtttttccttctgctgctttttctcccttgaagaacctagaatactacctggtataaagtagatgctcaatgcaaa

SEQ ID NO: 7063 - DNA, 201 bp, Homo sapiens
ctggttaatcttccattactccatttctacttgcttttttcagggcaaacaccaagttgatttatcagaaagaatacaaatttctcatgcttttcagaacygggcagataatatcaatgagtaaaacgagccaggtgcaagatgataacagtggtgaaaatcttagctaaaggcattcaaattcatttaaatgtaaatgaa

SEQ ID NO: 7064 - DNA, 201 bp, Homo sapiens
ccatggcggatcaattagattctgtctcctaggaatttgaaagttgataggtaagacacacagaccaggaattgttggctctaaaccaatgtaatagtgaytctccttcgtcgaggaatgttgcctcaccttatgacctttccaagattagttgctcaacttatactttgatttttaaaaggtctagtaaagccccaaaca

SEQ ID NO: 7065 - DNA, 201 bp, Homo sapiens
aatgtctttcactttgttcctacctgcactataacatctgtactgctattcagattcctacatttcatcctccatactcatatcaagcccacttgccagaygaaatgttcccacacctcagttctgatcatgtgccacccttctcaaaaccctgaaatggatccccactgtccaaaaataaaatccatgctccttggcaac

SEQ ID NO: 7066 - DNA, 201 bp, Homo sapiens
tcataagacacatagtagatatgggtgctctatttcattcaaaaatatacatatagagtcttcactctttttctccagacaggatcttgaatttgcagaawgagattctattccagggacctttatgtaaagatttatagacatttgctacaacgcattgtgcaaccttgtattttaggtcaaataagtaattgaaacaag

SEQ ID NO: 7067 - DNA, 201 bp, Homo sapiens
ttttgtgaaatctgatgatagtgtttaaacattgggactttacttttggaaacaggaaaaacactctaagtttaaaaaaaaaaaacatgcacacaacacasgtcaatttgcagcctctgaaagtcgtaacgtggggtttggaaccaaaggaaactggatttaacttctggctccattttacattacctgtgtggctctttt

SEQ ID NO: 7068 - DNA, 201 bp, Homo sapiens
aaatgattgacttgcattgcagggctggcatacggttcttttgacttccagccataaaagggagggctgtgttccaggagagatgccacaaacagagatgrtgctgaagagaggctgttgacttagtgctcaggctgaacacccagcaagctcagcccactctcatgggtccatcaggcctagatcaagctgtgcctctag

SEQ ID NO: 7069 - DNA, 201 bp, Homo sapiens
tacccaaccatccaatacccaacctatatctcaatgtatcctttattgataaagaggagaatatagaagacctataaacctcagcagttgtccacagaacktcattaatgccaaaatagggcaacaagataaaaaaaaccaccaacagaagacaacacagaagtagagtctaaaggcaattatattcgccaacctcacaca

SEQ ID NO: 7070 - DNA, 201 bp, Homo sapiens
tttaccacccagagccaagtttcccactatcaagtccacaatgccagaggaaagaacacataaatgcatggagaaatgtatttcttgattctcgttgcagstgatttaggacagcccaatatactgtacattaattaggaccacacaatgatcattgctcttgaactcagccctgctttctagatcattagcagggctggc

SEQ ID NO: 7071 - DNA, 201 bp, Homo sapiens
cttgcttctgcttttctgtatttttcaaattttccataattagcctgtttcttttataaatgaaaaattaactggaaaacgaggcagcctaggtaggtagrgagagcatatgctgtgaagtcaaccagactatcttttattaattgtatcacttgttcctaacgtgtaatttttcttttttatacactttatttttattta

SEQ ID NO: 7072 - DNA, 201 bp, Homo sapiens
atccaaatggagtttcataccatggagcttacatgaatttacagtacaagtgtggccctggaaccagtgacccaatcctgcatctaccacttgataaataygggaccttgcacaattactcagccttgaattcttcttcctgaaaatgtgaccactgttagtgcttaattgaggttcttgtgacaatttaatgggatcagc

SEQ ID NO: 7073 - DNA, 201 bp, Homo sapiens
gctagagcagggtctttgtccatcagtcttcaccacagctctgcttattacctcccccataacactgtccaaaatctgtaattagttttttcacctgtgtrttgatgtctccctatactagaatctggacatgaaaagactgtatcctcattctctagtacaatgccaggcatttaagcatttaatattcacagaatgaat

SEQ ID NO: 7074 - DNA, 201 bp, Homo sapiens
aaacccagaaatcaaggctggctcttgggcgagtatgttctcatcaaagatcccagcaatagagcctggtggtttcctacagggaacagacttccatctayagctgaaagacgtcagaaggttgttgctgctgatctcattcgggttcgctgtgaacaccgagagggtaactgaccccatttcaatcctgtttcatgtctt

SEQ ID NO: 7075 - DNA, 201 bp, Homo sapiens
gcaactgttcccacatgtctccccacttggaattgaccacatctgttccttaacttgtgagcacagcacggatcaaaggactctgctgcagtagtcttgtyttagtaaattaagtacctatcagtgccctgaagggttgctattctaagataccacacacgtgaatgcacacacatgctccagaacaaagaaacatcgtta

SEQ ID NO: 7076 - DNA, 201 bp, Homo sapiens
ctggcaccaggccctccctggtgacattgggaaagtaggtcagtttcagagctggctgggggatgaatggtcagccaggagcaagtggtgggaattaaagrtgctgagtgagaggttgacttaagcatgggatctaggagacagggagtgttattagtctgtttttcacactgctgataaagacatacctgaactgggaag

SEQ ID NO: 7077 - DNA, 201 bp, Homo sapiens
tctctccagacccaatgctccaccacccatcacctccctcatccgtcgagacccaaagcttcatcacttccttatctctccaaagccaaaacttgacttgycatactttctcaatgtactgattaaataaaactgccggtaggattaactctgcaaggatgcacccaacccagatatattcaccatagccatagattacac

SEQ ID NO: 7078 - DNA, 201 bp, Homo sapiens
ggaagaaaaagagggaggaagaaagagcatggaaaggaggaaggatggagagacacagacagggagtgaaaaaaagagacaaggagttaatgctttctggrgttgacgagaagaatccatgaaagaattttttagcagcggtgtgacatgagcaagtttttatcttcgggaaggaccacttgagcttgagtatgaggaagg

SEQ ID NO: 7079 - DNA, 201 bp, Homo sapiens
attacccaaatgatgtcatcgcatcataattagcaatagggccagaattaccaaccacagcaaagcacgtcaaaatggggctatctcaactcttccttaaytgggaaatttaacaaccgaaagatgcccctcgatgactctgaagggcttggtttctcgcatttcctggacctctttgaacctcacctgagaactcttcta

SEQ ID NO: 7080 - DNA, 201 bp, Homo sapiens
atctcagctccaagcaaattgaaaatctctactaattcacaaaaaaataaaaataaaaaaataaaactttttaattaggtcaaccctgcagcttaacaacraagatgaagaaaaagatcttgggcaagaacaagacagctgtggtttgagaagaaggcactagacttggagttagaacttggatgctggctgtgccatata

SEQ ID NO: 7081 - DNA, 201 bp, Homo sapiens
gaaaaagtgcttatggagaagttgtcataacatgatgaactgaaattatgacgttaggtgaataataaaagtgaaaacaaaatgtatatacaagccaatcrtaaaaatatttgtaaaataataagattgaaaaacttcaccaaagagttacagttgtggtgaaattacaagtgatctttgtcgattttattttatagtgta

SEQ ID NO: 7082 - DNA, 201 bp, Homo sapiens
ttatttttccattatttttccaagatgttcagaagtcaattgcataaaaaaccacctttcacaatgtagatgatcaataaatataaaagggagttctgcasgttattatttcaatacgaggtgggagtttagtgcagcaggctgcagctgtgtgtgcaataaatatagaattagaattttccacattgagtttctgaaaaa

SEQ ID NO: 7083 - DNA, 201 bp, Homo sapiens
gggatttctagttagaggctttataaaggtagaatcatgcagacacatatacctggaaatattcggaacattctattagcagaaatgcaatgtaggaagcktattggttctagaagaatgtgtcattgtcagtaattggaattactgacagatccagttgaagtaaggggaaaaccacaaagagtctgtactcttaaaact

SEQ ID NO: 7084 - DNA, 201 bp, Homo sapiens
tgagacctaggggtggaagcttgggggtcaagtctgctttgagaggcaagatctcaggctgtgtgcagaacacttttgcacctcgtgtctcagtgatgggmggtcagggtgagcttccccaccaaaccccaacaggtgtttattataccctgtggggaggcagggagaggagagggaaatgtctcttctgaagaggcctag

SEQ ID NO: 7085 - DNA, 201 bp, Homo sapiens
caacccaaccttgcaagcccaattttccacctcattcctgagggacagacagtcactgttagctcaatcatatcctgatatagccttcctattccatgaaycctcacagtcttctgttagagacctaattgccgaagcttattcctcatatcaagatgaaactttactccttatagtttcactcttggccaggtgccgtgg

SEQ ID NO: 7086 - DNA, 201 bp, Homo sapiens
aataaaaataaaaaaagttaaaaaaatgtgtgtgtgtgtgttcattttaactgataaccaaattgactactattcttaccagcaggggcactatcatgttsccaatgtagaagtaaatataacacacgtgtgttctggatgactttaccaaatcaacatcattttaacaggaggcagaggccttgtcaatctaggaaggtt

SEQ ID NO: 7087 - DNA, 201 bp, Homo sapiens
aaagtctctgccaggtgttaggtgctggttcctatcattggttccatcaccccttaaagcggcttgcaacatccttgtaaagttctgttgttcggactcakgatcaagacacaaaacaattctcaggggcttgaatcagcccctcctagctgctactgggtgaacactgtgatttgtgacaggtaatttaaatgcaacaag

SEQ ID NO: 7088 - DNA, 201 bp, Homo sapiens
ggagatggaacaaaaatgccccccaaagctgcctcaatatcattaaaagttgggcagtgaggaagccaggaaatagaacacaaagcatgttgggctgagcyatagaataagagacttttgggatagtgaacaaactctacctcccctattttaagcagaaatcacaaccgattttgattccacttaataatttcctcgaca

SEQ ID NO: 7089 - DNA, 201 bp, Homo sapiens
ctcagcctcccaaagtgctgggattacaggtgtgagccccgcagccagtgtaattaatatgactcttgagactctttttatttcattgcatttttggtttyaaaaactgggtcttttgttgcagtttccaatagtctggattttgctgatgacatgcccatgatgtcatctaacaggcttatgccccctcccatatttgct

SEQ ID NO: 7090 - DNA, 201 bp, Homo sapiens
gaatgatcacacaactttaaaggaaaagacaattacccaacctcctttggaaacagaaatcaacagcattgttccttctggctgggtaccgagataagaawggaaatctgtagaaaatcctacaaccaaggaaaagaaatatgctactaccaagaaaaagtgcttatggagaagttgtcataacatgatgaactgaaatta

SEQ ID NO: 7091 - DNA, 201 bp, Homo sapiens
ctgtggaatacattcccctagggagagctgaccacagatggaatggctattcaggaaggcaatgagaaattcatctctggaggctgaatgaccggtttcayggattaggtgggtaagagaaggaagtcagtgtagtcatctataggtaccttcctcacagtaagcctggaactccatgagagaagttggaaactgagatgc

SEQ ID NO: 7092 - DNA, 201 bp, Homo sapiens
atggaaggcaggaaaccaagaacacagtgggagtataccaagtagagctgagttcttggacaaggctgaaattgtgcacactcccacttctggttgccttrgcaatgagactcccactttatacgaatgacatgagaatgagtaaaaccttatgcaaatgaagcacacagtaattagaggcagagccacatggagtctaga

SEQ ID NO: 7093 - DNA, 201 bp, Homo sapiens
ggaagctaaaattgtatttctaagcagaaatttgtggacccattttaatgacaagataaaacacatttctagttagcagcattccttgtacataaacaatytatctacccaaggctagaaaacggtatgccctcaagtagattaaatcaaccctgccgggtacccccaatgcctctttactactcatttgtttggcaaatg

SEQ ID NO: 7094 - DNA, 201 bp, Homo sapiens
aaaatactactatcatgaggccagggagaaatctgaactcgggaaagtggtgtgggggccagaatttgagaagagaagaagcctacgctggaatcgcactkagttcacgtcacttcccagatctggcttccaatggcctcttctcaccctctaaataaaatacgtaaatcctcaatgtggcctttacaatctgcctctttt

SEQ ID NO: 7095 - DNA, 201 bp, Homo sapiens
ccacctacctccaggctgctttaatctgagaaggaaataaacttctcttttgttttagcatttccaggcttatttattggcaaacacaattcctaaccaayatatgcacctgcccgaatactaaaatccaatgaatagagattcctgagattcctttacatactcatttccactcattcactctgatttaaatacagtcaa

SEQ ID NO: 7096 - DNA, 201 bp, Homo sapiens
taaaatacccacgaaaaattcacactccatctctgaatgaggaggctaggtttttccaacggtggagccacaaaagtctgttttgacaagttatctccccrtaaacatactggtttatctcatgctgaacaattagatgtgctatttaggcaaaataaaaaatatattgcacattttctagacagcctgttagcatccatg

SEQ ID NO: 7097 - DNA, 201 bp, Homo sapiens
ctcttgcagcctgcaggtcccaaaggaaattgtgtcattttatcttgcctagctccaaaaggagcagcctctgtcagaagatctcaatcatcataggcacrtcccaggtgtgtgtcctgcttctcatcaggcctccccatcttactagaccactaggttcagccctgacttgtaggaggggctgggcctccatagcttcta

SEQ ID NO: 7098 - DNA, 201 bp, Homo sapiens
cctaaatttaaacttcatatcacttcgccctctgatttaagcagggcattaggttcatctctaactctccctttctgtcaactgaagaacatggatctgcwccattcactgcacagtcaagctggggggcactgcagagaacaaggaaagaagaccaccaccagcagacatgggccatggcagctcttaacaatggcccca

SEQ ID NO: 7099 - DNA, 201 bp, Homo sapiens
tgcagtaaaggactaaaccagagatgatgctgcacccaccaaccaagtgcttcctctgccctgcgtgctcctcctctctcctccctcgtccaaggcattcygaaaagcacccttgtcttttgggcagagttccctttccaccctcgagctgtccccactgccttagcctggactaatctctccagggaacctctcctacat

SEQ ID NO: 7100 - DNA, 201 bp, Homo sapiens
gcttctaaaaacatacagttaatctacagcatctctcctacatttgctgcgtagcattggcaccttcactcaagtgacagtattatagtcaggtggcatcratcagctttaatcagccttatatttaagagctagagtctctgggtgttttagggaatacccgggcaacaaagtgaaaaaaaaaaacaaaaaaccttttgc

SEQ ID NO: 7101 - DNA, 201 bp, Homo sapiens
gtagggaagagattgtctgggaaactctgcccaagacatcaccagagagcccacgtagtgtggtttctctccttgtatcaatgagaatgaaacccaaagaraactgatgcatcacccagtgagtgaatataggagctacagtgaaacccatgtctcctgtcctcctactccaggtttctaaacaggaagcatcagaacctg

SEQ ID NO: 7102 - DNA, 201 bp, Homo sapiens
tccatcatgagtcaggacaggcggctcatgtggggaaaaggatgcattctttgtttttgctcctggctcagatttcggacacatcattgtaatcctctggycttctgttgcaccatcatgtcttcttacttgcaaagagtagtctgatattctacaggaattgcagatggaaagtttatttttgaacattctgtagtgagg

SEQ ID NO: 7103 - DNA, 201 bp, Homo sapiens
tccataactttttacacaaataataggttatgctttttgttctataactgtctgtttttacccaaaaacatgtcttggagacctctccataccagtatgargctctactttattctactagatgaatctttcccatggtgctcatgtgtcatgggttagccatggcactgcgattgatatttagtccatatctgttgttat

SEQ ID NO: 7104 - DNA, 201 bp, Homo sapiens
ttgctcaaatgagaaagaaaaaaaaaaaatcaacctgccaatctggtctttcctgcagtaaatgaaaactagctctgttcctgcatagaacagaagagtcmaggcagctaagtcacatgaccggagacaaaccagacagaaagaagtcacgtgggaccacaatgaacaagaggcagagacaggccggatgatggccaaatg

SEQ ID NO: 7105 - DNA, 201 bp, Homo sapiens
acctaaactcacattttgccacatctccacccatcctgcaccctccttctgaaatatcctccctcttccttgtcctgtttagtcactacagaactccattyctcaatagtcaactaactaacctctcaaagacatggactacctacatctgaatcactagaagcactaataaaaatgtaccttcttggccgggtgcggtgg

SEQ ID NO: 7106 - DNA, 201 bp, Homo sapiens
gaccacagaacaatggacttttcagaagagtccatggaatagaatctaacctttacaataaataacaacactcacatttaggtactgtctatttcccatcsaaaaggctttccatcagattttctctcttaggtcctattattattcccatgttagatatgaggctatgaggtatgagaaactctctctccaaagcctaaa

SEQ ID NO: 7107 - DNA, 201 bp, Homo sapiens
gcctatgcctacactatttcttctgcctggaattcttctccttattatctccccctactgaaatcctacccactcttttcaggcctagctcaaatgccaawactcccatggaacctaattctccatctggaattcatttttgcattttctttgcctttagaacacactttcccctcacttgtttattcatgagcccacatg

SEQ ID NO: 7108 - DNA, 201 bp, Homo sapiens
tggagtgaacatagcaataggagacagaggaaatggcgacaaagatggagcagctgcagatgtgctgggccccacagactatgggaataggttttagttgygccttaagtgcagtgggtagccatggaagcagtgtatgcaggggaataacagatctacattatattgttttaaaagatttctttggacactgaatagaga

SEQ ID NO: 7109 - DNA, 201 bp, Homo sapiens
cgcaccttccgcgctcagctcggcggccccggccgcggtggacaggctgtcggccgggccccggtgcgcaggcggcggcggttgtttctccttggctgccrcctcacgctgctcgtgctccacggcagcgctgctcgacacggatgccggccgcttgtgggcgcccagatcggtgggctgcgcggagcccaggctggcggc

SEQ ID NO: 7110 - DNA, 201 bp, Homo sapiens
ttaatgctaaaagttaaagaaaaaaaggtactgtaaatctgacaaatgacagaattcaggtgatatttccatagcgtgattttaaaatataataatgttgrtatctgagattacactcacttcagttgacatgagtttcatcatatatagaaaaagtatcaccttcaacttaaaaaaagtaaaggttaaaaggtggcacac

SEQ ID NO: 7111 - DNA, 201 bp, Homo sapiens
gcggggcactggttgccagagaggagtccgggaggctggcagggtgcactggctccagtcctcctgtgttgcctgctccctggccccccacctctctgggrcccagccttctttggttcatagaggacggagagggcggactgttgctattcctcctggtagtggagtgaacctggttggcatcttttgaggcatgactgc

SEQ ID NO: 7112 - DNA, 201 bp, Homo sapiens
catgcaacttaaaaccttcaggcgtacgggattctgaggcagcagactgatttaaaatggagccactgaaaatgacacgcttgtaactgcctgtttgtacrcatgcacaaaagtaccctcgtttgcactcaacatgtgactgctaatgtcccccaataggttaaaaggtgactggtgccctcatgctcccatccaagaatg

SEQ ID NO: 7113 - DNA, 201 bp, Homo sapiens
agaccataagagctgaattctttacaaatgtctttatgggcatgtaaaattgactctgcatttctgcatgtgtgcattcacataagagagaccagtctgcmctgagtcatatatactccaacttgaaaaagtaagtgtaacaactggttaatcatgcaagtctgtttgtaatataacaatgactggtaaaacatgaattct

SEQ ID NO: 7114 - DNA, 201 bp, Homo sapiens
gatttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaaga

SEQ ID NO: 7115 - DNA, 201 bp, Homo sapiens
atttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaa

SEQ ID NO: 7116 - DNA, 201 bp, Homo sapiens
tttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaag

SEQ ID NO: 7117 - DNA, 201 bp, Homo sapiens
ttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaagg

SEQ ID NO: 7118 - DNA, 201 bp, Homo sapiens
cccttttctcccctagaccccctcacttcacagccgcccctacctgctttagacccgttggccccgttggcctcgaaacccaacaacctgcctgcagtcarggccggctccttcttaaacttgctctcgaagggccccgagtggccgtgctggtgcagcgccagcagcgtgtcgcgcacggtcttgggcctgttgacccag

SEQ ID NO: 7119 - DNA, 201 bp, Homo sapiens
agccgcccctacctgctttagacccgttggccccgttggcctcgaaacccaacaacctgcctgcagtcagggccggctccttcttaaacttgctctcgaarggccccgagtggccgtgctggtgcagcgccagcagcgtgtcgcgcacggtcttgggcctgttgacccagtcctgctctccagacccgcggctcttgcccg

SEQ ID NO: 7120 - DNA, 201 bp, Homo sapiens
ggcgcgcgcggggccgcctcggggccgccgtggccaagctgctgctgctgctgcaaaaggatgtccttggcggagagcggcggcggcttggcggcggccgrggccgcggcgccgggtggggagcgaccctccgggaagcagccgtgcgcccgcttgagctgccgcgccgtctcgatgacgaactcgacgcggtcggcgccc

SEQ ID NO: 7121 - DNA, 201 bp, Homo sapiens
tggaaacacaaagaaataaaaggaaaaaggtaacataagtggcggtgcactgaaagagatcattctcttcctaacccgaaacaaaagtcgttacagaattyctcctctctaaaagcacagacagaaaatactcatatacgagtttcaggtgcacatgcaacttaaaaccttcaggcgtacgggattctgaggcagcagact

SEQ ID NO: 7122 - DNA, 201 bp, Homo sapiens
gtgaggcagtgggtggtggcggagacacaaaagaggatgtaggagtcatggggatcttgagcccctctgtggatgtggacagccacggctgggcctctccrttgatcttagggggcccgacttcaccttctggttctggagagggcttccttttccttgctgttcttgcaactggaaacacaaagaaataaaaggaaaaag

SEQ ID NO: 7123 - DNA, 201 bp, Homo sapiens
gggccgcttcaggcggtgtggtccggttggaatgaggtgaggcagtgggtggtggcggagacacaaaagaggatgtaggagtcatggggatcttgagcccytctgtggatgtggacagccacggctgggcctctccgttgatcttagggggcccgacttcaccttctggttctggagagggcttccttttccttgctgttc

SEQ ID NO: 7124 - DNA, 201 bp, Homo sapiens
ttatccaaaacggcaggatggttctgtattaatctttttggaaagcatgtctgtattaagattgcaaaacatacagatagctaccacaaattaggtcaaaygactgatcaagttgtaacatctgtgaggtcaaattcctataataaagtgcctagatacacatttatacaacagaccataagagctgaattctttacaaat

SEQ ID NO: 7125 - DNA, 201 bp, Homo sapiens
gcagcgtgtcgcgcacggtcttgggcctgttgacccagtcctgctctccagacccgcggctcttgcccgcaccttccgcgctcagctcggcggccccggcmgcggtggacaggctgtcggccgggccccggtgcgcaggcggcggcggttgtttctccttggctgccgcctcacgctgctcgtgctccacggcagcgctgc

SEQ ID NO: 7126 - DNA, 201 bp, Homo sapiens
gcacagacagaaaatactcatatacgagtttcaggtgcacatgcaacttaaaaccttcaggcgtacgggattctgaggcagcagactgatttaaaatggasccactgaaaatgacacgcttgtaactgcctgtttgtacacatgcacaaaagtaccctcgtttgcactcaacatgtgactgctaatgtcccccaataggtt

SEQ ID NO: 7127 - DNA, 201 bp, Homo sapiens
aatctgatactgcccatgtacagtaagtagctttgtgacatttttatccagctgtggagaatctctgcactgtcatcaggtacaacaaaagatcaaacccmtgtcccgatgttaactttttaacttaaaagaatgccagaaaacccagatcaacactttccagctacgagccgtccacaaaggccacccaaaggccagtca

SEQ ID NO: 7128 - DNA, 201 bp, Homo sapiens
tctttatgggcatgtaaaattgactctgcatttctgcatgtgtgcattcacataagagagaccagtctgcactgagtcatatatactccaacttgaaaaastaagtgtaacaactggttaatcatgcaagtctgtttgtaatataacaatgactggtaaaacatgaattctcgcacagtagtaataggtgcactcattaaa

SEQ ID NO: 7129 - DNA, 201 bp, Homo sapiens
agcaagcattttcttcagcttccagtggcttttctcaaaattaacttctttacatgcccaactactcttgacagttacttttgcttcagtctgggcaattkgttgaaaataagaacagagagaacattacttcacatgacaattcctttgggaacgcatacttcaaattttatcagcatagccctttcacacaaggatgtt

SEQ ID NO: 7130 - DNA, 201 bp, Homo sapiens
tacctaaatactttctgcacgaattttttcctttagccacctgtcaaagagatgtttagggatgacaatccttgaaacagaactactagatgaaattgctyattgagttgctgttcattcactgatcactctcatccttcacagttttttgaagaggcgcagtctactgaagcatacctgaaggggctccaggactccatc

SEQ ID NO: 7131 - DNA, 201 bp, Homo sapiens
gtcttgagcctgttgccttgaagagctggggtctcggggaatgattggtctattaataatttaatcagccacttgcaattcagccttctttgaaatggtcrtgaaaaatccttccttcctgaaaacttctccgtgtggaggccattatccttagcaaacttatgcgggaacagaaaaccaaataccacatgttctcactta

SEQ ID NO: 7132 - DNA, 201 bp, Homo sapiens
ccttgcttgaagagcaaatgaaactctgtcatctcgttctttaagatacagaccatctgcaacattttccgccaacaccaccgttgttttaaggtttctgytaggtgtcttccagaaaagtgcctcatttgaaatgtacattgaatgagcttcattgtagagaaaaataggtattctaggaacatcttgaaaggagaatgg

SEQ ID NO: 7133 - DNA, 201 bp, Homo sapiens
cgatcataactgagcttctggactgtttaggcgttggcttaaggaagccattgcaccagtgaaggagggagggaatgaaagtctgaaccagggtgagggcrgtggatggaaaagtaggtattgccaaggtggagtgacagcttcagctaagaattggatgcgagagacaagggagagtctgagaaaacaggcccagagctc

SEQ ID NO: 7134 - DNA, 201 bp, Homo sapiens
actatcccacaaacacaatctgccaaacacacagtgtgaaaatcgagaaaaccgcctggaaaagaagcagaacttttattagagtactgtttctgtagctsctgggcgaagacaaaatgcaggatcaaaggaggctgtctttctaaaatctatagagacaaaaaatccaccatgtttgctcactgctggagtgggaatggg

SEQ ID NO: 7135 - DNA, 201 bp, Homo sapiens
taggattccccattgaaacatttaattttgggcaggctccatgttttttccttgtgtagtatcatcccgtgctctgtttttccaacttaaagcctacttayaaacttgtcaagtctcacatctctctgggaaggggaaagagacccaagtgaaaaattacctgactttgaggaaggatgttttttcttctcattaatgttg

SEQ ID NO: 7136 - DNA, 201 bp, Homo sapiens
atgaactttttttcctttatctttctgaatatttttatttttttaagacaaggtcttgttctttcgcccaggttggagtgcagtggtgcaatctcggctcrctgcagcctctgcctcccaggttcaaccatctcatctcagcctcccatctcagcctcccgagtagctgggacttacaggcgtgtgccttcatgcccagct

SEQ ID NO: 7137 - DNA, 201 bp, Homo sapiens
tctggacgactgggagactcgggtcccgaaggtggaaaggtttttttgccccaggtcccgaaagaacttcccggccgcgctgggagcaggaccgggtgtcytgacgcgtgcggggacaggttggcccctgtcctgcgaacagggactcggtcgtacctttctcccctcccgcgagcccgggcgggtggtcagagggggcgt

SEQ ID NO: 7138 - DNA, 201 bp, Homo sapiens
tatatcatttgctaagatcatatgagcagctggtgcaagaattatgatgagaatccagatttcttgaatttttgcctagtcactctttgcatgtatgtctrtgtgtgtaaagagaaatgagaatgcacattggtctgggaggggaaaagtactgcttctttcttggaatgtgaggtgtttttcttttgacataatctctga

SEQ ID NO: 7139 - DNA, 201 bp, Homo sapiens
tacagatgaggtagctcagactcaaagataatatatcatttgctaagatcatatgagcagctggtgcaagaattatgatgagaatccagatttcttgaatwtttgcctagtcactctttgcatgtatgtctgtgtgtgtaaagagaaatgagaatgcacattggtctgggaggggaaaagtactgcttctttcttggaatg

SEQ ID NO: 7140 - DNA, 201 bp, Homo sapiens
gaatttgctttatttctctgtgttaaagataacatcttggactaggtatatttgaattttttatattcagtgattgttccctttattcctcatttatgatrcttaaattgagattatatgtaaacttattttaatgtaaacttgaaataaagggaatataatttatgaaatcataagcttttgattttgaaagaaattacc

SEQ ID NO: 7141 - DNA, 201 bp, Homo sapiens
catgtgtttttatgattgaataatattccattgtttggcagtgccacattttgttgatcttttcatcagttgatacctgagttgtttccagtttttggctrtgataaaaagtgctgctatgaacattcatgtataagtttttatgtgggaatatgatcagttttcttgggtatatatcaagtgaatttctgggtgattcta

SEQ ID NO: 7142 - DNA, 201 bp, Homo sapiens
cctagcaggagagggagatcctttaggagtgacagggatggaagtgaggagaggggcacagaaagtaccttttggggtcccccgagccctttttctctttktagttggagcagctttgctgggctctgctttacatttagggcttctgaataatatttcgttgaagaaaaatattctgtaggcaaaaaaaaaaaaaaaaaa

SEQ ID NO: 7143 - DNA, 201 bp, Homo sapiens
aatatcaatattcactcattgtaggaagaacattcgtttaacaggttgtccatggcagattcctttaaaccatttagtatcgaaatcttcaaccacacacwgaatagggagagtagtgtagtaagctgctgtgtgctcatgaccaagctttgggtcattggcatctaatgcacctgccatcctgccttagacctctgtcaa

SEQ ID NO: 7144 - DNA, 201 bp, Homo sapiens
tgaagaaaaggaggcttagaagggccactcttttctatacaatccacaaggggatttatatctacctgctttttgttgtcttctagcgcgagaaatctgckatctaccagttggaggaggagtatgaaaacctgctggtaagctgatttatttctcaagtgcatcgactttctgttgtttccaattcaattcagttcaaga

SEQ ID NO: 7145 - DNA, 201 bp, Homo sapiens
agttcccagggaggtctgggctcctcacccacattcatctagtcctggcttgttggggagccttgcctgcagggaggaaccccaaatgggtggccaaaaamgaaatgctttcccatggtgagacagtgcagccaggtgcttcgggagaattcccacattactgtgatcttatcccatctatgcataatgcaaccattgttt

SEQ ID NO: 7146 - DNA, 201 bp, Homo sapiens
cttgcttgtatctcagcagtatgagaaacggacctcatttcctgtataattcggagtggaagacagagactggttgcattggtggtgggtgggggcagtcytggtttcgagagctggatggctctggcaccacctcccctgggcctgcctggaggagcctgtgtcttcttctgggagtagttcccagggaggtctgggctc

SEQ ID NO: 7147 - DNA, 201 bp, Homo sapiens
ttttatttttttttaacagcggggttttatgctgtgttgcccaggctagtcttgaactcctgagctcaagcaatccttttgccttggcctcccaaagtgckgggattacaggcgtgccccaccctcatcttatagctcagtttgtgattgtttttacagtggcacacattattaaatcatttaggaaactctgactttcca

SEQ ID NO: 7148 - DNA, 201 bp, Homo sapiens
atagttttagatttgcagaaaagttacaaaatagtacaaagtttgtgtataccctcacccagtttcccatgcctccatcattttatttttttttaacagckgggttttatgctgtgttgcccaggctagtcttgaactcctgagctcaagcaatccttttgccttggcctcccaaagtgcggggattacaggcgtgcccca

SEQ ID NO: 7149 - DNA, 201 bp, Homo sapiens
gtggattccctataccttagttggcctgagtctccctctatcttgttttgatggaccgagccattcacaaggtatatacctagttccttttctcgcctcgktctgtttccaaagggaattcttggccacacctaagactgaagttggattcttacagatgaaagatagaagtagaccttgttttaaggatcagacgcggtc

SEQ ID NO: 7150 - DNA, 201 bp, Homo sapiens
acctggcaaggtggattccctataccttagttggcctgagtctccctctatcttgttttgatggaccgagccattcacaaggtatatacctagttcctttkctcgcctcggtctgtttccaaagggaattcttggccacacctaagactgaagttggattcttacagatgaaagatagaagtagaccttgttttaaggatc

SEQ ID NO: 7151 - DNA, 201 bp, Homo sapiens
ctaagacaagcaaactgacctggcaaggtggattccctataccttagttggcctgagtctccctctatcttgttttgatggaccgagccattcacaaggtrtatacctagttccttttctcgcctcggtctgtttccaaagggaattcttggccacacctaagactgaagttggattcttacagatgaaagatagaagtag

SEQ ID NO: 7152 - DNA, 201 bp, Homo sapiens
aatccagtgctacacatacagctggtgtatgtctgacatcagactgacccgatgggtcgaaatcatttccgctgaacttcctccctgattaagtacagcgrgttctgtgtggattcttcattgggctaagacaagcaaactgacctggcaaggtggattccctataccttagttggcctgagtctccctctatcttgtttt

SEQ ID NO: 7153 - DNA, 201 bp, Homo sapiens
gcttgttaatttaattcctaacatgatttgaaaatctttcaacccctaacacccatatgtagcagtattaaaaatttctttgagggtagggatttaaaaamatgtgtatacgcttgtaagtacatcattttaaaattatttctttatccattatagaattttgcattttcccaaactgcactatatgaattaaatttaatt

SEQ ID NO: 7154 - DNA, 201 bp, Homo sapiens
gagcttttgaaatcagggtaatgagatgagccataataccctcagatgggtcttttgtttgcctttgtttttcttccactttactaagccaaacaaacatkcattaagtaccttctgtgtgccgaaccttatttatgttgttaggttaagtgtttgtaggagtccaagatgactaagacatgggactttgctctccaggag

SEQ ID NO: 7155 - DNA, 201 bp, Homo sapiens
aggaagaattccctgtggcgtcaaagcttcctctccgggacccactgcgggacccggagcgagatccggagcgagatcccgagcgggagccggagcgggascccggagccgaagacatgttgtaagggctgggtaagcccttggacgacacggaggcggcttccagaaggcgcagcccagtgatatcttctaccatggagc

SEQ ID NO: 7156 - DNA, 201 bp, Homo sapiens
atatatcatttgctaagatcatatgagcagctggtgcaagaattatgatgagaatccagatttcttgaatttttgcctagtcactctttgcatgtatgtcygtgtgtgtaaagagaaatgagaatgcacattggtctgggaggggaaaagtactgcttctttcttggaatgtgaggtgtttttcttttgacataatctctg

SEQ ID NO: 7157 - DNA, 201 bp, Homo sapiens
aacatggatttggacacatcctggtgaaactgtatttcctctaaaggtttagtgtaatactgcttgtttgtaagtctggggttacttccatgctccaataygctgctttaaatgaacttaagtaatagtcataatattgcaacaactttgccaaacaaaagtcacttgatttaatgtttggttaaggaatttgctttattt

SEQ ID NO: 7158 - DNA, 201 bp, Homo sapiens
atttctctaagacctagggaatcctaaatgatgtctttaaactttaagacaattttctaacacgtgagtctttaagtgaccctgatctgggctttcctttrtggagacggtgctgccaggccagcaagggtttgctttccaaccgcctaggaaaaagtccccatgggtgaaatatctcatagagctagtaattctttcttt

SEQ ID NO: 7159 - DNA, 201 bp, Homo sapiens
aataggtattctaggaacatcttgaaaggagaatgggtttgttttgcgataaagacaatgtatttaaattttccatcactttcttcacaccatgatttttwaaaaaaacattattgtcttttacaggaattacagaaaatatatatatatatttttacagacagggtctcactctgtcaccgaggcaagagtgcagtgctg

SEQ ID NO: 7160 - DNA, 201 bp, Homo sapiens
actacagtaggctgtgctgtggcataatatatcttggtaaatttaaaagccagactttggttataccttgcttgaagagcaaatgaaactctgtcatctckttctttaagatacagaccatctgcaacattttccgccaacaccaccgttgttttaaggtttctgctaggtgtcttccagaaaagtgcctcatttgaaatg

SEQ ID NO: 7161 - DNA, 201 bp, Homo sapiens
caacttcttgtagcacatccgtgaggacttttcacagacattaaataatcacttggtctgctttaaatctctctgaaaccaaactacagtaggctgtgctrtggcataatatatcttggtaaatttaaaagccagactttggttataccttgcttgaagagcaaatgaaactctgtcatctcgttctttaagatacagacc

SEQ ID NO: 7162 - DNA, 201 bp, Homo sapiens
aaaatgtgccaagcaatagaaggaatgaaaacttgggttttcattacatttgttttaaaattttgccagccatttaaatctgaaatttaaattttctcccscagtcctccaggatttgagatgcacatcctttaaatgtgtgggttacacacagtttaaatccaagtcagaatagaatgcgaaggactctttagtagctct

SEQ ID NO: 7163 - DNA, 201 bp, Homo sapiens
agcccccgcgggcgagcgcacctggggccctgcctctgagccttttgtttcctcctttttaaaaacaccggatgaaagaccccagtgtgccttggatcgcmgagcgccggccgcatgtctgctttgatccagaatgtgtgggcaggggagtgggggggtgggagaggacgacgctgggggcccgccctggcctaggcgccc

SEQ ID NO: 7164 - DNA, 201 bp, Homo sapiens
aatttcagaaccataacaacagcagcagcctccgcaagtaagagctatcactaagtgaggtctccgcctctgcagtgcccctctgagcctcacctcagccycaggaggggggtgttctacctgtcacagaggcagaagctccaggcactgccagtggatgtcactttaagttgctcaaggtcacaggctgtataactggaa

SEQ ID NO: 7165 - DNA, 201 bp, Homo sapiens
aaccctttcatagtcgatcctcaggcgtgtcagttcttgctcctgaaccttcagtttgtttattgtctccgtcgcactactgtttgctttctgcaggtcayactggaccctttgtaatctcgcgttttcatcttccaggcatttccggtcatttgtttctttgtcgatcagttgttttaacctttctatctccttgttttt

SEQ ID NO: 7166 - DNA, 201 bp, Homo sapiens
aaatgtttagaaatcccacttcttaaatggggaagtggaatcagtagccctattagagattatgttaacacttgaagaggagttaaaccagaggctgaggktgtgcaaacactcatttgcagtttgtgaataagtctctttaggggtggcagtttgtttctgcggtaagcagaacatctttttgaataggggaaatgcaac

SEQ ID NO: 7167 - DNA, 201 bp, Homo sapiens
cctgtctggtggccgagtggtgctcggggctccgcagtctctaccggctcacccccaatccccagtaaccccgagaccacgactgcaacgactcctggacycctcggccacccaaggacgtttgtatcaaggctgcgcgtcccggcggcgcggggtcctgtcccgaggaggcgcttcggcttcccctgtccgggaaacgaa

SEQ ID NO: 7168 - DNA, 201 bp, Homo sapiens
acaatagaccaaaaaacagacaaaataaatttttatctgctttgacgttgttccctttcattactagctgtgagaggcaaatcttcacagactaattatgycactggcaattttatgtgcttcttttgctctttccagcttatgcacagtaagggcactgctccaggctattctccaaacagaagacatgttaaaggttta

SEQ ID NO: 7169 - DNA, 201 bp, Homo sapiens; identical to SEQ ID NO: 550

SEQ ID NO: 7170 - DNA, 201 bp, Homo sapiens; identical to SEQ ID NO: 571

SEQ ID NO: 7171 - DNA, 201 bp, Homo sapiens
ttccttctcctaacccttaatttaaaaataacttatttaacttctacagacaatatttgtgtgtggctgggttggtgtgtgtgtgtgtgtgtgtgtgtgtrtatatctatatattatatatataattatataattacataatatatatttatctataatatatattttatataatatatatcttcatatatttgtattgct

SEQ ID NO: 7172 - DNA, 201 bp, Homo sapiens
atataatttatgaaatcataagcttttgattttgaaagaaattacctcattttacagatgaggtagctcagactcaaagataatatatcatttgctaagakcatatgagcagctggtgcaagaattatgatgagaatccagatttcttgaatttttgcctagtcactctttgcatgtatgtctgtgtgtgtaaagagaaat

SEQ ID NO: 7173 - DNA, 201 bp, Homo sapiens
aaacaaactaaaagctgtttgattgcttactgcaggttcgctctgggatttgctgtggctcctttcctcttatcgcttgttcccctgcatgctttacctcrttcccaggagactgagctgcagggcccagctgataagggaactgttgccccagcagccagtcaggaggcaggcactcctgagccaggtttttgttttgtt

SEQ ID NO: 7174 - DNA, 201 bp, Homo sapiens
ccttggcctcccaaagtattgggtttacaggtgtgagccaccacgcccagccagttttatgtcgttttctaacagaagcaattgataagcgatgctttccrggttaggcacgcagccctcatggttgcaaacaaactaaaagctgtttgattgcttactgcaggttcgctctgggatttgctgtggctcctttcctcttat

SEQ ID NO: 7175 - DNA, 201 bp, Homo sapiens
tcctttgaaggcagcacaaatgttcccaaggaaaggtttgcttacttggtattttgcaactttattatgtatctctaatacaaagtgaccatttcattatrggtgttaactgtacctccctttagaggacagaaagccctttggcatggcatttgactttttttttttttttttttttttttgagacagggtctcgctctg

SEQ ID NO: 7176 - DNA, 201 bp, Homo sapiens
tcgcagagcgccggccgcatgtctgctttgatccagaatgtgtgggcaggggagtgggggggtgggagaggacgacgctgggggcccgccctggcctaggygccccgggaagaccccccggtgagagggtcagcttctccggatcccagcggaaacagaccgagggcgtcatttgggtgggtggggaagagatcctgtccc

SEQ ID NO: 7177 - DNA, 201 bp, Homo sapiens
taccggctcacccccaatccccagtaaccccgagaccacgactgcaacgactcctggactcctcggccacccaaggacgtttgtatcaaggctgcgcgtcycggcggcgcggggtcctgtcccgaggaggcgcttcggcttcccctgtccgggaaacgaaacttccccgccggggcggctgccgggcccgggtctcgaagt

SEQ ID NO: 7178 - DNA, 201 bp, Homo sapiens
ccttttggttgttcacaagataatgtcacttgaagggaaccactgaagaaaacagaggttttgttttttgtgtaagttaggcgtaacagatgctcttttcrtggactgcctgtatgcagctttgttagaaatggaaggagaatgcatcacgatagccaaccctgtgcaggccaggtgccatccagggtcttagagaaacgg

SEQ ID NO: 7179 - DNA, 201 bp, Homo sapiens
tttcagaaactggaaaatatcaatggtgttacagatggctacttaaataggtaaactcagctaacactaatctcatattttccttttctcaagcttctttytctgggtcttcatttgctttagatgcttgccttacagtttctctgttactagagatttacttacatccttctgtggtttggagagcatgttaattccgct

SEQ ID NO: 7180 - DNA, 201 bp, Homo sapiens
gacaagcggaaaatacagtctcagttcaccgatgcccagaagcattaccagaccctggtcattcagctccctggctatccccagcaccagacaggtcggcytgggacatctttctctttgtatcaaccatccataccattttaaaaagaaaggagtttgcataaaactggtttcagaaccatttctctgaatgctatatag

SEQ ID NO: 7181 - DNA, 201 bp, Homo sapiens; identical to SEQ ID NO: 558

SEQ ID NO: 7182 - DNA, 201 bp, Homo sapiens
tgaactacttacaagatctggagactattacaggttcttaagtgagatgctgaagagtttggaagatctgaaggtaatttatactgtcttttcttgtagcrtcaaaaaagaaaatagaatagaaccttattattacttccacattataacatggatttggacacatcctggtgaaactgtatttcctctaaaggtttagtg

SEQ ID NO: 7183 - DNA, 201 bp, Homo sapiens
acattgaactacttacaagatctggagactattacaggttcttaagtgagatgctgaagagtttggaagatctgaaggtaatttatactgtcttttcttgkagcatcaaaaaagaaaatagaatagaaccttattattacttccacattataacatggatttggacacatcctggtgaaactgtatttcctctaaaggttt

SEQ ID NO: 7184 - DNA, 201 bp, Homo sapiens
ccaacagttcaaccttcttgctgtgtagcagtgcttttgtgtctcgtcaagcaagtcagctcagccctccttagaggttctggtctgtccaatagagaacrggagggattagcatatggctgattatgagagaaagaagcaatactaattcaggtggcctgacaagcaagccagaagtgcctgtggaaaagtcatgcactc

SEQ ID NO: 7185 - DNA, 201 bp, Homo sapiens
aagcactgggattacaggtgtgaaccactgtgtccggccaatatttttgtagagtaagcttttttctcctctcctacctttccttcagcccgacttgccastgaaatcttcatgctctgtgtctgacaccatgaggtcttcctgcagagggacttgtggtgttggggactgtcattagggaccgctgtgggatgaagcagg

SEQ ID NO: 7186 - DNA, 201 bp, Homo sapiens
ttctggattggatcctggacctgggaggggaaaacttgctgtgaatgacattattgggctaattggtgaaatctgaacaagttctataaattagaaaatcrtttgtgtcaattgtaaattttctgcttctcatcattgtattgtggttatatataagtgaatgtttttattcttaggaatgatatgctaagatatttgggg

SEQ ID NO: 7187 - DNA, 201 bp, Homo sapiens
ttatatataagtgaatgtttttattcttaggaatgatatgctaagatatttgggggttaaaaagccatgttctcaaatgattcagaaaaaaataatatgtrtacatagataaatatatgctgaaatatttgggggtagaagggcatggttattctcaagtggttcagaaaaaataatatatacacacagataaatacacac

SEQ ID NO: 7188 - DNA, 201 bp, Homo sapiens
tttgcaaaagcatggatgaatgtgggggacattatgctaagtgaaatacaccagacacaaatactgcttgatttcacttatgtgtaaattctaagaaaaargttgaatgcagggaaacagagagtaggatggtgattaccggggtggggagggaggaggaaatgggaagatgtaaaggatacaaacttgcatttgtgtggg

SEQ ID NO: 7189 - DNA, 201 bp, Homo sapiens
atggatgaatgtgggggacattatgctaagtgaaatacaccagacacaaatactgcttgatttcacttatgtgtaaattctaagaaaaaagttgaatgcakggaaacagagagtaggatggtgattaccggggtggggagggaggaggaaatgggaagatgtaaaggatacaaacttgcatttgtgtgggatgaataaatc

SEQ ID NO: 7190 - DNA, 201 bp, Homo sapiens
tcacttctgcctgtctcctttcagctgaaaacaatgcggcaggaagattacatgaagacgatagccgaccttgagttacattaccaagagttcatcagaartagccaaggctcagagatgtttggagatgatgacaagcggaaaatacagtctcagttcaccgatgcccagaagcattaccagaccctggtcattcagctc

SEQ ID NO: 7191 - DNA, 201 bp, Homo sapiens
cctgtgatgagtgttgctttgagtcccatctagtgggtggcattttttggccaactcttcttgattgcattgtggggcagtcataaatcccaaatcacttytgcctgtctcctttcagctgaaaacaatgcggcaggaagattacatgaagacgatagccgaccttgagttacattaccaagagttcatcagaaatagcca

SEQ ID NO: 7192 - DNA, 201 bp, Homo sapiens
aaagccaaaccctggggttgcttgccttacagaaaatcgtgcataagggggatgagtgtatcctgaaggacaacaacgagcgcagcaagtggtacgtgacrggcccgggaggcgttgacatgcttgttccctctgtggggctgatcatccctcctccgaacccactggccgtggacctctcttgcaagtaagtcatccaag

SEQ ID NO: 7193 - DNA, 201 bp, Homo sapiens
aggctaagacagctgacattttcttgtttcaggcctatatggacactctgcagacgcagtggagttggattcttcagatcaccaagtgcattgatgttcayctgaaagaaaatgctgcctactttcaggtttttatatttagtgataattttgttgttatttaggtcttaatacctaatcttttgagtgtgttttataaag

SEQ ID NO: 7194 - DNA, 201 bp, Homo sapiens
tttcagccttaaaaatgctgtgattcttgaggaaaacagcgtgattctttggcattgttcatttccaaaatgcagttttgtatttcacttttaaaaagtamtgtgggggtgatggaagtttaatgatgacttgctgcaaaggatttcttatttcttcattcacagatacgcatgagtcaactggaagttaaagaaaaagag

SEQ ID NO: 7195 - DNA, 201 bp, Homo sapiens
gctgcagaacatcattcaggccacgtccagggagatcatgtggatcaatgactgcgaggaggaggagctgctgtacgactggagcgacaagaacaccaacwtcgctcagaaacaggaggccttctccgtaagttcaccccacgcggctgtagatgcttgtcttgagcctgttgccttgaagagctggggtctcggggaatg

SEQ ID NO: 7196 - DNA, 201 bp, Homo sapiens
ttgtggagacggtgctgccaggccagcaagggtttgctttccaaccgcctaggaaaaagtccccatgggtgaaatatctcatagagctagtaattctttcyttctatggagggatctgaggccagtatctgaagaaaaggaggcttagaagggccactcttttctatacaatccacaaggggatttatatctacctgcttt

SEQ ID NO: 7197 - DNA, 201 bp, Homo sapiens; identical to SEQ ID NO: 573

SEQ ID NO: 7198 - DNA, 201 bp, Homo sapiens; identical to SEQ ID NO: 553

SEQ ID NO: 7199 - DNA, 201 bp, Homo sapiens; identical to SEQ ID NO: 560

SEQ ID NO: 7200 - DNA, 201 bp, Homo sapiens; identical to SEQ ID NO: 569

SEQ ID NO: 7201 - DNA, 201 bp, Homo sapiens; identical to SEQ ID NO: 552

SEQ ID NO: 7202 - DNA, 201 bp, Homo sapiens
aagatcattttcactggcgaaacttacagtttttgtcatgtttacagtggaagctcttgcttccattaatgcccatgaaggttttcttcctggtagtatgygttttccttcatgtgagtgttttctttcaggaattgaagtatggagatggaatacaactgactcggagtcgagaattggatgagtgttttgcccaggcca

SEQ ID NO: 7203 - DNA, 201 bp, Homo sapiens
gggcctattcactgacctctttcacgtagtgtttagagacacgctttttcagaacagactacagagagatgtgtgtcttcttaacctatttgtaatgttgktttaacaatgagaaccagctttcagacagttccccgtccccctcccaacaaatgtttacactacagattgccacctttttggaaataaagcaatttatga

SEQ ID NO: 7204 - DNA, 201 bp, Homo sapiens
ctgacctctttcacgtagtgtttagagacacgctttttcagaacagactacagagagatgtgtgtcttcttaacctatttgtaatgttggtttaacaatgrgaaccagctttcagacagttccccgtccccctcccaacaaatgtttacactacagattgccacctttttggaaataaagcaatttatgatttacgtgact

SEQ ID NO: 7205 - DNA, 201 bp, Homo sapiens; identical to SEQ ID NO: 551

SEQ ID NO: 7206 - DNA, 201 bp, Homo sapiens; identical to SEQ ID NO: 568

SEQ ID NO: 7207 - DNA, 201 bp, Homo sapiens
cgcggatcaacactctgggccgcatgatccgcgccgagtctggcccggacctgcgctacgaggtgaccagcggcggcgggggcaccagcaggatgtactaytctcggcgcggcgtgatcaccgaccagaactcggacggctactggtgggtacctgcccggagagcgcgggctgcggggctcgcgggacagggagggaccg

SEQ ID NO: 7208 - DNA, 201 bp, Homo sapiens; identical to SEQ ID NO: 575

SEQ ID NO: 7209 - DNA, 201 bp, Homo sapiens
gctctctgctaagtgaatgatgattaagaatttcataagtatttttctgacccgaaggttttctaaataaaggtttttgtggttttcttttctttctttctttttttttttttagcatgaaaactagtataaaaactattggttgactttaaactcatttatttcaaaaactgctactttatggctgaattattaatagat

SEQ ID NO: 7210 - DNA, 201 bp, Homo sapiens
actgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtg

SEQ ID NO: 7211 - DNA, 201 bp, Homo sapiens
ctgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtgc

SEQ ID NO: 7212 - DNA, 201 bp, Homo sapiens
gaaaactccttgcagaaggctgtaacttttgaagttctgaacttttgaaggatggctaacacagcatttcagctgatgtatatagagagtgtttaatgaatttttttttttttgagacggagttttgctcttgttgcccaggctggagggcaatggcgcgatctcggctcactgcaacctccacctcccaggttcaagcga

SEQ ID NO: 7213 - DNA, 201 bp, Homo sapiens
gcctcccaggttcaaccatctcatctcagcctcccatctcagcctcccgagtagctgggacttacaggcgtgtgccttcatgcccagctgttttgtttttktttttttttctgtagagatggggtttcgccatgttgcccaggctgatcttaaactcctgggttcaagcaatccggcggcctctgcctcccaaagtgctgg

SEQ ID NO: 7214 - DNA, 201 bp, Homo sapiens
ggctgggagtggtgcctcccatctgtaatcccagcactttgggaggccaaggcgggtggatcccttgaggtcaggagtttgagaccaggctggccaaaatktggtgaaaccctgtctctactaaaaatacaaaaattagctttgcgtggtggcagtgtgcctgtaatcccagctacttgggaggctgaggcagaagaatca

SEQ ID NO: 7215 - DNA, 201 bp, Homo sapiens
tctctactaaaaatacaaaaattagctttgcgtggtggcagtgtgcctgtaatcccagctacttgggaggctgaggcagaagaatcacttgaacccaggakgtggaggttgcaatgagctgagattgtgccactgcactccagcctgggcgacagagtgagactccttctcaaaaaaaaaaaacaggcatgtttcctgaag

SEQ ID NO: 7216 - DNA, 201 bp, Homo sapiens
tgaggcagaagaatcacttgaacccaggatgtggaggttgcaatgagctgagattgtgccactgcactccagcctgggcgacagagtgagactccttctcaaaaaaaaaaaacaggcatgtttcctgaagcaagctctcctggctctcgtgctgaagaatccagtgctacacatacagctggtgtatgtctgacatcagac

SEQ ID NO: 7217 - DNA, 201 bp, Homo sapiens
aagatgctgtgcaaaacatgtaagttttttagtggatatcaggaacatatgagacagggcgcggtggctcacgcctgtaatcctaacactttgggaggccraggtgggcagatcatttgaggtcaggagtttgagaccagcctgaccaacatggtgaaaccccatctctattaaaaatacaaaaaaaaaaaaatagctggg

SEQ ID NO: 7218 - DNA, 201 bp, Homo sapiens
tcaggaacatatgagacagggcgcggtggctcacgcctgtaatcctaacactttgggaggccgaggtgggcagatcatttgaggtcaggagtttgagaccrgcctgaccaacatggtgaaaccccatctctattaaaaatacaaaaaaaaaaaaatagctgggcgtggtggtgcatgcctgtagtcccagctactccagag

SEQ ID NO: 7219 - DNA, 201 bp, Homo sapiens
gggagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggc

SEQ ID NO: 7220 - DNA, 201 bp, Homo sapiens
ggagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggct

SEQ ID NO: 7221 - DNA, 201 bp, Homo sapiens
gagaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggctg

SEQ ID NO: 7222 - DNA, 201 bp, Homo sapiens
agaattcccacattactgtgatcttatcccatctatgcataatgcaaccattgtttgtcaaacatttttttttaaacagtgaaattctttctttaaaacacacacacacacacacacacacacacacacacacacacacacacacacacacacacacccagttggttagacaggcatcagataaaagcaggctcaggctgg

SEQ ID NO: 7223 - DNA, 201 bp, Homo sapiens
aaattttctgcttctcatcattgtattgtggttatatataagtgaatgtttttattcttaggaatgatatgctaagatatttgggggttaaaaagccatgwtctcaaatgattcagaaaaaaataatatgtatacatagataaatatatgctgaaatatttgggggtagaagggcatggttattctcaagtggttcagaaa

SEQ ID NO: 7224 - DNA, 201 bp, Homo sapiens
aaccagatgaatttacgggctctgtttagataacattttaatattctaatttcttaatttagatattgtgtgggttctagttctgaatttcttcatccagktaaaaaaagaatgtcacgttagtccatgttcagagatatttggggctcagcaaactagcttggctccagttctagttgtttcgagtgtctgatttgaaac

SEQ ID NO: 7225 - DNA, 201 bp, Homo sapiens
atttcttcatccagttaaaaaaagaatgtcacgttagtccatgttcagagatatttggggctcagcaaactagcttggctccagttctagttgtttcgagygtctgatttgaaacatactccttgaaatgttcctcgcagtggcccgattcctttacacaaaacaaaatagcagacaccagtgacttaatagtgaacatac

SEQ ID NO: 7226 - DNA, 201 bp, Homo sapiens
tcaaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaagggga

SEQ ID NO: 7227 - DNA, 201 bp, Homo sapiens
caaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaaggggaa

SEQ ID NO: 7228 - DNA, 201 bp, Homo sapiens
aaaaaaataaaaataaaaataaaaaaagaactaaaacattatgttctcataaggtataggaaaaactctgtgcataagaggccccatctgtaccactgtaccataatggtacagtgtccttgtcacaatgagattcccattatatgagacttgtgtgtaaatatgaaagatcagcatttaacatactgaagcaaggggaag

SEQ ID NO: 7229 - DNA, 201 bp, Homo sapiens
ttgtatttatgttgggtgtagcttaagaatgtagtaaatgctcaatgtctttaaattttggaaaagtattaccacatgaattcagttttatgtcattttcttttttttttttttgagagggagtctcactctgttgcccaggcaggagtgcagtggcatgatctcgtctcactgcaacctctatctcccgggttcaagcaa

SEQ ID NO: 7230 - DNA, 201 bp, Homo sapiens
tgtatttatgttgggtgtagcttaagaatgtagtaaatgctcaatgtctttaaattttggaaaagtattaccacatgaattcagttttatgtcattttcttttttttttttttgagagggagtctcactctgttgcccaggcaggagtgcagtggcatgatctcgtctcactgcaacctctatctcccgggttcaagcaat

SEQ ID NO: 7231 - DNA, 201 bp, Homo sapiens
ttaagaatgattaaatgagtattttataacatatcatacatatatatgcacacatatgttctgtgcacatgcttgcttgcctgtgcacaggtagatttggttttttttttttttcagaagacatgatcttggttttcaggttcccatttctaaatttccttctctgcccatcttgagctggggtcaagcaagttgagggaa

SEQ ID NO: 7232 - DNA, 201 bp, Homo sapiens
gggttgagaattacagcataaaatcataactgatcttaagtgcttagtttcccgcaggtctctacacttgtaaatcactaaactttttttttttttttttwcctgagaccatagcttctcatcctcatttcttcttctggctttttggggcttacttttgtccacctgagcccctgaccaactttctccttcatttctcta

SEQ ID NO: 7233 - DNA, 201 bp, Homo sapiens
gtaaatgaatgagtgtgcctgtattccaataaaactttatttacaaatagaagtgggccacatgtggcccttgagctatagtttggtgaccgctgccctakactgccatctttgggccacgctcaaggctgacattagctggtaccactggtatggccatactgcttgttaaaaaacacagaaagttccatatcagttggt

SEQ ID NO: 7234 - DNA, 201 bp, Homo sapiens
ctctgcctcctgggttcaagtgattctcccgcctcagcttcctgagtagctgggattacaggcatgcaccaccatgcccggctaattttatatttttagtrgagacagggtttctccgtgttggtcaggctggttttgaactcccgatctcaggggatctgcccggctcggcctcccaaagtgccaggattatgggtgtga

SEQ ID NO: 7235 - DNA, 201 bp, Homo sapiens
tccagtgtgagtcattgatgtatgatacattttcagaaatgatcaggaatctgttatttagagtctttgtagaaattgggcttaaatttctgggtttgatragacttctaaaaagtggaaaatacagaaatttctaaaagacagcctcttctcaaagatgtcagagactatcgtacctgtcagatggtttaggggaaacag

SEQ ID NO: 7236 - DNA, 201 bp, Homo sapiens
ttgaccgggtctcgggagctggactctagatgcccacgtgagccgtgcgcgttttgcagcccgccccacctccccgccccctgctagttgttcccacgtcsggcttttgggaaagaggccctgagcgccgggacgttatttaccaggcgttgtggccctaggcctgggaggagcaacctgaatgcgctccagggagttttg

SEQ ID NO: 7237 - DNA, 201 bp, Homo sapiens
actgcaacctctatctcccgggttcaagcaattctcctgcttcagcctgccgagtatctgggactacaggcgtgtgccaccatggcaagctgattttttgyatttttagtagagacgggggttttgccatattggtcaggctgatctcgaactcctgaccttgtgatccgcccgccttggcctcccaaagtattgggttta

SEQ ID NO: 7238 - DNA, 201 bp, Homo sapiens
cacacacacacgtcatttgtagtgactatggatacgttttacatgtagctctgaaaattttgcatggcctcatgttctcagtttatttttgcttatatgcrtcaacgtgcaataaataaaaacaggttagggaaatagtgtcatatttgctaacatttctgtttagagaaaagaggttcatttgactaaagccaagtaaaa

SEQ ID NO: 7239 - DNA, 201 bp, Homo sapiens
gtgcgcgttttgcagcccgccccacctccccgccccctgctagttgttcccacgtcgggcttttgggaaagaggccctgagcgccgggacgttatttaccrggcgttgtggccctaggcctgggaggagcaacctgaatgcgctccagggagttttgttttgcaagcagttttgaaggcagggactactcgagttgcaacc

SEQ ID NO: 7240 - DNA, 201 bp, Homo sapiens
catgatctcgtctcactgcaacctctatctcccgggttcaagcaattctcctgcttcagcctgccgagtatctgggactacaggcgtgtgccaccatggcmagctgattttttgcatttttagtagagacgggggttttgccatattggtcaggctgatctcgaactcctgaccttgtgatccgcccgccttggcctccca

SEQ ID NO: 7241 - DNA, 201 bp, Homo sapiens
acttctttttacagtgaccacaactgaaatcactcatcatggaacctgccaagatgtcaaccataataaagtaattgaaaccaacagagaaaatgacaagyaagaaacatggatgctgatggagctgcagaagattcgcaggcagatagagcactgcgagggcaggatgactctcaaaaacctccctctagcagaccaggg

SEQ ID NO: 7242 - DNA, 201 bp, Homo sapiens
ttgaacctcctgtgcagaaagcgtcctttgagaggatggatcacctgcgacagctgcagaacatcattcaggccacgtccagggagatcatgtggatcaakgactgcgaggaggaggagctgctgtacgactggagcgacaagaacaccaacatcgctcagaaacaggaggccttctccgtaagttcaccccacgcggctg

SEQ ID NO: 7243 - DNA, 201 bp, Homo sapiens; identical to SEQ ID NO: 576

SEQ ID NO: 7244 - DNA, 201 bp, Homo sapiens
tggatcacctgcgacagctgcagaacatcattcaggccacgtccagggagatcatgtggatcaatgactgcgaggaggaggagctgctgtacgactggagsgacaagaacaccaacatcgctcagaaacaggaggccttctccgtaagttcaccccacgcggctgtagatgcttgtcttgagcctgttgccttgaagagct

SEQ ID NO: 7245 - DNA, 201 bp, Homo sapiens
ctattctccaaacagaagacatgttaaaggtttatgaagccaggctcactgaggaggaaactgtctgcctggacctggataaagtggaagcttaccgctgwggactgaaggtaacttgaaagcttataacagtggcccaacttacaggaactaattcagatctgagctcccaattataaagcctcactgggttttcatgag

SEQ ID NO: 7246 - DNA, 201 bp, Homo sapiens
atgcttttgctagcttggatttcttatcttttaaatagacaataatcagtactattaatcgaatatttcactcccttggcttcttataccttttgtagggragtaaaactttaataaattaagtggttaatgaactgcatcaaggtacatgttttattaggattccccattgaaacatttaattttgggcaggctccatgt

SEQ ID NO: 7247 - DNA, 201 bp, Homo sapiens
ctcggtctgtttccaaagggaattcttggccacacctaagactgaagttggattcttacagatgaaagatagaagtagaccttgttttaaggatcagacgyggtcttgaaaagttgtgtatatgatgaaatttcgttaatcagatcacacttcccaatagacaaataatgatatcaaagattctttatttcattgttccaa

SEQ ID NO: 7248 - DNA, 201 bp, Homo sapiens
tatgatgagaatccagatttcttgaatttttgcctagtcactctttgcatgtatgtctgtgtgtgtaaagagaaatgagaatgcacattggtctgggaggrgaaaagtactgcttctttcttggaatgtgaggtgtttttcttttgacataatctctgatttcattccacagctgaaaaataccaagatcgaagttttgga

SEQ ID NO: 7249 - DNA, 201 bp, Homo sapiens
ggctgaggcaggagaatcacttgaacccaggaagtggaggttgcagtgagccgagatcatgccactgcactccagcctgggtgacagagcaagactccatytcggaaaaaaaaaaaaaaaaagaacatatggaaatggaaatcctttagaaaagcacgaagaatttatttggtattattagcagcatataaagttacctgt

SEQ ID NO: 7250 - DNA, 201 bp, Homo sapiens
ctcttttttttcttatcaccccgcctccattttgctgcaggacatccttaaagttatggactggggcaaagacaaaacacaaaaacgaaatttctgccggrcgcggtggctcacgcctgtaatccagcactttgggaggccgaggtgggcggatcacaaggtcaggagttccagcccagcctagccaatatggtgaaaccc

SEQ ID NO: 7251 - DNA, 201 bp, Homo sapiens
cctcatggttgcaaacaaactaaaagctgtttgattgcttactgcaggttcgctctgggatttgctgtggctcctttcctcttatcgcttgttcccctgcrtgctttacctcattcccaggagactgagctgcagggcccagctgataagggaactgttgccccagcagccagtcaggaggcaggcactcctgagccaggt

SEQ ID NO: 7252 - DNA, 201 bp, Homo sapiens; identical to SEQ ID NO: 570

SEQ ID NO: 7253 - DNA, 201 bp, Homo sapiens
ggtgtagcaggtatgataacctgaaacaaaactccccacattttttcaaagcataattattgttaagagtaagacaggtctgcaacttacagttccttctrtagaaaaaaatagtaagtatgaagccatttattgaagtggcaacatatacagaatttttcccacaaatttgtaaaataacaagctcacagtgtatccagg

SEQ ID NO: 7254 - DNA, 201 bp, Homo sapiens
gacagtgataaaaatgcaaccatcttggaactaaggagccagctgcagatcagcaacaaccggaccctggaactgcaggggctgattaatgatttacagakagagagggaaaatttgagacaggaaattgagaaattccaaaagcaggctttagaggtattcacaaatacttgatcacagcttcactgtttctcaaattat

SEQ ID NO: 7255 - DNA, 201 bp, Homo sapiens
catatgagcagctggtgcaagaattatgatgagaatccagatttcttgaatttttgcctagtcactctttgcatgtatgtctgtgtgtgtaaagagaaatragaatgcacattggtctgggaggggaaaagtactgcttctttcttggaatgtgaggtgtttttcttttgacataatctctgatttcattccacagctgaa

SEQ ID NO: 7256 - DNA, 201 bp, Homo sapiens
tcccattacagggtaccactttaagaggtttaatagcaggttatgtgccctccagtgtgagtcattgatgtatgatacattttcagaaatgatcaggaatstgttatttagagtctttgtagaaattgggcttaaatttctgggtttgatgagacttctaaaaagtggaaaatacagaaatttctaaaagacagcctcttc

SEQ ID NO: 7257 - DNA, 201 bp, Homo sapiens
tcagtccccttctggggtgattctgcaagaggtatatatgtcatcacatatctcttaaaacctgcccctccttctgcttcttcccttttccctgtctcctrcctcttcccttttccctgtctcctgcctgtcttccttaccattgctgatttcatcccattacagggtaccactttaagaggtttaatagcaggttatgtg

SEQ ID NO: 7258 - DNA, 201 bp, Homo sapiens
actttgcgccaattcaattaaggtatgttggtttcataaagaatgttggtatttcaccaagattattattaactgcatgacttgctgatttgttgtaaagmgtatacacttcctgaggatagcaattacggtctgtatatattcttttctgaacaaaccataaaaattaaaaatctattagcttgaattcattccacattg

SEQ ID NO: 7259 - DNA, 201 bp, Homo sapiens
taacattggtaaatatttcactttttgtatagaacttgcacagtgaaatatctggcaaacgagacaaatcagaggaagtacaaaaaattgctgaactttgygccaattcaattaaggtatgttggtttcataaagaatgttggtatttcaccaagattattattaactgcatgacttgctgatttgttgtaaagagtatac

SEQ ID NO: 7260 - DNA, 201 bp, Homo sapiens
cctcttacagatagtaagttaaagggcttgcttctcttctctgaatggaaaaaatgctcatctcctaagctgtaactataaaaatatgagacaagtacatrtagtaataaactgaaaaaagggtacaaataacagtggtaaaagagtgaaatcacatttatttaaaaatatttgtatgcattaacattggtaaatatttca

SEQ ID NO: 7261 - DNA, 201 bp, Homo sapiens
ccagaacttgagaattcttcagcgaatacaaaatgttggtctgaatcacaatagaccaaaaaacagacaaaataaatttttatctgctttgacgttgttcyctttcattactagctgtgagaggcaaatcttcacagactaattatgtcactggcaattttatgtgcttcttttgctctttccagcttatgcacagtaagg

SEQ ID NO: 7262 - DNA, 201 bp, Homo sapiens
caaaacatcattagtagacacatgactatacacacacacagtggggtactatttacctttaaaaaagaaagagatcctggggccaggtgcggtggctcacrcctgtaatcccagcactttgggaggccgaggcgggtggatcacaaggtcaggagttcaagaccagcatgaccaacatggtgaaaccccatctctactaaa

SEQ ID NO: 7263 - DNA, 201 bp, Homo sapiens
aagaaacatggatgctgatggagctgcagaagattcgcaggcagatagagcactgcgagggcaggatgactctcaaaaacctccctctagcagaccagggrtcttctcaccacatcacagtgaaaattaacgagcttaaggtaggtatctgctagtattttgcctggttaccctgtatatttttatttacctgtaaatgaa

SEQ ID NO: 7264 - DNA, 201 bp, Homo sapiens
cagtgttcttcgtgcactaaattttcagaattgattctgaaattcaaaggaagaaggtatacttttaggtagtatggatgttttttgaggcctagcacctwgatacctaggtattctctgatttttgtggccctaacttctttttacagtgaccacaactgaaatcactcatcatggaacctgccaagatgtcaaccataa

SEQ ID NO: 7265 - DNA, 201 bp, Homo sapiens
gaccctggtcattcagctccctggctatccccagcaccagacaggtcggcttgggacatctttctctttgtatcaaccatccataccattttaaaaagaarggagtttgcataaaactggtttcagaaccatttctctgaatgctatatagccagtgttcttcgtgcactaaattttcagaattgattctgaaattcaaag

SEQ ID NO: 7266 - DNA, 201 bp, Homo sapiens
agataattcagaatgtacttttggggagtaaatgaatccaaatccatgaactgttttcaaagttatacctctacctgttactttatcagtgactgttgtargtttttgtgcagtggtgtgagcgtgtccaggtttcccatttgggatgaagtgtgaaagcctggctctagcatgttttccctttgtgcctcttaggattga

SEQ ID NO: 7267 - DNA, 201 bp, Homo sapiens
taccttttaggctcacatgtattatttaaagcatcggtattgttgggttgtatgatgatcagcttcatttgaggggaaaaacgtaaaagctttaataattygcatgtgttcatctctgtttccatcattgagaaaaaaaataaaaacacatacttatgaataaagccaaaccctggggttgcttgccttacagaaaatcgt

SEQ ID NO: 7268 - DNA, 201 bp, Homo sapiens
tgcagttggctctgattagtattattgtacaatgcacgcccagagccaagcaagcattttcttcagcttccagtggcttttctcaaaattaacttctttayatgcccaactactcttgacagttacttttgcttcagtctgggcaattggttgaaaataagaacagagagaacattacttcacatgacaattcctttggga

SEQ ID NO: 7269 - DNA, 201 bp, Homo sapiens
aagaactggtacgttcagataacccaggatgtgtgtggcactgcaggagggtgggtggaagcctgggattagaaaacctcaggatggatgtagctcttctytcctcctgtgtcatcttgagtaagcctccgccacatcctctcctgtagcaaacatccttttcagccttaaaaatgctgtgattcttgaggaaaacagcgt

SEQ ID NO: 7270 - DNA, 201 bp, Homo sapiens
gaggtggaaggagggagaggatcaggcaagataactaatgggtactaggcttaatcgtgggtgatgaaataacctgtacaacaaatccctgtgatacaagwttacctgtgtaacaaacctgcacatgtatccctgaacttaaaataaaagttaaaaagaaaaagaggggcaataccttgtttaatatcccagaagaccgta

SEQ ID NO: 7271 - DNA, 201 bp, Homo sapiens
taattattgatgggtacaaaaatacagttagatagaaggagtaagttctaatatttgatagtacaatagggatattatagttaatgataatttattgtatrtttcaaaatagcttgaagaaaatatttgtaatgttcccaacacacagaaaagataaatgttcgaggtgatggatatcccacttatcctgatttgatcatt

SEQ ID NO: 7272 - DNA, 201 bp, Homo sapiens
tgctgttctgttttcaagttgtgtcacataaatggcacttgttaagtacttgcagttgaagcaagaaaacgttgccacttgtgaattgtggtcttttttaygaagtgtaagcaaaaataaaagttatttttctcaagatagaggtctaccagatcgtcatcacaattttatgacactcagtcatatcagttacttgattca

SEQ ID NO: 7273 - DNA, 201 bp, Homo sapiens
aagtgcatcgactttctgttgtttccaattcaattcagttcaagaaatatcaagcacatcctggcggggaggcacctgttcatcgatgctaatgttgttgstgctgctgagtttcctttagaagtgaattttaaaagttgttttcttttctttttttcttttaagtagagacagggtttcaccatgttcaccatgttaacc

SEQ ID NO: 7274 - DNA, 201 bp, Homo sapiens
ccatttcattataggtgttaactgtacctccctttagaggacagaaagccctttggcatggcatttgactttttttttttttttttttttttttgagacarggtctcgctctgtcacccaggctggagtgcagtggcacaaatgtggctcgccgcagcctcaacctcctgggctcaagcaatcctcccacttcagcctatc

SEQ ID NO: 7275 - DNA, 201 bp, Homo sapiens
ttaaaaaacagagcaaacccaccaatgttttaagccaatgtttggttgccttacctcctttatcctggatgtaattcgtttctaactgtggtataactaaycagtctagttcttgggtaaaaagaagttggcaagttttatattttgtggtcaaatgaatttgatctcataaattcacttttaaaaatgtgtatgtacact

SEQ ID NO: 7276 - DNA, 201 bp, Homo sapiens
atgcgccaccacgccaggctaattttgtatttttagtagagacggggtttctccatgttggtcaggctggtctggaactcccgacctcaggtgatcctccygcctcagcctcctgaagtgttgggattacaggcgtgagccaccgtacccggctagtgaatcttagaggtaaagtatcatccttaaatgaagtattaaaaa

SEQ ID NO: 7277 - DNA, 201 bp, Homo sapiens
taccctcagatgggtcttttgtttgcctttgtttttcttccactttactaagccaaacaaacatgcattaagtaccttctgtgtgccgaaccttatttatrttgttaggttaagtgtttgtaggagtccaagatgactaagacatgggactttgctctccaggagcaggtagccaggtgtgtttaaactaatgcaagagag

SEQ ID NO: 7278 - DNA, 201 bp, Homo sapiens
acaaaaaatccaccatgtttgctcactgctggagtgggaatggggaggggagagctgtgctctctggttgagcttttgaaatcagggtaatgagatgagcmataataccctcagatgggtcttttgtttgcctttgtttttcttccactttactaagccaaacaaacatgcattaagtaccttctgtgtgccgaaccttat

SEQ ID NO: 7279 - DNA, 201 bp, Homo sapiens
tatggtgaaaccccgtctctactaaaaatacaaaaattagctgggcgtggtggcgggctcctgtagtcgcaactgctcaggaggctgaggcagaagaatcrcttgaacccgggaggcagaggttgcagcgagctgagatcatgccactgcactccagcctgggcaacagagcgagactccgtgaaaaaaaaaaagaaagaa

SEQ ID NO: 7280 - DNA, 201 bp, Homo sapiens
ggccttgttgctgcagctgggagcagtgcctcaccccttgattttctccatctccctcccgctgggctggtcccagtggccctgccgcttgaaaacgttcrgatgtggttctgattttgaagtcacggccccacagatcctaagactcagacatgagctgctcatttgaggtgacatcttgtaaaatactagtgcagtcca

SEQ ID NO: 7281 - DNA, 201 bp, Homo sapiens
acagatgggaagctgaggttaaaatatttaaatggcttgcctaaggtcacacagctagttaagttgttaagctagatttgaatccagtataccacaatgaygcaagagaagattaaacctgcagtgtgagaattcaccttttctacttgtaaacccttttctatctgagttattacttatttttaatctgttgaattcctc

SEQ ID NO: 7282 - DNA, 201 bp, Homo sapiens
aggggagatcaaggtggaaatctatagccttgaaaggagtgtaggcccttccaaggaagataagtacacgaagactagcacgcaaaagcggaatgcacagkaggggtgtacgtgacttcagagacttcacaaggaggtgagagaacatctgtcgtgggggcactgggaagactttataaaggaagtggtgtcgaactagac

SEQ ID NO: 7283 - DNA, 201 bp, Homo sapiens
tacattttaaagttagtcttaaattaggttttaagagaagcttatttcttactatgagacaaacaggtcaatttgcctgaattttagagcggggggacccmtaaggatcacttagcctaggcagaaaccccacacgcacacttcagagacaggaagctgaggacgtgccgaagatcctagaatccacttagggctgggttg

SEQ ID NO: 7284 - DNA, 201 bp, Homo sapiens
tcaagctcagggcttgagtcgggaggcggtcattctttccggggatcctggcaatggaggttcctctcgagcctgacccagcctgcagtggtgctactgastacaaaatagcccacaaatgctgacttctgcgttttcaaataatagcgaccgcctgaaggcagggcatgtcgcagtttttctggtggcattctggttttg

SEQ ID NO: 7285 - DNA, 201 bp, Homo sapiens
gtatcatcccgtgctctgtttttccaacttaaagcctacttacaaacttgtcaagtctcacatctctctgggaaggggaaagagacccaagtgaaaaattrcctgactttgaggaaggatgttttttcttctcattaatgttgctctgcccggcagcagggcgtcaagctcagggcttgagtcgggaggcggtcattcttt

SEQ ID NO: 7286 - DNA, 201 bp, Homo sapiens
accttttgtaggggagtaaaactttaataaattaagtggttaatgaactgcatcaaggtacatgttttattaggattccccattgaaacatttaattttgrgcaggctccatgttttttccttgtgtagtatcatcccgtgctctgtttttccaacttaaagcctacttacaaacttgtcaagtctcacatctctctggga

SEQ ID NO: 7287 - DNA, 201 bp, Homo sapiens
cgaaggactctttagtagctctttttggcgttttcatgaaccaagtatttattttgattattatttataactatgcttttgctagcttggatttcttatcytttaaatagacaataatcagtactattaatcgaatatttcactcccttggcttcttataccttttgtaggggagtaaaactttaataaattaagtggtta

SEQ ID NO: 7288 - DNA, 201 bp, Homo sapiens
gtcagaatagaatgcgaaggactctttagtagctctttttggcgttttcatgaaccaagtatttattttgattattatttataactatgcttttgctagcytggatttcttatcttttaaatagacaataatcagtactattaatcgaatatttcactcccttggcttcttataccttttgtaggggagtaaaactttaat

SEQ ID NO: 7289 - DNA, 201 bp, Homo sapiens
tttgtttcctgaacaaaatgtgtctggggatttccagggaaaatgtgccaagcaatagaaggaatgaaaacttgggttttcattacatttgttttaaaatkttgccagccatttaaatctgaaatttaaattttctcccgcagtcctccaggatttgagatgcacatcctttaaatgtgtgggttacacacagtttaaatc

SEQ ID NO: 7290 - DNA, 201 bp, Homo sapiens
tctcgggagctggactctagatgcccacgtgagccgtgcgcgttttgcagcccgccccacctccccgccccctgctagttgttcccacgtcgggcttttgsgaaagaggccctgagcgccgggacgttatttaccaggcgttgtggccctaggcctgggaggagcaacctgaatgcgctccagggagttttgttttgcaag

SEQ ID NO: 7291 - DNA, 201 bp, Homo sapiens
gataaatacacacacatctatggagaggggagaagggggataaaagaaacacaacaaaatgttaacaattgggattccgggtaaagggtctcacaggagtsgttttgtcccgtttttgcaacttttgcaagtttgaaattatttcagaattgaaataggttatttgatgtctggtttctctgtgtttgcctccttagtcaa

SEQ ID NO: 7292 - DNA, 201 bp, Homo sapiens
ggttagacaggcatcagataaaagcaggctcaggctggccctggctgaaggtaggaagagccaacttcttgtagcacatccgtgaggacttttcacagacrttaaataatcacttggtctgctttaaatctctctgaaaccaaactacagtaggctgtgctgtggcataatatatcttggtaaatttaaaagccagacttt

SEQ ID NO: 7293 - DNA, 201 bp, Homo sapiens
ctggaggagcctgtgtcttcttctgggagtagttcccagggaggtctgggctcctcacccacattcatctagtcctggcttgttggggagccttgcctgcmgggaggaaccccaaatgggtggccaaaaaagaaatgctttcccatggtgagacagtgcagccaggtgcttcgggagaattcccacattactgtgatctta

SEQ ID NO: 7294 - DNA, 201 bp, Homo sapiens
gccttggcttcccaaagcactgggattacaggtgtgaaccactgtgtccggccaatatttttgtagagtaagcttttttctcctctcctacctttccttcwgcccgacttgccagtgaaatcttcatgctctgtgtctgacaccatgaggtcttcctgcagagggacttgtggtgttggggactgtcattagggaccgctg

SEQ ID NO: 7295 - DNA, 201 bp, Homo sapiens
tttcagagaaaatgactatattgagataacaattctatctgagaaacagaaaaatggggaaaaataggcaatggaaaattgaggagaaatggtaacatttstgagaaccttgcgatgtttcttaagataactgagacatcctaggatctcatcgaatccagattagaaatcatggagttcgtggtatttgctgtgtgaagt

SEQ ID NO: 7296 - DNA, 201 bp, Homo sapiens
gagtattttataacatatcatacatatatatgcacacatatgttctgtgcacatgcttgcttgcctgtgcacaggtagatttggttttttttttttttcaraagacatgatcttggttttcaggttcccatttctaaatttccttctctgcccatcttgagctggggtcaagcaagttgagggaagtatttggcaaccctg

SEQ ID NO: 7297 - DNA, 201 bp, Homo sapiens
cctaggaaaaagtccccatgggtgaaatatctcatagagctagtaattctttctttctatggagggatctgaggccagtatctgaagaaaaggaggcttaraagggccactcttttctatacaatccacaaggggatttatatctacctgctttttgttgtcttctagcgcgagaaatctgcgatctaccagttggaggag

SEQ ID NO: 7298 - DNA, 201 bp, Homo sapiens
tttcataaagaatgttggtatttcaccaagattattattaactgcatgacttgctgatttgttgtaaagagtatacacttcctgaggatagcaattacggkctgtatatattcttttctgaacaaaccataaaaattaaaaatctattagcttgaattcattccacattggcagtatccatttgaatggctggtttctatt

SEQ ID NO: 7299 - DNA, 201 bp, Homo sapiens; identical to SEQ ID NO: 578

SEQ ID NO: 7300 - DNA, 201 bp, Homo sapiens
gttcttgggtaaaaagaagttggcaagttttatattttgtggtcaaatgaatttgatctcataaattcacttttaaaaatgtgtatgtacacttcggtgcrttcattcacaattgtgtttgtcctccctgtctctgttttttaatacattttaattctagaatagttttagatttgcagaaaagttacaaaatagtacaaa

SEQ ID NO: 7301 - DNA, 201 bp, Homo sapiens
agtttaatgatgacttgctgcaaaggatttcttatttcttcattcacagatacgcatgagtcaactggaagttaaagaaaaagagctcaataagctgaaayaagaaagtgaccaacttgtcctcaatcagcatccagcttcagacaaaattgaggtaggcttcatgaggtttatatttttgttagaaaaaaaaaaactttt

SEQ ID NO: 7302 - DNA, 201 bp, Homo sapiens; identical to SEQ ID NO: 580

SEQ ID NO: 7303 - DNA, 201 bp, Homo sapiens; identical to SEQ ID NO: 579

SEQ ID NO: 7304 - DNA, 201 bp, Homo sapiens
gttttcttgggtatatatcaagtgaatttctgggtgattctatgttacatattttaggaactaataagataatgattttattgtatctatttccccccagrttatgggacctggagaaacaaatcaagcaattgaggaattatcgtgataactatcaggctttctgcaagtggctctatgatgctaaacgccgccaggatt

SEQ ID NO: 7305 - DNA, 201 bp, Homo sapiens
tcttgtatttttaaaaataatatttttggcaacacatgtaaagctaatgccttaggacagctagttttggagtcctatttttaaagaaaaatgtttttttraaggtagtaaaataaaaccttgaaatcttggtaatattgttcacatattcatgtggtccgtctttggattagaatccagaacttgttttctttttaacca

SEQ ID NO: 7306 - DNA, 201 bp, Homo sapiens
catcttctgtgccactgaaatgggatttaaaaatcgaacttcatggcttgttaatttaattcctaacatgatttgaaaatctttcaacccctaacacccayatgtagcagtattaaaaatttctttgagggtagggatttaaaaaaatgtgtatacgcttgtaagtacatcattttaaaattatttctttatccattatag

SEQ ID NO: 7307 - DNA, 100 bp, Homo sapiens
ataaagtggaaattcatataaatgaagtcaaggtatagcaaccactcccwactgactactagtgcccaatagaactactgctaaatgagtaggaataaga

SEQ ID NO: 7308 - DNA, 201 bp, Homo sapiens
cctgctggtaagctgatttatttctcaagtgcatcgactttctgttgtttccaattcaattcagttcaagaaatatcaagcacatcctggcggggaggcasctgttcatcgatgctaatgttgttgctgctgctgagtttcctttagaagtgaattttaaaagttgttttcttttctttttttcttttaagtagagacagg

SEQ ID NO: 7309 - DNA, 201 bp, Homo sapiens
taaataatgtcactcgtggtgacacagtgattttcctattgggctggggtgtgacttatggcactttgaatttttggggagaaggtaggaaaagcttgatwtctctaacagtccattttcccccttatagtccaaaactaattattgatgggtacaaaaatacagttagatagaaggagtaagttctaatatttgatagta

SEQ ID NO: 7310 - DNA, 201 bp, Homo sapiens; identical to SEQ ID NO: 591

SEQ ID NO: 7311 - DNA, 201 bp, Homo sapiens; identical to SEQ ID NO: 590

SEQ ID NO: 7312 - DNA, 201 bp, Homo sapiens; identical to SEQ ID NO: 589

SEQ ID NO: 7313 - DNA, 201 bp, Homo sapiens; identical to SEQ ID NO: 622

SEQ ID NO: 7314 - DNA, 201 bp, Homo sapiens
tgcctttccacttttgtgttctgctgcctacctctttttaaaagcctacttggtaaactcctcctcatcctttaagacccatctcagccatttcctgaagmctttttctcacttgttcaagcagagctgatcatcttttccattttgttgccaccctacctagcttatagttgttcttgagcttaatagttattattatcg

SEQ ID NO: 7315 - DNA, 201 bp, Homo sapiens
attccttccttcctctttctcttattctttctttctttttcctgctaattcctcaaataagggtatgtagggtcagagagaacatctaaattttgacagtsaattttgcctttgttagtaaaattttgatagcttgagagatgtgaattaataccgaattagtaaatgtaaatcatttgaggtctatttctgtagtccagc

SEQ ID NO: 7316 - DNA, 201 bp, Homo sapiens
ctaccattggtttgatatagaatattacactttagactggtgtgtctgtgtacgtatactggagaccagtggtaacacaaactgattaacattcttttctrtgttttaggaatgaagaaaggcgatcagcttcagtagattcacggcagtctggtggaagctatttggatgctgagtgttcacgacatagaagggatagga

SEQ ID NO: 7317 - DNA, 201 bp, Homo sapiens
gttatagcaacttcaaatttaatattgctgtaaaacttttatctactattcatattccagtttgaccattgccttttctgtgttctctaaactgcacaagwcccacagtcaattatgtcatagcacttagtaaatatttgattgttagcactgatttttctagcgttacagtcttaattttttgagcagttttcttacctg

SEQ ID NO: 7318 - DNA, 201 bp, Homo sapiens
cacccagcttcaaaaattgaaataaaagattggcaagggcttcatagagaaaagcatttgagggaaagggagaagcaaggaggaataaaggaatgtctgctattgactcttgcctatgtggtggagcctgagctaggtggattctgtgcaaatagcaggcttcaaggcgcttacatagagctgctgacagggaggcttgta

SEQ ID NO: 7319 - DNA, 201 bp, Homo sapiens
aaacaagttaaaatataggattgtgatgtatttatttgataattcatagaatttaaaagctttgaaggatataatacttttattttattctttcattagayaatagtcgaaaaagtccaaaatcctaccttgaaatcctggcagaagtacgagattataaaagaagacgccagtcctatagagccaagaatgttcacataa

SEQ ID NO: 7320 - DNA, 201 bp, Homo sapiens
ttgggggttcctgaacaaattctgcatggatactgagggatatttactcagtacctgaggttttactctgacttttacattaaatgtaccttctttctgtraaaatattacaactgtgctgttactttaatctatgtacctaagcactcttatgttcaactaatggctggagagaagaaatgatataaaacttagcccgtg

SEQ ID NO: 7321 - DNA, 201 bp, Homo sapiens
ggctggtcccaaactcctggcctcaagtgatcctcctgtcttggcctcccaaagtgctgggattacaacgtgagccactgtacccggcctgtattaggtawtgaaagtaatttagagatgacttcaagtgtactggagggtgtgtgtaggttatatacaaatactacaccattttatatcagagacttgagcatccatgga

SEQ ID NO: 7322 - DNA, 201 bp, Homo sapiens
tttgtgatctaactcaagctgatcgtcttgccctctatgatttcgtagttgaggagacaaagaaaaagcgctctgattctcaaattattgaaaatgacagygatctctttgtagacttggctgccaaaatcaatcaaggtttgagatgcacatcatggctttacatttcttcattatcattttattctatgagtgttatta

SEQ ID NO: 7323 - DNA, 201 bp, Homo sapiens; identical to SEQ ID NO: 601

SEQ ID NO: 7324 - DNA, 201 bp, Homo sapiens; identical to SEQ ID NO: 600

SEQ ID NO: 7325 - DNA, 201 bp, Homo sapiens
gctactttgaaacaagttaaaatataggattgtgatgtatttatttgataattcatagaatttaaaagctttgaaggatataatacttttattttattctytcattagacaatagtcgaaaaagtccaaaatcctaccttgaaatcctggcagaagtacgagattataaaagaagacgccagtcctatagagccaagaatg

SEQ ID NO: 7326 - DNA, 201 bp, Homo sapiens; identical to SEQ ID NO: 594

SEQ ID NO: 7327 - DNA, 201 bp, Homo sapiens
cagctttagagctgggttaaagagtttctccctgggaacctcagcagagagtaggttagaagttttaagcataagcttttaggaaattgaaagaaaacttmatccatcaaaaacatagacataggccagacacggtggctcatgcctgtcatcccagcactttgggaggccgaggcaggtggatcatctgaggtcagaagt

SEQ ID NO: 7328 - DNA, 201 bp, Homo sapiens
gtccgtgtgcagagccgcgatgggcgcctgggacccgaggggcgccgggggccctggagcaaccctgacgtccctgggttccgggctggggcgcgcgaggractcccgaaggctccacatcgacctccagtgcggcgctcctcccgcgcaacttcgagtttaaagaaaaccgggggccgggcgcggtggcgcacgcctgta

SEQ ID NO: 7329 - DNA, 201 bp, Homo sapiens
ggaagaagggagatccgcactggcagccgcggagggaagggcgaggagtcctcgtccgtgtgcagagccgcgatgggcgcctgggacccgaggggcgccgsgggccctggagcaaccctgacgtccctgggttccgggctggggcgcgcgaggaactcccgaaggctccacatcgacctccagtgcggcgctcctcccgcg

SEQ ID NO: 7330 - DNA, 201 bp, Homo sapiens
cgtggagagcggctgccggacgttggaggaggtgaccgcgtccctgggctgggacctagatagtctggatcccggggaagaggaggcggcggaggtgaggrgcgcggccgcggggccctttcggggactatcggcccggggtcttctctggaagaagggagatccgcactggcagccgcggagggaagggcgaggagtcct

SEQ ID NO: 7331 - DNA, 201 bp, Homo sapiens
tccagtttgaccattgccttttctgtgttctctaaactgcacaagtcccacagtcaattatgtcatagcacttagtaaatatttgattgttagcactgatytttctagcgttacagtcttaattttttgagcagttttcttacctgaagttcggtgcttacctctcccaaggtgattcgagatgtgataaatgtgcacatg

SEQ ID NO: 7332 - DNA, 201 bp, Homo sapiens; identical to SEQ ID NO: 602

SEQ ID NO: 7333 - DNA, 201 bp, Homo sapiens
acaaagaaaaagcgctctgattctcaaattattgaaaatgacagcgatctctttgtagacttggctgccaaaatcaatcaaggtttgagatgcacatcatrgctttacatttcttcattatcattttattctatgagtgttattaagatgatttaattcttgggccactttgagttagagtaaaatggttttgtatcattt

SEQ ID NO: 7334 - DNA, 201 bp, Homo sapiens
gaatgtagaattaattaatgtacaaggcaactaattcacataatctgaagtttagagaccaggcttgtattaataggcagtgaaaaccttacaaagctttstatagtagagcagacaccttctttctcagttacaacaaaaatttgagcatgtgacacagattgaaggatgagactgaagatggacatgtgttccagggat

SEQ ID NO: 7335 - DNA, 201 bp, Homo sapiens
aatggtaaacatttaatggtaattatttatttaaatattatgtacctattttctttgtttctgtttgatttttataggatgaagttgtgatatgtccataygattccaatcatcacatgcctaaatcatctttggcaaagcacatggcatcttgtagattgaggaaaatgggctataccaaagaagaagaggtaccatata

SEQ ID NO: 7336 - DNA, 201 bp, Homo sapiens
catgggggttgagagaggcctgtagaagaggatgcactatacagtactggtacataattaaatggtaaacatttaatggtaattatttatttaaatattawgtacctattttctttgtttctgtttgatttttataggatgaagttgtgatatgtccatacgattccaatcatcacatgcctaaatcatctttggcaaagc

SEQ ID NO: 7337 - DNA, 201 bp, Homo sapiens
tagttaagaggaactattatattattttgatagttaagaggaactttaattttgaattcttacactatcttaaattaagatttaattgttaaccgtaaccttttttttttttttttttgaggcggaatcttgctctctcgcccaggctggagtttagtggcacaatctctactcactgcaagctctgccacctgggttcac

SEQ ID NO: 7338 - DNA, 201 bp, Homo sapiens
agttaagaggaactattatattattttgatagttaagaggaactttaattttgaattcttacactatcttaaattaagatttaattgttaaccgtaaccttttttttttttttttttgaggcggaatcttgctctctcgcccaggctggagtttagtggcacaatctctactcactgcaagctctgccacctgggttcacg

SEQ ID NO: 7339 - DNA, 201 bp, Homo sapiens
gagataaattgcaaaactaaaaatagtaccaagaactcccatattgtctttacccagatcacccattgttagcattttgccacatagcttctcattggcaytctctctctctctctctgcacatttttcactctctcgatctcgatctgtacatatttttttcccctgaattctttaagggttaaattacatacctcataa

SEQ ID NO: 7340 - DNA, 201 bp, Homo sapiens
tggctcatgcctgtaatcccagcactttgggaggccaaggcgggtggatcacctgaggtcaggagttcgagaccagcctggtcaacatggtgaaaccctgwctctactaaaaatacaaaaaatagccaggtgtggtggttcgcgcctgaaatccagctgcttgggaggctgaggcaggaatcgcttgaatccgggaggcga

SEQ ID NO: 7341 - DNA, 201 bp, Homo sapiens
aaaaaatagccaggtgtggtggttcgcgcctgaaatccagctgcttgggaggctgaggcaggaatcgcttgaatccgggaggcgaaggttgcagtgagccragatcgtgccatttgcgctccagcctgggcaacaagagtgaaactccatctcaaaaaaacagaaacaaacaaataaaaaaactaagagacgaaactgaaa

SEQ ID NO: 7342 - DNA, 201 bp, Homo sapiens
tctgtgtacgtatactggagaccagtggtaacacaaactgattaacattcttttctatgttttaggaatgaagaaaggcgatcagcttcagtagattcacrgcagtctggtggaagctatttggatgctgagtgttcacgacatagaagggataggagtagaagcccacataaaagaaaaagaaacaaagataaggataaa

SEQ ID NO: 7343 - DNA, 201 bp, Homo sapiens; identical to SEQ ID NO: 599

SEQ ID NO: 7344 - DNA, 201 bp, Homo sapiens
agcggcggcggctgcaggaggagctgaacgagttcgtggagagcggctgccggacgttggaggaggtgaccgcgtccctgggctgggacctagatagtctrgatcccggggaagaggaggcggcggaggtgaggagcgcggccgcggggccctttcggggactatcggcccggggtcttctctggaagaagggagatccgc

SEQ ID NO: 7345 - DNA, 201 bp, Homo sapiens
aagttctagagatggatagaggttgcacaacgtgaatgcacttcatgtctctgaacagtacactgaaaaaatggttagaatgttaaattttatgttatatrtattttgccacaaaaaacctgcaaaaacaggcagccaaagggtcttagagttattataattacagcacattcatatgtacctttaaatcatttaaaaaca

SEQ ID NO: 7346 - DNA, 201 bp, Homo sapiens
atacctcttttatttcagggatggggaaagacaccatagtcataaaagaagaaagcaaaaaatataaatgaagtacttgtacctatattaattatgcttaygccatgataaccaatatacagatatattaattggaattcctttgcataggagaatgtttttatgatctgtttagtgcttattattttttttatgatctgt

SEQ ID NO: 7347 - DNA, 201 bp, Homo sapiens
ctgaggtaagttttacataatctttgttgataagaatttcccttaggtaattttctaaatctgttctatgaatttccacaattctttggaaattttctgaragtgtcttcagggtggccacacctgatttgtatctgttccatcacttctagatccaccctttagcaagcaaaggctttcatagtataagaaccttatata

SEQ ID NO: 7348 - DNA, 201 bp, Homo sapiens
gtgtgactcatgtcactccgctaggttggaccttggcatatcttaggttttccatgggagaatatagtggaggaggagaagtggtggataaggattttccrggtggaagaactagcattctgaaaagcagatagaagtataggagtttttcagagactcattagtaacccagggtggctagagcttagggcttctctgttg

SEQ ID NO: 7349 - DNA, 201 bp, Homo sapiens
ccaggctgtagtcatggttggttttctccctcattgaaattgaggatctttaccaaatactgttctaagccagtatctggacttgatttctcagagttgckctatggcttcagaagaaagaccatcttatccttagttgtctatattacatgggttctctacaacagccagaagcacatttcttgtattttttgttttgag

SEQ ID NO: 7350 - DNA, 201 bp, Homo sapiens
ttgattggatgtgggtgatgagggagaagtagtttcttgcttgagcaagggggacctttcactgaaatagaaaagtacaaaaggaatagatttgagggttrggagatgatgaatataattaatttatttttgtttgtgttgaacttttagtgtctttaatatacggtactggagagaaacaaggtttaaagatctaaattt

SEQ ID NO: 7351 - DNA, 201 bp, Homo sapiens
gataccctgagttggggaagtggcagtggggatggaggatgttgagggattttcagaaatatttaggagttaaattggcaggactaggtgattgattggaygtgggtgatgagggagaagtagtttcttgcttgagcaagggggacctttcactgaaatagaaaagtacaaaaggaatagatttgagggttgggagatgat

SEQ ID NO: 7352 - DNA, 201 bp, Homo sapiens
ggtggtggacaaagtggtggtcagcaaaggcttcctggacaaagtgaattctaagctgataaataaaagtgagttgaattggctagggggttggcgggtgyggggaagaagcatcaacagcatgtgtagaagttcagagacagggagtgaccagatcgggaagcctcaagtagttaaggatagctagagcatagagtgtag

SEQ ID NO: 7353 - DNA, 201 bp, Homo sapiens
aggtcgaggctgcagtgagccgagatcgctccactgcattccagcctgggcgacagagcaagaccctgtctcaaaaaacaaacaaacaaaatccaggaagrtgtgttgagtgaggagggaatggcagatttggtatttatttagaaaataagtgaacgtgtctcagagcgctgcagagggattggcggtttgcattgtcat

SEQ ID NO: 7354 - DNA, 201 bp, Homo sapiens
aagggagatccgcactggcagccgcggagggaagggcgaggagtcctcgtccgtgtgcagagccgcgatgggcgcctgggacccgaggggcgccgggggcyctggagcaaccctgacgtccctgggttccgggctggggcgcgcgaggaactcccgaaggctccacatcgacctccagtgcggcgctcctcccgcgcaact

SEQ ID NO: 7355 - DNA, 201 bp, Homo sapiens
cggcggctgcaggaggagctgaacgagttcgtggagagcggctgccggacgttggaggaggtgaccgcgtccctgggctgggacctagatagtctggatcycggggaagaggaggcggcggaggtgaggagcgcggccgcggggccctttcggggactatcggcccggggtcttctctggaagaagggagatccgcactgg

SEQ ID NO: 7356 - DNA, 201 bp, Homo sapiens
cttagtaatcctttttgattcatatgctgttttataataactatagtgcttcttctacttaagtaatttttgacatctctaatcaatccctgttgacttamatacattagaagtcctcaaaatctaaacattaaatagtttttatttaaagaagataaactggatataagtaagaaatacttctcaacaggctaatctttg

SEQ ID NO: 7357 - DNA, 201 bp, Homo sapiens
ccgcggagggaagggcgaggagtcctcgtccgtgtgcagagccgcgatgggcgcctgggacccgaggggcgccgggggccctggagcaaccctgacgtccytgggttccgggctggggcgcgcgaggaactcccgaaggctccacatcgacctccagtgcggcgctcctcccgcgcaacttcgagtttaaagaaaaccggg

SEQ ID NO: 7358 - DNA, 201 bp, Homo sapiens
ttgcactccagcctgggcaacagagcgagactccatctcaaaaaaaaaaacacacatagacaaacgagttaataaaagtttaaatttctaatgaatgtagrtatgacatctagccaaaacctgaacagcttctcttgtaaggatttctgcattgtcttctttgaaccttctgtaggtagctttctctggacaacttacctt

SEQ ID NO: 7359 - DNA, 201 bp, Homo sapiens
tacaaaaattagccgggtgtggtggtgtgagcctgtggccccagctatttgggaggctggggtggaaggatagcttgagcccaggaggtcgaggctgcagkgagccgagatcgctccactgcattccagcctgggcgacagagcaagaccctgtctcaaaaaacaaacaaacaaaatccaggaaggtgtgttgagtgagga

SEQ ID NO: 7360 - DNA, 201 bp, Homo sapiens
gggtattttcggtggaatgagaggaagggaagtgctccaatgtggggtaattcattatctttactattacttctgggtttaccatgctgtgataatttctsctgggtttaagttacatgactgattcctcagaggcatttaaaatatatttgatttctgtatataccattcattgtttattgtattaaaagcacagaggaa

SEQ ID NO: 7361 - DNA, 201 bp, Homo sapiens
tgctgcgtgcctaattataggcatgaactgcttgaagtctgattacttactgggctgtagataaatctgaaaggattctgtgttcagatttcatagacagrgatgtggatgtttcttaagattctggaaggtttgtccacgtgcccaaagggcttggatcagaaaccagttaataatttaattgtggtcactgatgattca

SEQ ID NO: 7362 - DNA, 201 bp, Homo sapiens
gaatcttgctctctcgcccaggctggagtttagtggcacaatctctactcactgcaagctctgccacctgggttcacgccattcttctgcctcaggtcccragtagctgggactacaggcacctgccaccacgcctggctaattttcttgtatttttttagtagagacggggtttcactgtgttagccacgatggtctcga

SEQ ID NO: 7363 - DNA, 201 bp, Homo sapiens
aatcttgctctctcgcccaggctggagtttagtggcacaatctctactcactgcaagctctgccacctgggttcacgccattcttctgcctcaggtcccgrgtagctgggactacaggcacctgccaccacgcctggctaattttcttgtatttttttagtagagacggggtttcactgtgttagccacgatggtctcgat

SEQ ID NO: 7364 - DNA, 201 bp, Homo sapiens
ctgggattacaggcgggagccaccgcgcctggccaacggtaactttatatgatcttcaaccttctttaaaaattttttttggccacgtgtggtggctcccwcttgtaatcccagcactttgggaggcccaggtgggcagatcacctgaggccaggagttcaagaccagcctggccaacatggtgaaaccctgtctctacta

SEQ ID NO: 7365 - DNA, 201 bp, Homo sapiens
tctaaatttactgcatatgattccattcccttgtatactgctagagtgaatagtcacctcatagaactcttccgtggcggtctggcatggtggctcatgcytataatccctacactgtgggaggctgaggcaggtgatcacttgagctcaggagctcaaggccagcccgggcaacctggcaaaacctcgtctctacaaaga

SEQ ID NO: 7366 - DNA, 201 bp, Homo sapiens
tctataaacatgttcataggtcttccccctcgccccgcccgtcttctaagggcattttctgtttctttttagtgagttcatgaatgtttaacggttctggygcaaagctttcttgcattctgagcataaaaataataaaacccacttatatttgcttgagtgtgtttacaagtcaatttccttttatgtagcttgcttttt

SEQ ID NO: 7367 - DNA, 201 bp, Homo sapiens; identical to SEQ ID NO: 593

SEQ ID NO: 7368 - DNA, 201 bp, Homo sapiens; identical to SEQ ID NO: 592

SEQ ID NO: 7369 - DNA, 201 bp, Homo sapiens
ccatcatttataaccatttttttatacctcttttatttcagggatggggaaagacaccatagtcataaaagaagaaagcaaaaaatataaatgaagtactygtacctatattaattatgcttacgccatgataaccaatatacagatatattaattggaattcctttgcataggagaatgtttttatgatctgtttagtgc

SEQ ID NO: 7370 - DNA, 201 bp, Homo sapiens
gggtttaccatgctgtgataatttctcctgggtttaagttacatgactgattcctcagaggcatttaaaatatatttgatttctgtatataccattcattrtttattgtattaaaagcacagaggaaattaaaaaatctttaatattcatttagaggggtatttgaagctgggaattccactgagtggggcttaccagacc

SEQ ID NO: 7371 - DNA, 201 bp, Homo sapiens
aaattattatttagtaaatacagatggtcccaacttaatgatgatttaatttaggattttttcaattttatggtgttgtgaaaacaatacacaatcacaargttttagactttaagtactagtgattcttttatcagacgctgggctgcattttcaacttaacggtattttcagtttatgatgggtttatcgggatgtaac

SEQ ID NO: 7372 - DNA, 201 bp, Homo sapiens
ttcttcctctctgcagatttttgagattgatccctgtgtgtcagttgtgcattttttttgttgctgagtagtatgttctatcttatgtcagatcattcacrtgagactttggcatgaaatgttaagcatccgacatctaaatagcaatattttgaatactggaaactcaggttaaagattttgtttccaagtagaaatgaa

SEQ ID NO: 7373 - DNA, 201 bp, Homo sapiens
caagtagagacctgggtccctgtcatactaccttggtgattctcatagtccctaagatacttggctcatcagttatttcttctctcgtctcataacccttrtaatcaagcttaaatgttgctgctagcattctttacggttttatagttgatattttattgtggaaatattcaaacatatactaaagtggatagcatcgtc

SEQ ID NO: 7374 - DNA, 201 bp, Homo sapiens
tcccctcaaatgcagctgatctaagctgaaatgttattggacaactacccagtttaatgaattttccagtgtcataatagccctgtaggcgctcagcaggrtgggatatctatgcttaaacagagatttatttggattcttaatctaatggaggttcaaatatgtggaatttctggtcatttgtaaaaagaggattatgag

SEQ ID NO: 7375 - DNA, 201 bp, Homo sapiens
aatcaacaccaattttagtgagtccatcatttccttctactgttcacaactacatgttttccatagatattgccttgctcaggtattgaagaaggaaatcyaattcgttttatagcaaaataaatgaaagtcataatctggagtttctattaaaatattccaaaatgtatttatcttcttttactcctaccttcacatatg

SEQ ID NO: 7376 - DNA, 201 bp, Homo sapiens
tctcatgtacatccaacttctcttgctctcccataaaagcctgcttgcccgttttcctgtccccttcctcttcattgtcgtcctcctcctctttctccccrggctgtttctgtacgtcttcacttgtgttctctgtatcccaagccagccgccttctaacgggtatggtgggagctgacacacccaatttctccgtggtat

SEQ ID NO: 7377 - DNA, 201 bp, Homo sapiens
ctagatgagatgcttttttccccaaaacatgtttaccttagtaaaatcattctttgaagtttctaaacaatcctgagaggtcattcttttcctctgttctrgggctggaggcttcatcttagatggagacactaaaacagcaccacctggaaaaataaagatgacagtttcaattacactaaattaacatgtagaaaaagc

SEQ ID NO: 7378 - DNA, 201 bp, Homo sapiens
atgtaaaaagaattctttaaaagttaaatttgtataagcctatgttaacaatttccaagtaaactgttctattggaaattaaatatttcaaagtagaaaaygttaggaaaaacttcactcaaaaaattttaacacagtaagcaataaagaaaaattatgccaatgtttccttagataaaggcaactcagctaggtttatgt

SEQ ID NO: 7379 - DNA, 201 bp, Homo sapiens
tgagtgtataactatacccaagtaagtggaagtttaagccagcagaagagtgaaaccaagaaacaaccaacttgttcccctgatggctctgggtttgggcrtactgagtaccactgaaagttggagtgaagggaagactgaaccaggaagctgcctaaatatgtttttacaaaaatagttaatatgccaggtcctccttta

SEQ ID NO: 7380 - DNA, 201 bp, Homo sapiens
acagcttaacaaaaacgacataaacttttgggagttttataaccctgcccaggtgtgagaagccagaatacctcccctgggcaacacagggcaagctcaawtaccactgctactactgcagctggtgctcttttgcaagcagcacctcctgattagaggccaactgacacagtccattatatcatctctaggtagaataac

SEQ ID NO: 7381 - DNA, 201 bp, Homo sapiens
gatgattaagctactcaaggagctaccagagaaaggtgaaaaccaacataaagaaattaaaaaaaaattcaggatatgaatgaaaaatttcccagagagayagatatcataaagaaaatgcaatcagaacatctggaaataaaaaacacacttagagaaatacaaaacgtagtggaaagtttcaaaaatagactagaacaa

SEQ ID NO: 7382 - DNA, 201 bp, Homo sapiens
aaggtgaaaaccaacataaagaaattaaaaaaaaattcaggatatgaatgaaaaatttcccagagagatagatatcataaagaaaatgcaatcagaacatytggaaataaaaaacacacttagagaaatacaaaacgtagtggaaagtttcaaaaatagactagaacaagtagaagatagctgcatgccaggtccaagagg

SEQ ID NO: 7383 - DNA, 201 bp, Homo sapiens
gtggctcatgcctgtaatcctagcactttgggaggccgagacgggaggatcactttaggccaggagtttgaccagcctggtcaacacggcgagaccccatmtctatttatttaaaaaaaaaattaaattaaattaaaaacaaaacaaggcaaaccagtaaaatcaagtacagttccaaactttcctgattatttcttgtaa

SEQ ID NO: 7384 - DNA, 201 bp, Homo sapiens
tttgaccagcctggtcaacacggcgagaccccatatctatttatttaaaaaaaaaattaaattaaattaaaaacaaaacaaggcaaaccagtaaaatcaartacagttccaaactttcctgattatttcttgtaattgttgccttcacttattatctttgattctatcaatgtaacattcaaaacattgctttctaaactt

SEQ ID NO: 7385 - DNA, 201 bp, Homo sapiens
tcttgagataacgaaagaaatcccaatgttgccatgttttccagcctcatgttgtaccaggctccctgccacacactgtattggtctttgtttcctcaaastctacattgtttctctccacaagatcttggcatatgctaggctccttctccccatccttttttcctggttaatgcttcctcttctcctttatcttagctc

SEQ ID NO: 7386 - DNA, 201 bp, Homo sapiens
cagcctggatttctaaggaggagtaaaacagtccattaagatctgattctcatgagtcctctgaccatattcctaatgtcacatttcctttaataaaccartgtatacataagcaacaggaaatagttttgatattctgtcactccaataacattcattcaatctgttacgtgctatgagctggactctgttctaagcact

SEQ ID NO: 7387 - DNA, 201 bp, Homo sapiens
cttagcactaatcagtatctaaaatactatgtattttacctggttattttgtttattgtctccctcctccactagaatgtaagttcaatgatggctatgayttttgtctgtttgttctctgctatatccccagcacttaaaacaatgcctggaacatagctggaatacaactgtcacacagcagatgctcaatgaaagtat

SEQ ID NO: 7388 - DNA, 201 bp, Homo sapiens
tagtgacaaaatacatatcaaccatgtaaataacgcttctctatactgagtaatttaaaactctcacccttctttcatcttatctgccttagatttctcaygtacatccaacttctcttgctctcccataaaagcctgcttgcccgttttcctgtccccttcctcttcattgtcgtcctcctcctctttctccccgggctg

SEQ ID NO: 7389 - DNA, 201 bp, Homo sapiens
tcagatggtcccgagaaaaatgcgtcccctgaactcgcttcctataaaactcagccttttctcggagttctttaacctattcaggagagttcagacatcayatactattgtaaatgcttctttacaaacagcaccaagtagcatatcaaagacattgcacaaatacagccagggaccaaagacaaaggaaggcaaaattag

SEQ ID NO: 7390 - DNA, 201 bp, Homo sapiens
aggcaaaaaaaagtcaagatatgatttgaaagatgctaattaatacaataacaaaaaggttccattctctatcctttgagtataagaagctagtactaaartagcaattctcaactctagaattacccttcccttcaaacctatcttcagatccccagagtttctcccaagtcagagtaccccaaaactgtagctcacacc

SEQ ID NO: 7391 - DNA, 201 bp, Homo sapiens
ataccccaattacctgtaatttataatcatgttagcctgattctgcaaattaaatggctgtaatatcacacagaagcagttgtttgtatattctgaggtamatcatgtgaattatactggctataatttggcatgctaaagctttggtttaaaatacatgtgatggccgggtgtggtggctcacgcctgtaatcccagcac

SEQ ID NO: 7392 - DNA, 201 bp, Homo sapiens
cacatatattattaacatccaaaggtcaactttatgtactcattactatgttttgaataacagttttgtaatcaaaatatagcttataatcaaaataaacrttggcatattttcatatgacatagacattagctttaaggcaactctgttgtcagttctacaggtttttttcttcctccctgacatgattttttttcttcc

SEQ ID NO: 7393 - DNA, 201 bp, Homo sapiens
ttaccactgattacaaggaaagcaaatggaaaagatggggaactcagtcaagttatattactgctttgtaatgctggatagtacatcttcatacagatcasatctaaacagtttatcttttttagtacagtataacctcaaggactttactgccaaaaactgttctgactcctttacatattaatataagacatcctttca

SEQ ID NO: 7394 - DNA, 201 bp, Homo sapiens
ctgttaagaacataaatgagagtttaaagcctaagaactccctaaaggatgaaggtagtaaaacaacagactatctattagtaatggtatctcaatactamaattgtgcaggagtataatgaaatctaataccacatcattacagcttttgaattttacaaatatagttatactgacaatgcctattactatttgtctgat

SEQ ID NO: 7395 - DNA, 201 bp, Homo sapiens
caggctacttaagtacttaatttctttcaactcttaattctatgtaaatctacattactagataagataatggtactcagaaatgtattacatccattaarctacctgattggctgcaaaagctggagcagtttctttagaagtcttccaaacaaactgcctttgatattcagaatttctcaaggcattatatgaaggaac

SEQ ID NO: 7396 - DNA, 201 bp, Homo sapiens
attttccacatctgaagccccttcagctctggagtctgcagagtgagatctggttcttttgggaaccctggaagcttctagtgagtgaactctttcttgartaacatccttttgttctgcttcttgtgattttggtgtttccggggcttctggttctggtgatgcaaccacattgctctctgagatagctccattccactc

SEQ ID NO: 7397 - DNA, 201 bp, Homo sapiens
agcaaatgtccaaaaacttaaccttctatgaaggtaagagcagctctgcagaatgacagccactgagagactgccctagtttagggccattctttaagacrgttgcagggtgcagaaggaagattaagaccagaatggaaagggaaggtggaaagaaaattgggcatgaggtaaaacccagggctccttagcctctgttgt

SEQ ID NO: 7398 - DNA, 201 bp, Homo sapiens
cccagtctctgaagtttgccgctgggtcagatcatgatgcttcagaggaactctaaaagagacactcactcttgcccactcttccctttgttctctagacsaaattctgaaaatacctcgtcgtcttactaactttccaggcttggtaccctacccataagtcttttcctggcttcaaacatctaacatttatgtgactta

SEQ ID NO: 7399 - DNA, 201 bp, Homo sapiens
cttcttttaatctataactaaggtctgagtcctgaagaccttcttctggagcatcagtaaatttacttaatctaaatgggtctaggtgctgggctgattayccttatcttgtctcctgctgaatcatggaggtttgaggagttccttcagaccgccaataaatttgtggaggcctggggagtttcttcagacccccagtaa

SEQ ID NO: 7400 - DNA, 201 bp, Homo sapiens
cccaggttagaatggctattagcctgctcaacttacctaattgatctgatctaagtccagcccatgggtactttcgccccacggaggaattacaagactckgacaaataagactttttccacaggaagttcctctggtattcactcagcccctgtaatgcaaagtacacttttgagtacagtccaattaatgaatgatgtt

SEQ ID NO: 7401 - DNA, 201 bp, Homo sapiens
tatatcattctatgatctacataagcttcaacaaactttttttgccatccacaaagaatatctcacccagcaagatctaatgctctgatgttgctactaayggttccttctgagcttgtggttgaggagacatcccaacagcagttgctatcagataaaatctgattcagatggtcccgagaaaaatgcgtcccctgaact

SEQ ID NO: 7402 - DNA, 201 bp, Homo sapiens
tcaaactttttaaaaattgtggtaaaaaatgcataacatgaaatctatcctcttaacaaaatgttaaatctacagtgcaaaattgttaactacatgcgcawtgtggtacagcaaactttcttcaacttataaatagtatcttttttcaagtgtcaaactatttaaaattcctttctatcaaaggactattaggcatcccag

SEQ ID NO: 7403 - DNA, 201 bp, Homo sapiens
catgtggtggagaaggcaactgtccagggggatttgttgggtattttggaatttttgaaactggaagagttgcctcagcaaatttgtggatattgtcttcmgaatcttcccgcaaaggcagaggatcaactgtttttataccagcagctggagaagtcagtagggatacagcacgactttctttctaaatgacaaaaaaaa

SEQ ID NO: 7404 - DNA, 201 bp, Homo sapiens
cactcaaagacattaaaaatttctattcaaactttttaaaaattgtggtaaaaaatgcataacatgaaatctatcctcttaacaaaatgttaaatctacastgcaaaattgttaactacatgcgcattgtggtacagcaaactttcttcaacttataaatagtatcttttttcaagtgtcaaactatttaaaattcctttc

SEQ ID NO: 7405 - DNA, 201 bp, Homo sapiens
aaaccaaaataattaccattgtgctgaaactctggatctctaagagagccctgaattcgtcgagagggatgccagtaggatggaacatgtggtggagaagrcaactgtccagggggatttgttgggtattttggaatttttgaaactggaagagttgcctcagcaaatttgtggatattgtcttcagaatcttcccgcaaa

SEQ ID NO: 7406 - DNA, 201 bp, Homo sapiens
tctcagcttgggagtaggaagccggcctcctttttctgaggatacagaagaatctgacctataaattgaaacaatctatgaatctatacagcatttcctcragaaaatatgataaaaaatactttgccatcattgtgcaataataaagtataaaacttgtaagaggccaggcgcggtggctcacgcccgtaatcccagcac

SEQ ID NO: 7407 - DNA, 201 bp, Homo sapiens
ttgaaatttcttttgtattcagtttcatggatgactgagttacctttgaatggtggaacaaactggcttttattgtggaaaaccttaaaacaaaaattatyttagtttagttttgttgattaaatatgcggaactttggtcttcaattacttaacaaaacataaagttgaattacaggacaaaaaaatagcaaagttatat

SEQ ID NO: 7408 - DNA, 201 bp, Homo sapiens
aatttccaagtaaactgttctattggaaattaaatatttcaaagtagaaaacgttaggaaaaacttcactcaaaaaattttaacacagtaagcaataaagwaaaattatgccaatgtttccttagataaaggcaactcagctaggtttatgttttaccccagaaattctccttccttttcttagctcgtgccagagtttga

SEQ ID NO: 7409 - DNA, 201 bp, Homo sapiens
aactttatgtactcattactatgttttgaataacagttttgtaatcaaaatatagcttataatcaaaataaacgttggcatattttcatatgacatagacrttagctttaaggcaactctgttgtcagttctacaggtttttttcttcctccctgacatgattttttttcttcctgccttaatagaaaattcttcacattt

SEQ ID NO: 7410 - DNA, 201 bp, Homo sapiens
aatagcaaagttatatatgattttaatttcatttcacatatattattaacatccaaaggtcaactttatgtactcattactatgttttgaataacagtttkgtaatcaaaatatagcttataatcaaaataaacgttggcatattttcatatgacatagacattagctttaaggcaactctgttgtcagttctacaggttt

SEQ ID NO: 7411 - DNA, 201 bp, Homo sapiens
tggaaaaccttaaaacaaaaattattttagtttagttttgttgattaaatatgcggaactttggtcttcaattacttaacaaaacataaagttgaattacrggacaaaaaaatagcaaagttatatatgattttaatttcatttcacatatattattaacatccaaaggtcaactttatgtactcattactatgttttgaa

SEQ ID NO: 7412 - DNA, 201 bp, Homo sapiens
ctcaatgaacatttgatgaacaaatgaattaatgaactagtgaaaaccaaaaactcccaggtggtagtaagtaaacgaaaacgtggagaatctaaaataayggggattttgttttgtaaggttaaaagttgatgaataccttcctttcaggagacactgtttcaagatttctgttttctctcaaatcatttcttaattttg

SEQ ID NO: 7413 - DNA, 201 bp, Homo sapiens
tctgtcctcatctgcaatgaaaaaatcccgagattatattcattgccaaaaatatctattaaataaacattgtgttttatataacagaaaattaaaagcaycaaactgtgttatcaatgtcaagttagtcaggaaaaaaagtaatctactgaaatgtaagatactaacactctcatgatacctcacagtagttttccaggt

SEQ ID NO: 7414 - DNA, 201 bp, Homo sapiens
tataaaactcagccttttctcggagttctttaacctattcaggagagttcagacatcatatactattgtaaatgcttctttacaaacagcaccaagtagcrtatcaaagacattgcacaaatacagccagggaccaaagacaaaggaaggcaaaattagccacatacagtcatcagactgtgcatttaagcaaaaactaaa

SEQ ID NO: 7415 - DNA, 201 bp, Homo sapiens
agaccatcctggccaacatggtgaaaccccatctctactaaaaatacaaaaattagccgggtgtggtagcggatgcctgtaatcccagctatttgggaggytgaggcaggagaatcgcttgaacccgggaggcagaggctgcagtgagccgagatcatgccactgcactccagcctggcgacagagcgagactccgtctca

SEQ ID NO: 7416 - DNA, 201 bp, Homo sapiens
tgcccctccacagcttaacaaaaacgacataaacttttgggagttttataaccctgcccaggtgtgagaagccagaatacctcccctgggcaacacagggmaagctcaattaccactgctactactgcagctggtgctcttttgcaagcagcacctcctgattagaggccaactgacacagtccattatatcatctctagg

SEQ ID NO: 7417 - DNA, 201 bp, Homo sapiens
tgtcttcagaatcttcccgcaaaggcagaggatcaactgtttttataccagcagctggagaagtcagtagggatacagcacgactttctttctaaatgacaaaaaaaaaaaaaaaaaaaagatgcctatgtgtagatatgtaaataaataagccaaacatttaaatgcaaaaaacataaccaaaaagcagaaggagaaata

SEQ ID NO: 7418 - DNA, 201 bp, Homo sapiens
cttgaggccaggagttcaagaccagcctggccaacatggcaaaaccacatctctactaaaaatacaaaaattagtcagatgtggccacaggtggctatagyctcagctatttgggaggctgaggcatgagaactgcttgagcctggaaggcagaggttgcagtgagccaagatcgcaccactatactccagcctgggcaac

SEQ ID NO: 7419 - DNA, 201 bp, Homo sapiens
tgaggcgggagaatggcgtgaacccagaaggcggagcttgcagtgagccgatatcgtgccactgcactccagcctgggtgacagagcgaaactccgtctcaaaaaaaaaaaaaaaaaacttgtaagagaaggccattttgtttctgaaaaaaataaccaccaaatccacatgcagttaaaagcgactgaaatttccaataa

SEQ ID NO: 7420 - DNA, 201 bp, Homo sapiens
caacttctcctctacactccaaacctatatagtcagttccctattcaacatgtctacttgtatgtctaataagcttctcaaatttagagtgtccagaacgraattcttgatcttctccaactcagttaaatggcgactccatccttattgctaaggccaaaaatcttgagtcacccttgatttttctctttctcccacccc

SEQ ID NO: 7421 - DNA, 201 bp, Homo sapiens
gaacgtaaatggcctaaatgctccatttaaaagatatggaatggcagaatggattaaaaaccacaaaccaaatatctaatgcacaaagattcatataagcycaaggtaaaggggtaggaaaagatattccatgcaaatggaaaccaaaagcaagcaggagtcttatatcaggcaaaacagactttaaagcaacaactattt

SEQ ID NO: 7422 - DNA, 201 bp, Homo sapiens
gttcaaaagggggaccaatcagtcctgcactgtgttgggtagattgacggggcagtgggggtggaagggacagcagaggcagctgcatctatccatgcatkatgaatgaaaggatggatgaataccctccatgtacacagtcatccagttttatttgacgtcaattttatttagaaaggagggggagagtatacttcataa

SEQ ID NO: 7423 - DNA, 201 bp, Homo sapiens
tgtttccaaggagtaagcttccttttaggctggtgtaagtcttttaattccatctctgcttccaattttaaacgatcgtctattttattactctgaaatgraaatcatttaagctttttatgcttaagatgttacacattaaagtgaaaacatgcatgttataaagttagacttgaatatttaatgacatttctattttta

SEQ ID NO: 7424 - DNA, 201 bp, Homo sapiens
ctgcttctatgaacaccccttctcctgcctgccagactcacacatcaccttccttgttccctttcacccccagctttttcaacaagctacagattcttctmcaacactctgaaatgcctcttcagggtcccagtcagtggtggacatgaaccagagaagagcagtggaacagaatggagaaagaaatgtggaaagcattga

SEQ ID NO: 7425 - DNA, 201 bp, Homo sapiens
tggccatgtcaccccgggtccttatccttttaaaaggcttccctagaccacaggtcttctcactgggtggatatctgtctggaggcacacaaagatgtttyaggagggtaaacagaagtgggcagcttaagggaatcattttccagatcctcaactccacatgtgctctcttgcctgatgctgatatatctgcctgagagc

SEQ ID NO: 7426 - DNA, 201 bp, Homo sapiens
cacatcacatgtgggacactaagcactgatctgtgtactcaaaccaggcccttaataggcaacatctcatttaaaccctcccagtaatcctatgcaacagwcttcctaaaatctcacttggtgaaactagctcaatttgcccaacatcacacagctattataattcaaatttaggctaattcattcattcaaaaaatagtt

SEQ ID NO: 7427 - DNA, 201 bp, Homo sapiens
gagtacagtccaattaatgaatgatgttttaaagcagacatcggtgaaaaataatttctgaacctcccaaaagagacttaagactgaaaattaaacacagwcgagctccttaataagagctaatattcacccagccctgtgctaagcagttcacacgtgttatatcctttaatccacaacaccacttgaggcagatgctac

SEQ ID NO: 7428 - DNA, 201 bp, Homo sapiens
atcaccctccgggaaactctggcccaggactctgccttccctgggacacagggaggaggcatgtgtgataacaagaacatgacctctgaaattacatgctytgcacaaaacagacttgatttcaaatcatggttctgccacttactagctgtaaagctggggcagcgacctcatctccctaagcttccatttctcaagacc

SEQ ID NO: 7429 - DNA, 201 bp, Homo sapiens
atttttagaagctttagatactaaagaaaataaaaaccataagaaatcaacaaagaagttttgaaatttttagtatatttggttagttatttttgaagttwagctgaggatatagtttcattttctaacaataaagattttagatctttggctaaggaagaaaatttttaagttaacaaatacatatctaaataatgttac

SEQ ID NO: 7430 - DNA, 201 bp, Homo sapiens
actccccagatgcaggcttgcatgagaggcagagtcacaattcctatctacttggatagcattctcacccttcaccctgataagacctcactgcatttaastgagagctcccccagccaccttcatcaaggctgggacctgtgcccaccagtgggtattgcattcacccacctaccttagccacagtaagttcctacccag

SEQ ID NO: 7431 - DNA, 201 bp, Homo sapiens
gagtcacaattcctatctacttggatagcattctcacccttcaccctgataagacctcactgcatttaactgagagctcccccagccaccttcatcaaggmtgggacctgtgcccaccagtgggtattgcattcacccacctaccttagccacagtaagttcctacccagggatacctcccctaatggcctgaagcctgaa

SEQ ID NO: 7432 - DNA, 201 bp, Homo sapiens
attgtcttcagaatcttcccgcaaaggcagaggatcaactgtttttataccagcagctggagaagtcagtagggatacagcacgactttctttctaaatgmcaaaaaaaaaaaaaaaaaaaagatgcctatgtgtagatatgtaaataaataagccaaacatttaaatgcaaaaaacataaccaaaaagcagaaggagaaa

SEQ ID NO: 7433 - DNA, 201 bp, Homo sapiens
tgatattccagaggtttcccagtgacatcagaataacatccaagagaataaaccccacttgattataatgaattatctttttgatgtgctgctggattcartctgatagtattttgttgaggatttttgtgtctaccttcatcaggaatattggtctacagttttctttttttgttgttgtgtccttgccagattttggta

SEQ ID NO: 7434 - DNA, 201 bp, Homo sapiens
aagcccaaaccccagcattacacaatataccaatgtaacaaacttggacataaacgctctgaatctaaaataaaattcaggctgggcacagtggctcaagyctgtaatcatcctaccactttgggaggccaagaagggaggactgcttgaacccaggagtttgagaacagcctggcaacacagcgagatccccaactctac

SEQ ID NO: 7435 - DNA, 201 bp, Homo sapiens
actggtcttctgccaactttgtgaccaccaacttaaaatggccccttaacattggcctaaaatatcccacattcccctggcccactcactctcccactctstgagaagactactctatgccttcactttcctcaaatctccaacatcttccccagccttattctcagtaaggatctttcttcacatgtcaccaagaagcaa

SEQ ID NO: 7436 - DNA, 201 bp, Homo sapiens
aaaaaaaacttgtaagagaaggccattttgtttctgaaaaaaataaccaccaaatccacatgcagttaaaagcgactgaaatttccaataatgaatagaaytaagcacaagatcaaaaataaaacagaacactgaaaaaataatataagctatatcaactatatcaatagaagaaaaacaacccacaaagaaaaaagtgac

SEQ ID NO: 7437 - DNA, 201 bp, Homo sapiens
tatgtattaatagcttgcagtctctacttttttattgttgttgactttctttttaccttctaaaggtctttttacatctaccatgtaatcatccctactcygctattaactgccaacaaaaaatattataaaaatctagccttccagatttacattatgtgttatttatacataaataaagcaatctacattgctttattt

SEQ ID NO: 7438 - DNA, 201 bp, Homo sapiens
tgtatattctgaggtaaatcatgtgaattatactggctataatttggcatgctaaagctttggtttaaaatacatgtgatggccgggtgtggtggctcacrcctgtaatcccagcacttcaggaggccaaggtaggcggatcacctgaggctagtagttcgagaccagcctggccaacacagtgaaacccgcatctctact

SEQ ID NO: 7439 - DNA, 201 bp, Homo sapiens
aatttataggatcactggtgtttttctatcttaatgtaagatgactagatgttattgtcttgctgaatctaattatcctgtcagttcttacggctatacamaatatacaagtgaatgttgacgtacaggagaaaatgaatgtgagggtgtgtgaaagtgtgtgtatttataaagaaaaacacgaagaccagaagaaaaaac

SEQ ID NO: 7440 - DNA, 201 bp, Homo sapiens
atacaagtgaatgttgacgtacaggagaaaatgaatgtgagggtgtgtgaaagtgtgtgtatttataaagaaaaacacgaagaccagaagaaaaaacagaytaagccattacaggtctctggggatattccaagtggaggtatttcctgtctatgcctagaagtactgttaagaacataaatgagagtttaaagcctaaga

SEQ ID NO: 7441 - DNA, 201 bp, Homo sapiens
agaaaataattctaatttggccggttagtttgccaatgaatactgactttgccaattgtatgataaacattttccaaaaattgaatgggctaaattggcarctccagagtttttacaaaatatatgtaaaatatataagcactatgcaatataccagaaattctatcattcaaaactattcataaaaatttattataaaaa

SEQ ID NO: 7442 - DNA, 201 bp, Homo sapiens
ctgtgaagttgcagggtgctagtccctgacagctaccagctacctggaacttttaacatacgctaagaatgcacaacgatgaaaaacgtgtatttctttayacgctgtctttactaagaacccatttctcaagcctttaaaagccacatacactaaagttttaaaggtaatgggggttaaatgctaagctaaatgggccac

SEQ ID NO: 7443 - DNA, 201 bp, Homo sapiens
tcagattataggattttaaaagtacagcttttcaacataaaatatttaattttgcttttaaaagcattaaaaatttgaccataacaaaaaattaaaaatcrgggggtcacaaaatgttccagttatcctaacaaaagtcactagaattgcaacgtgatagacctggcaggccaggcagtacatgctgcctcgtttctaatt

SEQ ID NO: 7444 - DNA, 201 bp, Homo sapiens
actggggtttagacctgtctacaactattcttctctgtctacacccacccccttgatgatttcctccagtctcaatactttaaaaacctgacccacctaasctataaagagcctcaaatctgtacctatagcccaacttctcctctacactccaaacctatatagtcagttccctattcaacatgtctacttgtatgtcta

SEQ ID NO: 7445 - DNA, 201 bp, Homo sapiens
aaaaactggggtttagacctgtctacaactattcttctctgtctacacccacccccttgatgatttcctccagtctcaatactttaaaaacctgacccacytaagctataaagagcctcaaatctgtacctatagcccaacttctcctctacactccaaacctatatagtcagttccctattcaacatgtctacttgtatg

SEQ ID NO: 7446 - DNA, 201 bp, Homo sapiens
actgaatatatcgctagtgatttctcttataaaagtaacgtttctacacaacgctttcactgacatgtaaaagccctatttgatgatgatagggctttgayttgaatcagctctattttaaaggtcaaatactctataaaaaactgaataattacaattttcaggttgtaagtaatgttttaggtacacttaatctccaaa

SEQ ID NO: 7447 - DNA, 201 bp, Homo sapiens
agctgccacaatttataggatcactggtgtttttctatcttaatgtaagatgactagatgttattgtcttgctgaatctaattatcctgtcagttcttacrgctatacaaaatatacaagtgaatgttgacgtacaggagaaaatgaatgtgagggtgtgtgaaagtgtgtgtatttataaagaaaaacacgaagaccaga

SEQ ID NO: 7448 - DNA, 201 bp, Homo sapiens
caaataatgaaacagcaatgtaaaagcaattgtagaaacatagctccttaacaaggtacgattttgaatgcaaagatgaaagtgttacatctctagggaaytggccaaagcaaaagacagcacctatatggcataagaaaccatataatcccaacagagtcctactctaatgaaccatacctgaaaaaagttcctaaagga

SEQ ID NO: 7449 - DNA, 201 bp, Homo sapiens
aggaacctcataatcagatgcctatagtaaatgacttccaagagatataagtaaaacatggctcatattaaatgtctataacctggtcaactaaaactgtwatcatcaatgatcactgacttcttagctaaaaattcttattcttttccaacttcaatttactttttgaattatttttctcaaagaaattaaggcaaacta

SEQ ID NO: 7450 - DNA, 201 bp, Homo sapiens
tactacaaaatagcgagtagtcagaatagaactaattcacaataactaaagtcaacagcctgttatcaactattcttatagacattagacaagaaaacaayaatggaaaattctgaaacacaaaatgtaatattacagaaatgacaatgaaaccaatgaagaattctatgcttttgaaaagaaatgcagtgaatatgccta

SEQ ID NO: 7451 - DNA, 201 bp, Homo sapiens
ttaggtacacttaatctccaaaaaaacctgtaggcaagcaaaagaagtactgatcctatttactaggttaataaagggtatttatcactttgttacttcayagattcttaaaatgttatataaatttcaaaggtattttaaaaattgaataataattaagcccaaagctgccacaatttataggatcactggtgtttttct

SEQ ID NO: 7452 - DNA, 201 bp, Homo sapiens
gttaagaaaaatacacatacctctgaccagtatataatcctctacactggcaaacaaagcctccgttgtcgacaacacacgtgcccccatagaggcatggsttggaggaacacggattgacgcttatctcacagtgggtccctatgtacaaggcactgcatttgcagtaataacctaaatcggcaaaaaggaacaaaaaag

SEQ ID NO: 7453 - DNA, 201 bp, Homo sapiens
tgaaatgtactaacaaaatgtcacacttcagtggaaaaagacagaatgaaaccctggttatagtaaaaaaaaaaaaatcagggtgctagataatggcactracaccaccaaaattcagttgaaacaaatgcacaaaatatcttggaaatctagttaaaactatgaaaaatcaaatctgtacataaaatttacaaaaaaaag

SEQ ID NO: 7454 - DNA, 201 bp, Homo sapiens
acacaggggttgggcttctaagctacagaatgacagcaacacaagtctacattgttttaggccacaaagtttgtggtaatctgtaatggccctggaaaacygggaatacgacgcaggaacagactctcagcagactttcagtttacaactgataattacattatggtaatgagtaaaataaaaacactcctgtatatatgt

SEQ ID NO: 7455 - DNA, 201 bp, Homo sapiens
aggagaaggggtgtagcgaaaagggaagaaaaaggaggatgatgaaggaaacatggtaagaaagggagtgtgaggaggaagagggaggaggggaagcagamacgaggaggagtgggggacaggaggaagagcagagaggaggaggagtgtaggagaagaagaggactggaggagaaaaggaagagacgaggccaggcgcgg

SEQ ID NO: 7456 - DNA, 201 bp, Homo sapiens
tctctccttaacctctgcctcataaaaacaatcctcccttttttaataagattatttaagtcatagtcaagattctctatgttctacctagacaaaaaaaagaagccaatccttttcctaagataacatggtacggtgaggtcttcagaatttctctccactcatcacaccacaagccacactatgctttctataacttgc

SEQ ID NO: 7457 - DNA, 201 bp, Homo sapiens
caagcaactgttaacagtggtaacttctggagaaccggtagagaaacaggtagctgagggaatgattactgtggcatttttctctactgtggtttttttttagcatgagtatgtgttgtctttatcatccactcacccctttcattaattatttaattccttttacataggtttaatgagcatctactatgtatcaggtgc

SEQ ID NO: 7458 - DNA, 201 bp, Homo sapiens
aggggggtagatacaatgtacccacggatatactttaaaatggacagaaaagtctaggcagacaagcaactgttaacagtggtaacttctggagaaccggyagagaaacaggtagctgagggaatgattactgtggcatttttctctactgtggtttttttttagcatgagtatgtgttgtctttatcatccactcacccc

SEQ ID NO: 7459 - DNA, 201 bp, Homo sapiens
ggtttgggatgtttttcatgttttccaatataagtatcaacattcttgtaacatgtctagaattattaagcttaacaaaaacttccttttcatttttgaaygacaaggtcctctctttcatatttaaacgactcaaaaatcttcatgagtatcaaatgaaaggctactaactgtaacaactaagttatatttttatattta

SEQ ID NO: 7460 - DNA, 201 bp, Homo sapiens
tataaagaactacaggttcttatttcacttggaaacagccttgaatgacggtttctcctaaatcatttcaggcacatgtacaaatatatagaaaagtgacctgtccattgttaaggtttatctagctcatttataatttttatacaggttttatttctctattacattaagcaccatataatgtatgtagaaatacttgca

SEQ ID NO: 7461 - DNA, 201 bp, Homo sapiens
ttaaataattaccatgtattttctaaagcaactaacattcctctcacaagtgaatgactggatgttaatcactaacttgggggataagagggaaaaaacaaccccaaactccctttaccccaccagtattaacgcagcacagtgaaacactttcagacacgtaatacaaacagggtaacaattgttttaatttaacaaatt

SEQ ID NO: 7462 - DNA, 201 bp, Homo sapiens
ctttaaataattaccatgtattttctaaagcaactaacattcctctcacaagtgaatgactggatgttaatcactaacttgggggataagagggaaaaaamaaccccaaactccctttaccccaccagtattaacgcagcacagtgaaacactttcagacacgtaatacaaacagggtaacaattgttttaatttaacaaa

SEQ ID NO: 7463 - DNA, 201 bp, Homo sapiens
tgacaatattaaactacattctcttgttgtttaatcgtctcatctagactgaatctcctctccaattataactatatccaatcccagatgaaggtctcackgcacagttataggagtgcttccgtgctggaccctgggaaggggatgctttagaagggccaggacagtatctgcgaggggctgaaggtactcttgcagatt

SEQ ID NO: 7464 - DNA, 201 bp, Homo sapiens
acatactcgatggaatactgggcagtcacaaaaaggaattacatgtgccctgtaatttcttcagtgattggaacagtaaaagtaccttttgtttaaaaaaatatttaggctgggctgggcacggtggctcacgcctgtaatcccagcactatgggaggccgaggcgggtggatcacgaggtcaggagatcgagaccatcct

SEQ ID NO: 7465 - DNA, 201 bp, Homo sapiens
tccctgtggtcatggactgtatgtataagctgcccccctgcccatccattcccaagtagcattttcctttactccagcctccacttttatcaaatttttaraaacttctttttctattaaattttatttcaattacaaagcagttcttaaattttaattcaaatctttaaactttaaaaattgcaaactgaagacgaacta

SEQ ID NO: 7466 - DNA, 201 bp, Homo sapiens
tgaagtgtaaatcagctgtaaaagttttgtggcagatcaacagaaacgttttaaggaaaaaccctctttaggaaagaaatctcattaagaaaaaaaaaaaactagcctcagcatggtggtgtgccctgtagtaccagttactcaggaggctgaggcaggagaatcgcttgaacccaggaggcggaggttgcagtgagttga

SEQ ID NO: 7467 - DNA, 201 bp, Homo sapiens
atgaagtctccataaaaggcccaagaaagcagagttcagagtttctcaccgctgaacacgtggaggctacgggaaggtgaacaagaactcatccaggtgcygggagggtggtacaccctgactctaccgggacagaaatgcctgtgcgtgggacccttgcagactttgcccctgtgtatctcttcatctggctgtttattt

SEQ ID NO: 7468 - DNA, 201 bp, Homo sapiens
acatgttgacatggctgtccgtgcgtcaatcatgcctaggcaatgaagtctccataaaaggcccaagaaagcagagttcagagtttctcaccgctgaacaygtggaggctacgggaaggtgaacaagaactcatccaggtgccgggagggtggtacaccctgactctaccgggacagaaatgcctgtgcgtgggacccttg

SEQ ID NO: 7469 - DNA, 201 bp, Homo sapiens
agcaaatgtgtttatccaaaggcacaagtttatcagtctactagattcttgattgtctgacattcattaacagagcaaccgtaacacccgcaagaggaagyggctgtggcacctgtcccctgaacgacgctgggcgctcctgcactctacacacacaagcccgctgtggcacttgtcccctgaacaaccctgggcgctcct

SEQ ID NO: 7470 - DNA, 201 bp, Homo sapiens
ggaattctattcatagactggcgaggctggaaagcagctcagaactcatttagttcaaactttcagagttccaaagaaaacactaataaaatggatcaaaygactagtctaaagtcacatggggagtcatacagggaccccataccctagtcttcagacgtctcttctgctttcaattctaccttactagctgtttcttgt

SEQ ID NO: 7471 - DNA, 201 bp, Homo sapiens
agcagctcctaatggggaaagcactgtggctgtgaaaccaccttttccagagggtattcccagttcccaatgcacacacacacacacacacacacacacahatacactgcacaactataaaaactaagtatttactgacaacgttaagaaaatttgaccaaggataaaatgaaattaagcaggcagcattataaacagcaa

SEQ ID NO: 7472 - DNA, 201 bp, Homo sapiens
tctgcttaatcagtaagtgatcataaaacacatgtgaattacaccacagcgccaaatgatggtcccattgaaagaattaagaaattgaaattcataacacrcaaatgtaagggaagagctgcttaccttttcacaaactggactgttgtcatttgcatccagaactttcacttcaactatcgcttttgatgagaaggtgcc

SEQ ID NO: 7473 - DNA, 201 bp, Homo sapiens
aaacacatgtgaaacaaggaggagccgtggagcagccaccagctccacatccctgaaagagcctggcctgacatttaacctacaaaatgctattatatgtyattaagctgatttcatattcaaatccttatgagaaaacgtaagtactaatcaaaaatgtaagtagtgctccgtatttacctaaaaactgcagagaataaa

SEQ ID NO: 7474 - DNA, 201 bp, Homo sapiens
aatttgaatggagcaactttctacactgttttaagacttaggactattttaggccacaggttagcaagatgatgaagcattcacgcagcaggagtcagcagttcctatgccttttgagcttgttggcggtctttccctaactgtgattcaaagtactccaactgttatagacaactagcatgataacgaagtcaacttaat

SEQ ID NO: 7475 - DNA, 201 bp, Homo sapiens
gaaacgaggaggagtgggggacaggaggaagagcagagaggaggaggagtgtaggagaagaagaggactggaggagaaaaggaagagacgaggccaggcgyggtggctcacgcctgtcatcccagcactttgggaggctgaggcgggcggatcacctgaggtcaggagttcgagaccagcctggccaacgtggtgaaaccc

SEQ ID NO: 7476 - DNA, 201 bp, Homo sapiens
aaatgtactaacaaaatgtcacacttcagtggaaaaagacagaatgaaaccctggttatagtaaaaaaaaaaaaatcagggtgctagataatggcactgacaccaccaaaattcagttgaaacaaatgcacaaaatatcttggaaatctagttaaaactatgaaaaatcaaatctgtacataaaatttacaaaaaaaagag

SEQ ID NO: 7477 - DNA, 201 bp, Homo sapiens
acagctagaaatgaatgactacactgaaatgtactaacaaaatgtcacacttcagtggaaaaagacagaatgaaaccctggttatagtaaaaaaaaaaaaatcagggtgctagataatggcactgacaccaccaaaattcagttgaaacaaatgcacaaaatatcttggaaatctagttaaaactatgaaaaatcaaatct

SEQ ID NO: 7478 - DNA, 201 bp, Homo sapiens
tccttcacaggcctacctctctgaggtagttcctgctcagcttcccttcctggacataagtctgcacagatgagtgaatggatggatgaatggatggatgsatagatgggtggatgggtaactggatagataggtggatggataaatgggtgaatgaataactgtatagatgggtgaatgaatgggtaagtggatacatgg

SEQ ID NO: 7479 - DNA, 201 bp, Homo sapiens
atctttaaggagtgctcatgctgcagctctcgatccagagggcgtgcgatgttaacaacacccgtcacgctgtcaattgaaaatgtgtctgtgtctgtaasaattgagtacgtcacgtgtccgttgggccccaggtctttatctgtggcttcaacctggatgatttcactatgtacctccttgtcttcactcacttccaca

SEQ ID NO: 7480 - DNA, 201 bp, Homo sapiens
tacatacttaaaaacaaaatttccatatatcatgttaaaaatgttaaacttcatcagtaaaatatgctaaattgtcattttaaagtatgtgttaaataaayagtacaccttttaataccagtaatcaccattttattttggctgttttcctctacagatttttataggagtggacctaaacatttaaatttaagaccaact

SEQ ID NO: 7481 - DNA, 201 bp, Homo sapiens
ctgcattggggccctcatccttgtcggtggctatgacgtgatagagcggctcccgtctggcatttctttctcggtctggcttttcccgctcagggagtctrattttgtagaacttttgcagaaactgaggtttgttgtcattttcatcaaggattttcacaatgactcttgcaatggttgatttggggggactaccattgt

SEQ ID NO: 7482 - DNA, 201 bp, Homo sapiens
aaacaaaacaacacacacgacgtcttaagagaaacctaaaaccacggagctaggtgagcattacgtggcaacacgctggcgagtgggatgggtgaccatgygcacactatgaaaaaaaaaacagcgatggaagatagtcactggaaataaaaaagtaaaaaaaaacaaaaacaaaacaaggcttttattttagatctcata

SEQ ID NO: 7483 - DNA, 201 bp, Homo sapiens
atatttccaggttctcagctaaagaggaaaaataatctaaacacaaatcattccctttgtcccacaccttaacaggtcaacctgggctactgttctcttayagtccgactgcctttctctgccagcgattaggatagcatctacagcctatgacaatggcccaaaaataagttacagaagtataaaggaagcaatgaaatt

SEQ ID NO: 7484 - DNA, 201 bp, Homo sapiens
tcctgagtcagcatcagatgccctgatctgaattactctacttccccctggcaggttttcaacaatgaatgcctcatatggactagattcaaagaccgggytgttgtcatttgcatctttcacttggatactaacatctacagaagccaccatctcatggtcatcttgagtgcacctggccagtatggaaaactgatacca

SEQ ID NO: 7485 - DNA, 201 bp, Homo sapiens
ttggtatgaattttttttacctgttatgaaatatgtaacttgtctgttgatctcttcagaatcagcatccgtggtacttaagatggcaatcaccccacctdgggggtcatcctcactcacagtccctttatagatctcggccgtgaatcgtggtggactatcgttgacatcggtgacggtaacatccacaatggctgtgga

SEQ ID NO: 7486 - DNA, 201 bp, Homo sapiens
tgccatcagttgccgtgatagtaagaaggtaattgtcccttttttccctgtctagaggtttcttcacatataccttccattcattctgtatagtttcaacrgcaaactgtcctaaaggatcccctcctattaaatcaatggaggaagataataatcaaatttgttgaaaggataaaaataagtaacagaaaaaataaactg

SEQ ID NO: 7487 - DNA, 201 bp, Homo sapiens
ccagggaccacccctgctcgagccacatgccctcatctaaccttggagggagcagcccttcctacgtctacttttagttcccactgaatggtgagccgcgmagatgcaggaagcacgctgtccacctctgagcttctccagcgtgcagaagagcagatgcccccaaaacagtgtctcacggcacgtcggcactttgtttcc

SEQ ID NO: 7488 - DNA, 201 bp, Homo sapiens
ccccagggaccacccctgctcgagccacatgccctcatctaaccttggagggagcagcccttcctacgtctacttttagttcccactgaatggtgagccgygcagatgcaggaagcacgctgtccacctctgagcttctccagcgtgcagaagagcagatgcccccaaaacagtgtctcacggcacgtcggcactttgttt

SEQ ID NO: 7489 - DNA, 201 bp, Homo sapiens
taagtgacaaaatgaggacggcctccttgctaacctggtttggacgtgtaactaatatgagcacagtataaatgagagtgtttctgtggggatggcctggmccactctacgcacacagaatgcaaatatacctccctgagagaacagcagaaaaccaaagctttggaaatcccacttaatgacagtattatttttgctctg

SEQ ID NO: 7490 - DNA, 201 bp, Homo sapiens
tgagataacacagtaacacaacaagcaagcaaagcgcagtgttgcagcacactgctgcctcaccattgtcatcgcacgattcggactggaaggagctcagrgactgcacttcagacaggctttcccgggcactgtatggctgggaaggcttttcctctagaggcttcttggaaagacagggatcaagatccaccacttttg

SEQ ID NO: 7491 - DNA, 201 bp, Homo sapiens
ggaggaaagtgactgcggaatgaggaaccagaaatttggccagaaaactcaaatattactttcttttccttgtttctgacaatcacagcctgaaaacacaraatttccttaggaataatgaaaacaaaacaaacaggctctaataaaatataaactgatcagattacataggtgataatccaaatacatctacagctacat

SEQ ID NO: 7492 - DNA, 201 bp, Homo sapiens
aggagtgccacggtctcagtaaaatggaaaaacctgtgggcagccagggcagaagctggagggcgaccagagcagtcagaggctgcagccacaacacaggyggagcgcgtgtgggctggggcacaacgggggtggggggcagattgtgaatctatttcaaggttgcctgatgcactggagtggggagagggagggaaagga

SEQ ID NO: 7493 - DNA, 201 bp, Homo sapiens
tctgctaactccatttatatgttgttatctttgactggggctgcaataatctggtaactctagcaagacatactttaaatattgccttcacatgatcaacmaccggttccaatttaaccctgagaatggtctttactgacaatgacagtgtggaactacaatctggctttttcagaaaacttcaccatgtacatgatttaa

SEQ ID NO: 7494 - DNA, 201 bp, Homo sapiens
atccacattccaggacaaactttgcccaaggagaagctcaatggactgttgacctcttgtgaatggagatcatctcatctaatgtatttttctccacaaayagaagtaatttaaatgacatcttggcagagtagccaataatcaacaatggccacttcttccactcccaagttggtaagtaagactttattttatacgttg

SEQ ID NO: 7495 - DNA, 201 bp, Homo sapiens
gccacttcttccactcccaagttggtaagtaagactttattttatacgttgaattgggctccctgtataattagattcggtcaacccttcactaaatgacrgaccaggaaagtgaatgttccatgtacagcaagaaaacggaaatcttcagggagaaaagtccatcttccctcctcctcttaaaatgttctcttcacctgt

SEQ ID NO: 7496 - DNA, 201 bp, Homo sapiens
cttccactcccaagttggtaagtaagactttattttatacgttgaattgggctccctgtataattagattcggtcaacccttcactaaatgacagaccagraaagtgaatgttccatgtacagcaagaaaacggaaatcttcagggagaaaagtccatcttccctcctcctcttaaaatgttctcttcacctgttctctct

SEQ ID NO: 7497 - DNA, 201 bp, Homo sapiens
tcggtcaacccttcactaaatgacagaccaggaaagtgaatgttccatgtacagcaagaaaacggaaatcttcagggagaaaagtccatcttccctcctcytcttaaaatgttctcttcacctgttctctcttcttacacctcagaagagatgccacccaccctagctgcaaataaagatactctgataccacaaaatcct

SEQ ID NO: 7498 - DNA, 201 bp, Homo sapiens
tttgttcatgcagagtattcctacagtcttttggtattcctgctttctgcccccaatcccagtcaacctattcaaacttctttgtgatattattctttagyttgaaaatattcagtatttccccttagcctgctaagtatatgattcttaaccttgcattaaagacctttgataatctaacctctaactaatttcctaatt

SEQ ID NO: 7499 - DNA, 201 bp, Homo sapiens
acaatcctcccttttttaataagattatttaagtcatagtcaagattctctatgttctacctagacaaaaaaaagaagccaatccttttcctaagataacmtggtacggtgaggtcttcagaatttctctccactcatcacaccacaagccacactatgctttctataacttgctttgcacacatcatttcctctgcttga

SEQ ID NO: 7500 - DNA, 201 bp, Homo sapiens
ctcatcagaatatatttttgaaatgaaaagttcccctcaggtatgagaaaatggcaacttcctgatcttaactgatgtatatcactcatttcaaaaactcytctccagtgtctaaggataaataagcacttgcaaactgaacaattaagtgagaccaaaagatagagtttggcttcaacttctacataatttggtcaaaag

SEQ ID NO: 7501 - DNA, 201 bp, Homo sapiens
agcacttgcaaactgaacaattaagtgagaccaaaagatagagtttggcttcaacttctacataatttggtcaaaagaacaattatctagcgcaaatcccrctcataaagattaaacagcacatccagccttacggctccctgctattaaatcaggtcctttaggctacaaattatgccactgagacagaatctaatgcaa

SEQ ID NO: 7502 - DNA, 201 bp, Homo sapiens
cggctccctgctattaaatcaggtcctttaggctacaaattatgccactgagacagaatctaatgcaataataatgtactaatttgatttggctgattgaytctacgtaaaatcagccaaacttgggtggaaagcaagcgggtaaagtgttaaaacataatctctaagatcctatccacctctaacattcaaagaaacgac

SEQ ID NO: 7503 - DNA, 201 bp, Homo sapiens
gctctcgtggagctcacccgccgtctcagcgcgcccccgagcagggaccgggcctgccggggccctcgccgggctcgcgcgtccgcatggtacctgccgcrcgagccgctcccgcgccctctccccgcgcccggccgcccagctcggcgccggcgcctcacgctccccgagcgcaggagatccctccgccccggccccgcc

SEQ ID NO: 7504 - DNA, 201 bp, Homo sapiens
gatgctggatgttcctatttcatgaattcatgactgtgtacttttataatgcctatcgtgattgctgagataagcttctgcttcgatgcattttaattatyacctctttgtaagataaaaaatcactgaatacaacttacggagaactataaagtaaatttcaactgccaaagggagaggagggcacaccgaagaatctta

SEQ ID NO: 7505 - DNA, 201 bp, Homo sapiens
caactatgaaccaaggggtgtgctgtaacaagaggaagcaaaacttactactgtcattctttattcatctccacatctgtcttcttacaataaacatactytgcaatatttttagactccaataaagaagaaaatggtaagaaacaatgaaaccgatttttaaaaataaaagtatacccaaccattcaactctcacctggg

SEQ ID NO: 7506 - DNA, 201 bp, Homo sapiens
gcgctctcgtggagctcacccgccgtctcagcgcgcccccgagcagggaccgggcctgccggggccctcgccgggctcgcgcgtccgcatggtacctgccrcacgagccgctcccgcgccctctccccgcgcccggccgcccagctcggcgccggcgcctcacgctccccgagcgcaggagatccctccgccccggccccg

SEQ ID NO: 7507 - DNA, 201 bp, Homo sapiens
gcctgacagaagaacaatgatttcatgaccacattcaacataaacaataagcaccctgattctcaaacgttatccggcattgcctaatggggccagcaggycacaaacacttcagccgtttacaaaatagaaataaagttactaaagaaaaaatacaaaataaggtttatagtcacaacatatgaaaaattacagtactac

SEQ ID NO: 7508 - DNA, 201 bp, Homo sapiens
caaagttgcgttttacaggcacatcttgatctcgtacctaaaaagaattgacacattatcaatcccattggtgctttccttataactaattaaaaatcacrctcgaacacacaaaggcctcaggaccaaatggtgggaggagagcgggtagagcgcctaccatgaccgtgagggtgtgctggtgaacagcttcatgatcca

SEQ ID NO: 7509 - DNA, 201 bp, Homo sapiens
acttcagcatttttccctttgtccttgtccagagccgtcacctgcaacacaactgagccaacggctgccgattcataaacccgccctttgtaggaggaagyggtgaaccacggggcgtggtcattcgtgtcgctgacattgaccacaatccttgcaaagttgcgttttacaggcacatcttgatctcgtacctaaaaagaa

SEQ ID NO: 7510 - DNA, 201 bp, Homo sapiens
cgtatcaaagaaaaggacaaatttctttatagcacttcactaattcacactgaaacccagctctgtcaatgactatgacagaatcaacaatgagctccttsaaacacagcgggataaaaatggaaggtatggcaaaaaacaaagacagcaattctatgaaagtttgtttttgtatgaaatgtaagctgttcaaatagaaga

SEQ ID NO: 7511 - DNA, 201 bp, Homo sapiens
ttgatcacacgaaattaaatattaacttattcgaggttaatatcagaaaaactcattttttgaatgaatgataattatatctaatactcccaaaaggactyacaacttgaaaatagaaaacttagctaaataaaatgtgaaattatcataaaatgaatctttattgccattcagaagcattacaatgatttgttattgctt

SEQ ID NO: 7512 - DNA, 201 bp, Homo sapiens
tacttgtttcttcatagtccagacttagtactgtatgaatagcaccagtgctagaatcaatagcaaaatatgtgtgtacagatggttcaacaatgtgatayacaagcaaagcatttgagtctttatcagcatcagctgctcgaatcaccagtgggacattcctgtctgttaggaccacgctgttaattgaggctgattcac

SEQ ID NO: 7513 - DNA, 201 bp, Homo sapiens
gcatctgccagtcaatatgacgctatgaaaaggtatgaacctaaattttgaaagaaaccatttacctttctcccctaaaacccgaatcacactgacaaacrgcgccatccaaactgtcaaagcatgttccgccattcttacagggttcatctttgcagtatggactaagctgacacctgaagagtaaggagaaacagacat

SEQ ID NO: 7514 - DNA, 201 bp, Homo sapiens
ttcatgcaagtatgtatggtattgtttaaaagtggtccaagaaaaatgaaaatatggtgaggctttaagggtagatagtgcgtctacattgtgagataacmcagtaacacaacaagcaagcaaagcgcagtgttgcagcacactgctgcctcaccattgtcatcgcacgattcggactggaaggagctcagagactgcact

SEQ ID NO: 7515 - DNA, 201 bp, Homo sapiens
atattaactgttgtgaaaaaaagccaatataagattagtcgatcagatccttcaatgaatatgttcttctctattactgacaagttcaaacacctattcawtaagaacagtttggctattttccccagcagacattcatgcaagtatgtatggtattgtttaaaagtggtccaagaaaaatgaaaatatggtgaggcttta

SEQ ID NO: 7516 - DNA, 201 bp, Homo sapiens
aatgaaaattcaaaactttgctctatcataaagaaaatgaattcaagcgaactttacaccctatgaactaaaaactcagatgtaatacatgaagcagctcytaatggggaaagcactgtggctgtgaaaccaccttttccagagggtattcccagttcccaatgcacacacacacacacacacacacacacacatacactg

SEQ ID NO: 7517 - DNA, 201 bp, Homo sapiens
aggacactccagatcaccctccccctcaatttcacactcggattatactcagctgtctaaatccctcaggattagcttgtcaggacctcccacaaaagaawgaaagtcaagtgagatagcttctttttcagggcagttccctataaagctctgtcttctagaatgagttgtgggagaagccagaaagctggctagatccca

SEQ ID NO: 7518 - DNA, 201 bp, Homo sapiens
gtaagatgggagcagccttccttagggccccaagtttgctctcagtggaagtagacagacatgagctgcctcccgcaccttagcgctgactcatttccaaygcctcaggacactccagatcaccctccccctcaatttcacactcggattatactcagctgtctaaatccctcaggattagcttgtcaggacctcccacaa

SEQ ID NO: 7519 - DNA, 201 bp, Homo sapiens
tcaggcaaaagacagaatgcacgttcattttcacaaggccgacagagctccaatgaggagtgtcctcctgagagtcctgacgggcaggtcccagtgagctrccactatctgttgcatcctgcctgtgagcgatgccctaatctcctacaaacgagtgcatgcaagtaatacacatttcccaacagcaagaattaccaataa

SEQ ID NO: 7520 - DNA, 201 bp, Homo sapiens
tctgctctatctgaaaggaagagaagaaaggtggagacgggagtgtggtggtgaggaggagggaaaggagaaggggtgtagcgaaaagggaagaaaaaggmggatgatgaaggaaacatggtaagaaagggagtgtgaggaggaagagggaggaggggaagcagaaacgaggaggagtgggggacaggaggaagagcagag

SEQ ID NO: 7521 - DNA, 201 bp, Homo sapiens
agggttgttttttttaaacaagtggtataaacgccttctaaattttaaatccttttttcaattaggtgatattcttgctgttttttaaaaaatctcacctygaattttacgcactaaattgctggtaagatttctaagagatgtcaacttcggagcatcagaatacatttgaaaagggcaaaatgtaatttcaaattttgt

SEQ ID NO: 7522 - DNA, 201 bp, Homo sapiens
tctaaattatgctaagttataaatttatggtcaccaattcaagaaaatatgctatttaaataaaatggataaaaagcagaaagcttgagttatattttaayttctgagggttgttttttttaaacaagtggtataaacgccttctaaattttaaatccttttttcaattaggtgatattcttgctgttttttaaaaaatct

SEQ ID NO: 7523 - DNA, 201 bp, Homo sapiens
atacttctagttccaactataataaataaggaatactcaacctgtggtatgactgaagaagttattctctgctatcaaatgctacaaatatacattctatmgtccaattttctctaaaaaaattttgaaaggtttgtaaacctatcataaagcatttgcttccattatgttgcaatgaggctaaaagctctctctgtcctc

SEQ ID NO: 7524 - DNA, 201 bp, Homo sapiens
ctgtggcctgcactcttgtcagcagcgttcccggctctgtgttttcaaacacggtgatggcataaggatcggcagagaattcgggggcgttatcgttcacrtcttctagcgtgagcacaatactggcttggcagaatcttcctcctccatctgtggccctgacgagaagatgataaacagcttgctcctcacgatcaaggg

SEQ ID NO: 7525 - DNA, 201 bp, Homo sapiens
ctctatctgaaaggaagagaagaaaggtggagacgggagtgtggtggtgaggaggagggaaaggagaaggggtgtagcgaaaagggaagaaaaaggaggakgatgaaggaaacatggtaagaaagggagtgtgaggaggaagagggaggaggggaagcagaaacgaggaggagtgggggacaggaggaagagcagagagga

SEQ ID NO: 7526 - DNA, 201 bp, Homo sapiens
tccatctgagggtcgagactgtaggttagagtatcatacacgtcctggtctgtggcatggatcttcccaatgacgccacctgagtattcttctccagaagmggtgatgaaaatctccaggggcaaaatcgcaggcggatagatgctctcctcaattaccctaatgtcaatgtatgtcaaagatgacaactgaggctttcca

SEQ ID NO: 7527 - DNA, 201 bp, Homo sapiens
gaaccccacacatctggtgtcagaagcatgttctgagagtctaattcaggaaactgagtttgttttctatccataagcaggaagtatctcacatcttattwaaaaaactgtctgctttttccaaaacctaaatacaaattcaacatgggaaaaaaaaaaacatagcatagtacttacaacactgttgccattcctaaagct

SEQ ID NO: 7528 - DNA, 201 bp, Homo sapiens
ttgggggaaccccacacatctggtgtcagaagcatgttctgagagtctaattcaggaaactgagtttgttttctatccataagcaggaagtatctcacatyttatttaaaaaactgtctgctttttccaaaacctaaatacaaattcaacatgggaaaaaaaaaaacatagcatagtacttacaacactgttgccattcct

SEQ ID NO: 7529 - DNA, 201 bp, Homo sapiens
aactaaaaactcagatgtaatacatgaagcagctcctaatggggaaagcactgtggctgtgaaaccaccttttccagagggtattcccagttcccaatgcrcacacacacacacacacacacacacacatacactgcacaactataaaaactaagtatttactgacaacgttaagaaaatttgaccaaggataaaatgaaa

SEQ ID NO: 7530 - DNA, 201 bp, Homo sapiens
aaagaaacagctgcacccctgcgcgccttcctgaccacgcaggctctcttctcgcattagtttaagtggaaagtgaacctcacccaaatgttaagctaccraaaacttaatacctttaggccatggaagagatacgtgaagattctgctttacacatttaaagagtcttcttaaaaacaacacactctacatacttaaaaa

SEQ ID NO: 7531 - DNA, 201 bp, Homo sapiens
agaccaaaaacatcctgctatgccaggactgcttcctggtggtcccccttgttatcccgactctggatctcttggcctctgggtcccggaaccgtccaggmccgcagctccagctgttttttttgctgcccttgctgcctcaagccccaccccagcaggccccagctctggggtctagtcctcaacccaattccatgaggg

SEQ ID NO: 7532 - DNA, 201 bp, Homo sapiens
gcaaggttacacagcgaggtcaggtactgcacagcagcagcctgttgatctggaaatgtgataaaagttaacagaaagcaaacaaacggttttgagcatcrttaactacgaaaatagtctctttttccccttcccttgaaagtatgctgtaagggtttcacaggtgctgatgacatcaatttcacacaatcaccaaattgg

SEQ ID NO: 7533 - DNA, 201 bp, Homo sapiens
cacatttgtattctgtgtatggaatgcctgacagaagaacaatgatttcatgaccacattcaacataaacaataagcaccctgattctcaaacgttatccrgcattgcctaatggggccagcaggtcacaaacacttcagccgtttacaaaatagaaataaagttactaaagaaaaaatacaaaataaggtttatagtcac

SEQ ID NO: 7534 - DNA, 201 bp, Homo sapiens
agttttcggttcgatgaaaaatttgccatgctcattcccgtcttcgatgctgtaggagatttctgcattggggccctcatccttgtcggtggctatgacgygatagagcggctcccgtctggcatttctttctcggtctggcttttcccgctcagggagtctgattttgtagaacttttgcagaaactgaggtttgttgtc

SEQ ID NO: 7535 - DNA, 201 bp, Homo sapiens
ttatctttgtcagtgactgcatttgccccttctgtcaatccttgtagtgacagaatgaaaattcaaaactttgctctatcataaagaaaatgaattcaagsgaactttacaccctatgaactaaaaactcagatgtaatacatgaagcagctcctaatggggaaagcactgtggctgtgaaaccaccttttccagagggta

SEQ ID NO: 7536 - DNA, 201 bp, Homo sapiens
cttctgcagagcacttaatcactcaccaacagcactgcgcaaatacttatgagcaaatacaactccccacttcacgatttacttagagcacacaagaaggytaaggaaagctgtacctgtgtccatactaccaattccacataaaaaggctgggcatggtggctcacacctgtaatcccagcactttgggaggctgaggca

SEQ ID NO: 7537 - DNA, 201 bp, Homo sapiens
aagtatgtccacttctttcattttcgacatctgtgctcatctgcaatattttttgccaaatcccagaaagatatatacttaaaggaaactgtacagaactkcagaactagacagaaacctttaagattatcaagttgagctgcctgaaccaaagagaagttaaaattttccaaggccactagtaagtcattaacaaagcca

SEQ ID NO: 7538 - DNA, 201 bp, Homo sapiens
aatgtagaagagatctaacagtctactaaccaacttgcaaaatcgtatctgagatctcaaccttgatactgatactctaattgctctatttaaagaataaytttgttattaacaaccaagagaagtgaaatacaaacatcctttctaagcactcttgcttagagcaacgggagggattcaatttttacttcagaaatataa

SEQ ID NO: 7539 - DNA, 201 bp, Homo sapiens
aaatggttgaaaaaaacttttgtgatacatgaaaagggcagaaaattcaaattttattgaatttatttcgtttatttacaaagttttactggaacacagcrgtgctcactcatttccgtatcatctacagcagcttctgggctacagtgacacggctgagtggtgtgacagagactgtatggcccacaaacccaaaagccc

SEQ ID NO: 7540 - DNA, 201 bp, Homo sapiens
tggtcgtggtggtgcaggtctgtgatcccagctattcaggagaccgaggaaggaagaacttgggcagaggagtttgaggctgcagtgagccaagatggcaycactgcactccagcctggacgacagagtgatacactgtctcgaaaaacaaaaaaaaaaacaaaaaaaacttcactctacaggatggaggaaggaaaacct

SEQ ID NO: 7541 - DNA, 201 bp, Homo sapiens
gtcgtggtggtgcaggtctgtgatcccagctattcaggagaccgaggaaggaagaacttgggcagaggagtttgaggctgcagtgagccaagatggcatcwctgcactccagcctggacgacagagtgatacactgtctcgaaaaacaaaaaaaaaaacaaaaaaaacttcactctacaggatggaggaaggaaaacctaa

SEQ ID NO: 7542 - DNA, 201 bp, Homo sapiens
gaaagaaaatgcaaacactagttgcctctaagtagattttattattcaggtatggtgaggcaacagatcaggtacgaccgccagtacctgaaagtacctgmaaaggcagtttggtacttccccaagaggaggccataccaccgccactgaaggtggcaaaggccgaaggccgtgctgggccatacgggaccatgccagggt

SEQ ID NO: 7543 - DNA, 201 bp, Homo sapiens
acgctcaggactggctggtttaagtaatttcaaaggctctggggcatagctgtccccagttgtctagcactggctctgatatgacttgggcgtgacacagrtggtggtgtggagtgggactctggactggtcagcttgcatatgaaaagcacggtcctgcaccagtcatctgctatcccgagtcctggaaggggcagtcct

SEQ ID NO: 7544 - DNA, 201 bp, Homo sapiens
tgggagggggaatacagagaagtgtgaggagacctttgggaatgatgggtgtggtcactgcctgatagtggtgatgttttctcaggtgtaaaagctatgtsaaagcttatcaaattgtagactttaaatatgtgcaatttgctgtaagtgaattacacctcaaaaaagctttttaaaaataaagatcaatacttggtttgt

SEQ ID NO: 7545 - DNA, 201 bp, Homo sapiens
ataagaatgtctgaaatgcagacagacagttcttggcaccataattaagcacaaaaaccttgaagagaaaaaacattcaaaaaagttcactcaaacttgtkgtttagaacacaaaattcataagctcactcactaaacccactcctagaaagctttcttgttgtgacttttaaaatattttgttacactatgacaaaaggg

SEQ ID NO: 7546 - DNA, 201 bp, Homo sapiens
tatttcttgcttgctcatctatctcttcacagaggacttactctaatctaaaagagagacagaagacacaagaaaattgaaaacactgcttagtctaattmatcaaacaaattactataggggtagttctggtcttgaattgccacctgagatatgacatatacgtgtgttgtggggaggggtacatatttgtttctgtcc

SEQ ID NO: 7547 - DNA, 201 bp, Homo sapiens
gtgcaatctcgccctttgtctaccaaaaacatatcactgcactttttctcatggattgatcactcgggactaaagatactttcagtgttcttctacaccayggtacaggctggactctggaaatgctgaagctctagaatcactgaagtttcccgttaaacgcaaactactgtgagaaaaataaccaattaccaattttac

SEQ ID NO: 7548 - DNA, 201 bp, Homo sapiens
atgtgcaaagaaagaccaggggtagagctagccttcgccatctcaaaatcaagcattagactgggaacgccttcaaaaccctccagtgcaactcccttgtycttaaagaacgttgaaatgatttgtccaactccaagaagctaaacaggtgtagttcagaatccagagtgaaggacttccttaatcaggggttcatcacga

SEQ ID NO: 7549 - DNA, 201 bp, Homo sapiens
gaggagggagggctgcagcccaggccttccgcaggattccctccagccagatgccgggagcaacagagccgtgagaggggtgacagggaaactctgtcgcyactcccgtcaggaggttgccgtgcacacgcagtgagagcggtcgtgatgctgctgcgtgatgctatgacgcagatttggagcacaggagacaggttgaga

SEQ ID NO: 7550 - DNA, 201 bp, Homo sapiens
atgtaccaatactgattctttaattgtaacatcttacatactcatgtaagatgtcaacaacgtgagaagctggggcagggagcagggagttatgtgagcaytctactttctgctccatttttctgcaaatgttttatttttttaaaaagttgtctatgagagctcataatatgtagattgtttccttccttcaattaaaaa

SEQ ID NO: 7551 - DNA, 201 bp, Homo sapiens
ctgctaaaccatgttgtcccgctttgttgaggaatgattccaagttctgacttccctgtcagaatcactgatattgtcaatgacggcttttgtggataagstctactgttaaagaggatcacccttgggtatcaaaacttatcatctggacacctgttaattggataaaactacatccacaagacagccttcagaagcatt

SEQ ID NO: 7552 - DNA, 201 bp, Homo sapiens
tacttctaatacccaatttgttgccaaaaccaatacctgtaagaactcagaagcttaagttaggtcaagctaacctaatcaggaagtgattcacggacacygataacctaggagaaacttcagatatgtccttttatgctaacgcttcatattaaatcaaacagccctatctaataatctaaatgcactgcaagatttgat

SEQ ID NO: 7553 - DNA, 201 bp, Homo sapiens
accaagatttcttagtggtaactgtggggcagacaaatgaagtatttaatatgcactattttatgcaaacaggaaacaaatctcataaagtactttgaaasagaattaaaacaggaggaaaacggattactgctaattcatcactttagagactatgaagacaaatcttgctggagacattaaaagactatataagaatag

SEQ ID NO: 7554 - DNA, 201 bp, Homo sapiens
tattcaaactaaccactagaaaaaacaaattcaaaaacacacaagtgttcattataacacactagttgtaattaagtagcagggtggttactaaaatataygtatcggagaagataaaaatataaataaatagctaggcgcagtggctcatgctggtaatcccagcactttgtaaggccaatctagtaggatccttgagcc

SEQ ID NO: 7555 - DNA, 201 bp, Homo sapiens
ctgcactccagcctgggtgacagagtgagactctgtctcaaaaaaaaaaaaaaaaaaaaaaaaaaatgggggttgggggaaccccacacatctggtgtcaraagcatgttctgagagtctaattcaggaaactgagtttgttttctatccataagcaggaagtatctcacatcttatttaaaaaactgtctgctttttcca

SEQ ID NO: 7556 - DNA, 201 bp, Homo sapiens
caacactgttgccattcctaaagctcaaatatttccagctcatgacagtatcagatatatgggttcaaaaggaaaagcatgttatcaagtctacagtttaraagatgatttttgaaaaatgactttgtgctaaactcttggattgagattgccttttcattcagcaatttatgaaagaggtggtgaagcaatcgtatattt

SEQ ID NO: 7557 - DNA, 201 bp, Homo sapiens
cactgttgccattcctaaagctcaaatatttccagctcatgacagtatcagatatatgggttcaaaaggaaaagcatgttatcaagtctacagtttagaaratgatttttgaaaaatgactttgtgctaaactcttggattgagattgccttttcattcagcaatttatgaaagaggtggtgaagcaatcgtatatttttt

SEQ ID NO: 7558 - DNA, 201 bp, Homo sapiens
agtatcagatatatgggttcaaaaggaaaagcatgttatcaagtctacagtttagaagatgatttttgaaaaatgactttgtgctaaactcttggattgarattgccttttcattcagcaatttatgaaagaggtggtgaagcaatcgtatattttttcccacttattttactacattggttggtttgctgtagcaggcta

SEQ ID NO: 7559 - DNA, 201 bp, Homo sapiens
gacctaggcacacatctcaatcactggtcaagagtatcaccgaattatttcggaattggagagggaaacaagagtgaatgtaggttttattctcagtctgytacttcaaagtattggccttataatcaaccatccttacagcatgcctgttaactgtcccaactcagcattttaataaatgtgtgactttggcaatttatt

SEQ ID NO: 7560 - DNA, 201 bp, Homo sapiens
tgggagactaaggcgggtggatcacctgaggtcaggagttcgagaccagcctggtcaacatggggaaaccccatctctactaaaaatacaaaaattagccrggtgtgctggcatgtgcctgtaatcccagctactcgggaggctgaggcaggaggattccttgaactcgggaggtggaggttgcagtgagctaagatcaca

SEQ ID NO: 7561 - DNA, 201 bp, Homo sapiens
gatcacaccaccgcactccagcctgagtgaaagagcgagactctgtctcaaaaaaaaaaagaaagttgtaaatgtttctaacatgatgcgtatgcatgaaracagactttttgaactaaaaacatgcttctgaaagaaaacaacttttaatgatttgtttttaaagtagttaaaacagcaatcttatttcaagggtttaca

SEQ ID NO: 7562 - DNA, 201 bp, Homo sapiens
cactccatctaaggaggccatgcacaccctgcaaaaatccttaacacatgccctgttttcctccacagcaccgctcagctgaaactgtgcgttcttttctyctcatctccgtgttgactcgtgtctcctctctccagaagaatagctccaagaagggcacagcaccatccaccttgcaaactgtggagtcctgggctccaa

SEQ ID NO: 7563 - DNA, 201 bp, Homo sapiens
taaggaggccatgcacaccctgcaaaaatccttaacacatgccctgttttcctccacagcaccgctcagctgaaactgtgcgttcttttcttctcatctcygtgttgactcgtgtctcctctctccagaagaatagctccaagaagggcacagcaccatccaccttgcaaactgtggagtcctgggctccaagaagggcac

SEQ ID NO: 7564 - DNA, 201 bp, Homo sapiens
caaactgtggagtcctgggcacctagagcaggttctggcattctagaggcggtcaataaacgtcaactaccagatgaatgaatgcatggaagggcattcasccaagccttctttcaccctctcaaatcttgcctctgtgaaattttccgaaagttttgctttcaaaggccactcgtgatttctccaaagcctttttccttc

SEQ ID NO: 7565 - DNA, 201 bp, Homo sapiens
tcgtaggagacgtaggaccatgaactgtgctcctccccgggatgcacctgcctccgcccgaacactgccatgcacagaaaatggaactgacgctcggcccrttttcaacagaatgaaacagctaccacatttctttaggacactttaaataattaccatgtattttctaaagcaactaacattcctctcacaagtgaatga

SEQ ID NO: 7566 - DNA, 201 bp, Homo sapiens
atctgtaagagactcgtattcccttcaactgaggtgagcattgctctctctactaaaaaagagaatactggcaggtcctgagctttgctctatctggtagkttgcatttgtagatgagtccgtctctaagcagccagcaagctgtaagcacaccggttgtgagaatctgtataaggaaatctacttccctcagttaaactc

SEQ ID NO: 7567 - DNA, 201 bp, Homo sapiens
cactaagctaatgaagaataaaatatgtgtcaatttttgaatgagtgttcttttttccaagggctcaatgaaagcatcttggcataattaaatcaatatastaatctcaacatctgggcctgctctgttgaaatgcaaccctctgcctcaatacaaatctcattttaatatttaattattgaatctattgcctaaagtcag

SEQ ID NO: 7568 - DNA, 201 bp, Homo sapiens
aatttaatttgacaagcctgatagcagcgaaaacgaaaaattcaactacttctgattttacgaagtagcatctggccaatgaaatgaagagtgaaagcatrttttacagtctgtccatccctcattagcctttatctggcatacaagagacgctttttaaacaattaattaatgtgaagaaataagcctcaatatgcactg

SEQ ID NO: 7569 - DNA, 201 bp, Homo sapiens
gagaaatgggcactcacaaactgctgatgggatgtctagttctcataaaaacaaacaaacaaaaaaaaagaacagcttttaaaaatttcattacctttcamccagcaatttcacttcctgttatttacgctaaggcaacagagatacacacaaacaaggaacttacatattcaaaaattgagtattactatacaaacagga

SEQ ID NO: 7570 - DNA, 201 bp, Homo sapiens
ataggtccttaatatgtatctgctccctgaactgattcctgttcataaggtaatcgcggaccccatgtggtcctttcacaggggcttcggcaaatcccctrcagtgagatggcccctgggcagctctgttttctgcagaccaggctgtgacctaatcaatagggttccaagcaagacaatccctacattcaacagctcgga

SEQ ID NO: 7571 - DNA, 201 bp, Homo sapiens
taggtccttaatatgtatctgctccctgaactgattcctgttcataaggtaatcgcggaccccatgtggtcctttcacaggggcttcggcaaatcccctgmagtgagatggcccctgggcagctctgttttctgcagaccaggctgtgacctaatcaatagggttccaagcaagacaatccctacattcaacagctcggaa

SEQ ID NO: 7572 - DNA, 201 bp, Homo sapiens
gctgagtaacttttattaaaaaaaaacaaaaaaccaattgatttaaaactaaaaagactgtattagtagactctccccaacatgaaatgagtaagacattytaaagaatcccattcaacaggttgagccactcggaggcctagcaatggaccgagttcaacatggtatcagatattcgaggagatatggtactgttgaact

SEQ ID NO: 7573 - DNA, 201 bp, Homo sapiens
acaagaaaagccttccaacaattaacgtcctgtccagttcagatgggcagcatttttaccgattaaatcacacttttacaactgcaaacacaaatatgacrcctgtccatctcttcaatggccaatgagacaagggaagctacaggcactcacctggattcacccacgccttcgctggcctgatcttgacttgctgactgc

SEQ ID NO: 7574 - DNA, 201 bp, Homo sapiens
cagaatgccgggcccagtgcccggctgtgacactcagtgtcgtggttattactagactggtgctcaccaccagtgtcattaccactgacagcatgaggacraagccggcctgtctgacgtaagctgtttccaccccacacctccgggtcccggcccctgcacactctgagaattacatcacagcacggtaagcgtcactgc

SEQ ID NO: 7575 - DNA, 201 bp, Homo sapiens
tgccgggcccagtgcccggctgtgacactcagtgtcgtggttattactagactggtgctcaccaccagtgtcattaccactgacagcatgaggacaaagcyggcctgtctgacgtaagctgtttccaccccacacctccgggtcccggcccctgcacactctgagaattacatcacagcacggtaagcgtcactgcgtgct

SEQ ID NO: 7576 - DNA, 201 bp, Homo sapiens
gttattactagactggtgctcaccaccagtgtcattaccactgacagcatgaggacaaagccggcctgtctgacgtaagctgtttccaccccacacctccrggtcccggcccctgcacactctgagaattacatcacagcacggtaagcgtcactgcgtgctgctccacaacgtgggacggccctgagtcacggtcccccg

SEQ ID NO: 7577 - DNA, 201 bp, Homo sapiens
gacagcatgaggacaaagccggcctgtctgacgtaagctgtttccaccccacacctccgggtcccggcccctgcacactctgagaattacatcacagcacsgtaagcgtcactgcgtgctgctccacaacgtgggacggccctgagtcacggtcccccgagttcccatccacagcctttccaggctagacttgttcagtca

SEQ ID NO: 7578 - DNA, 201 bp, Homo sapiens
tagctgtgattctcagactgtggaaagacacctttgcacctaagccatccattagcgatcgctttaatgacaatacccccgagttggggtttaaactaaasaaatccagttcatttccagcttcaatctgatactgtaccaactgaagttcatctgcatcaatagcagaaacagtggttatttgctctcccacgcctagat

SEQ ID NO: 7579 - DNA, 201 bp, Homo sapiens
gttcgtagtccaggttttctgacgtactcacggcaccagtgaaatggtcaatcgcaaacggcacatgatttaaatttgcgatactgtatgtcacgtacccrttctcaccctcatcagggtctacggcactcaggctcatgacagtagtaccaatgggcacgttctcatcaaaagcagctttgtacgctgtctgggtaaatt

SEQ ID NO: 7580 - DNA, 201 bp, Homo sapiens
agatgataaacagcttgctcctcacgatcaaggggggttgacgttttcagttcacctacaaacaaaaacaaatggactcacttgtaatttaagacgtgachtgcagttgtacatcttatttcctccccttttgtctttcaattacttagtctgagtattcacagccttcctcttgagaccagtattatcaatgacagattc

SEQ ID NO: 7581 - DNA, 201 bp, Homo sapiens
agtctgagtattcacagccttcctcttgagaccagtattatcaatgacagattcaacagctgcaagaggcagtgagctccaggtctccaaccctgccaggkgctagctctttaagtcctgcaggtctgaggccagggcctctcaccttgtgtataagattgcacaggtgaaacagctaccaaatttaccaaaatttaaaaa

SEQ ID NO: 7582 - DNA, 201 bp, Homo sapiens
aaggactcatccctattgctttctggagtattccctttgaccaggctgtaaagaacagtcccactatgttctgctcggatgagatctatctctgttccaayaggcacgtcctctgacactgtaaaggtatagaaaggttctgaaaattttggaagctgcatttccggtggaaggattttaacatagacaagaacaacagat

SEQ ID NO: 7583 - DNA, 201 bp, Homo sapiens
ttatttcatacaccactgatgattgactatgggctgtaaccatcccaacgaaactcccaatgctgacagtttcactaagttcaacagaatattcttttgaygtaaacttcggagaggcgttgtcagcaattgtgacaaagatacgcacagaagttatttcactcattggtggactgcccttatctgtagcttttaccatta

SEQ ID NO: 7584 - DNA, 201 bp, Homo sapiens
catccaaactgtcaaagcatgttccgccattcttacagggttcatctttgcagtatggactaagctgacacctgaagagtaaggagaaacagacataaacytcacgatcctattgcaaataaatacagcaaaacagaaagcaaaacagaacacattagcaaattaacgtgcagactttttacatgtaccattatatgttta

SEQ ID NO: 7585 - DNA, 201 bp, Homo sapiens
aggagtctgttcaagtcgttggctgccatcactgtctccaaaatgttggaagagaaggagcagaagcaggagcaaagccaaatgtctccccattgcttaamtgtcgggaatctgaaacagaagaaatcagaatcgttaccttggggaaataaaacaagcaaaagtgtgtacattgttttaaacttctcattaaaaaaatat

SEQ ID NO: 7586 - DNA, 201 bp, Homo sapiens
caatggaggaagataataatcaaatttgttgaaaggataaaaataagtaacagaaaaaataaactgtacaaaagatgtataatgttatagtttaaaagaaytgagtattaaaagaattaatttggcatatattagccttccaatttacaaaaacaagggcagcattaaaatgcataaacatagcattaagactactaatca

SEQ ID NO: 7587 - DNA, 201 bp, Homo sapiens
tggtatgaattttttttacctgttatgaaatatgtaacttgtctgttgatctcttcagaatcagcatccgtggtacttaagatggcaatcaccccaccttrggggtcatcctcactcacagtccctttatagatctcggccgtgaatcgtggtggactatcgttgacatcggtgacggtaacatccacaatggctgtggag

SEQ ID NO: 7588 - DNA, 201 bp, Homo sapiens
gggcagaggaaaagcaccagtggcagcaggtctgattaagcaataagctcttaggaatcctagaacagtgagaatatctcaaaaatcaaagcacggaaagraaagagataaaagcttggctttatctttaaaatgctcatcttttaatactgatagcgacttcttgaattctacgtttcccatttttctagaaagaaacct

SEQ ID NO: 7589 - DNA, 201 bp, Homo sapiens
atgaatccacaaccaaaccacaaagaaagccattcataccttcacctgcagtaagtaatgatctttctccttcctcttgatggcagatgatgtcaggaggrctccttgcgggttaacttcaaaagccttctcatcatttccagttacaatagtaaagaagaagggtggaccgttatgggaagaatcctcatctgttactac

SEQ ID NO: 7590 - DNA, 201 bp, Homo sapiens
gttgccgtcagttcttgaggcggtcagtcctgctcacaccacgcccagcagacaagagcacaaggcatttctagttattgatgtggtgatttgtaaacaaygtaaatcaacctttttcacttaccgtttctcggtcgagaagtttggtcactttgacttctcccctgacggggtcaattgtgaacgagcttccttggttgc

SEQ ID NO: 7591 - DNA, 201 bp, Homo sapiens
cagttttcactgtaatggggaaaaaatacacaccgtgatgacagactgctcaagaacggcatcttcactgatgactgtcgtgtaggtgtcttggctgaacrcaggggtattatcgttgatatctgttacattaacgttcacagtggcaacgtcgctcagtgaaggcgtgcctccatcagtggcctctactgttaggtaata

SEQ ID NO: 7592 - DNA, 201 bp, Homo sapiens
gttcctttaaagttgtaatccagcctgtttccatgttaatggcaaaggattcaatgacttccacactttgtgactgatccaggctatacataacttggccrttggttcctgagtcagcatcagatgccctgatctgaattactctacttccccctggcaggttttcaacaatgaatgcctcatatggactagattcaaaga

SEQ ID NO: 7593 - DNA, 201 bp, Homo sapiens
tgattgactatgggctgtaaccatcccaacgaaactcccaatgctgacagtttcactaagttcaacagaatattcttttgatgtaaacttcggagaggcgytgtcagcaattgtgacaaagatacgcacagaagttatttcactcattggtggactgcccttatctgtagcttttaccattaaatcatactccgcttggtt

SEQ ID NO: 7594 - DNA, 201 bp, Homo sapiens
tagcttttaccattaaatcatactccgcttggttacttcgatctaattctttggcagttttaatagagcccaagacaggatcaatcataaaagaatttccratatttcctggaaggagaggaaaaaatacatgttacagaaaaacacaaggggcagtagtagtagtagttagagaaacagaaacaaagtatccttaaaaat

SEQ ID NO: 7595 - DNA, 201 bp, Homo sapiens
tttaccattaaatcatactccgcttggttacttcgatctaattctttggcagttttaatagagcccaagacaggatcaatcataaaagaatttccaatatytcctggaaggagaggaaaaaatacatgttacagaaaaacacaaggggcagtagtagtagtagttagagaaacagaaacaaagtatccttaaaaattatat

SEQ ID NO: 7596 - DNA, 201 bp, Homo sapiens
catactccgcttggttacttcgatctaattctttggcagttttaatagagcccaagacaggatcaatcataaaagaatttccaatatttcctggaaggagrggaaaaaatacatgttacagaaaaacacaaggggcagtagtagtagtagttagagaaacagaaacaaagtatccttaaaaattatattctgaaattaagc

SEQ ID NO: 7597 - DNA, 201 bp, Homo sapiens
agagcccaagacaggatcaatcataaaagaatttccaatatttcctggaaggagaggaaaaaatacatgttacagaaaaacacaaggggcagtagtagtastagttagagaaacagaaacaaagtatccttaaaaattatattctgaaattaagcagaaactcaggggatgtcaatatttgaatggaaccttcaacttgtt

SEQ ID NO: 7598 - DNA, 201 bp, Homo sapiens
ctgaaattaagcagaaactcaggggatgtcaatatttgaatggaaccttcaacttgttttatttttatccacctaaaaccaggtatactttacagaatttygtccataaatgatgaaaaacaaaaaacagaagaaacagcactctgctcttagcgaagccaaaactccctctctcggctgcactgggaatgtgtggtggaa

SEQ ID NO: 7599 - DNA, 201 bp, Homo sapiens
tgataactccagtattgaagttaatagtgaactggctgaaagggtctccgtctgtgatgctgtagaacactttcaggccttccgggctgttagcctgcacrtggaccacagggctgtgcacctggatgctctctgcaatctctgcactgtagaaaggtttttcaaacacaggcatggctttattcatgacagtgatcggaa

SEQ ID NO: 7600 - DNA, 201 bp, Homo sapiens
tcggaacgataacttccgctgaaaaggccgggttccctccatcttttgcaaccactgtaacaagatattctttatttaaggtgtcaagctcaaattgcttyttcagtgaaatttcacccaagggtccaatttgaaagtgttcatgatgttccttgaggtagtaatgcacttccccgtttctgccactgtctctgtctacag

SEQ ID NO: 7601 - DNA, 201 bp, Homo sapiens
ccggcgcattatcattttggtcttctacaatgaccttcacgacaacgtgggccactgcagaaggcttatgttcctctgtcacttctacaaccacatcaaaygcctcctgctgctcacgatcgaagggcgtgccagtggttgacagaactcctgaagtgcggcttattttaaatctgcgatctgggttgaggatgtgataaa

SEQ ID NO: 7602 - DNA, 201 bp, Homo sapiens
ggcttattttaaatctgcgatctgggttgaggatgtgataaaacaaaggctcattgattggattcccaatagcagtaatgacagctaatgtttcggcctcrgtggaattctctttcactaccgcagagtagacatcctgggtaaactttaggtgactttctttgctttctttcacattaattttgacagaggtaaggccgg

SEQ ID NO: 7603 - DNA, 201 bp, Homo sapiens
tctctacaagtactattctcaccagtgccttttgtttgaggttcagacatatcgaggggataaaaattgggcaaatactgattcaagttgaacctctgccrgtttcttgatgaagaacccaagctacccgcggcaggcatgtctctaggagggtggatggattcaaactgattgctgaattcgggcggtaacggtggtagc

SEQ ID NO: 7604 - DNA, 201 bp, Homo sapiens
tgatttcatgaccacattcaacataaacaataagcaccctgattctcaaacgttatccggcattgcctaatggggccagcaggtcacaaacacttcagccrtttacaaaatagaaataaagttactaaagaaaaaatacaaaataaggtttatagtcacaacatatgaaaaattacagtactacaatcttaactcactgaa

SEQ ID NO: 7605 - DNA, 201 bp, Homo sapiens
ttcaagtcgttggctgccatcactgtctccaaaatgttggaagagaaggagcagaagcaggagcaaagccaaatgtctccccattgcttaactgtcgggartctgaaacagaagaaatcagaatcgttaccttggggaaataaaacaagcaaaagtgtgtacattgttttaaacttctcattaaaaaaatattttccatac

SEQ ID NO: 7606 - DNA, 201 bp, Homo sapiens
aaggctgtatctcacctgaccagactgacctaaatcaggatcgtgggcttctaaccacatgatgacggttccttctggaagatcctctcggactttcacaygataattaggtggaataaatgtaggtgggttgtcattaacatcttctagtgatactttcacaacgacagtggagaacagctgaggctcttctctggcttg

SEQ ID NO: 7607 - DNA, 201 bp, Homo sapiens
tgagcattgacagagtgagaatcgaagaaaatatcctccacctctccctggttgtgtaatttatttgcctgcaggagcttctctgccagcattttggcaayaccagtctcttcacactgcaagtttaccagcttgtgactggcagccactgttatgttgatatataatggtgtggcaaaattttctccatctgtagctgtg

SEQ ID NO: 7608 - DNA, 201 bp, Homo sapiens
ccagcttgtgactggcagccactgttatgttgatatataatggtgtggcaaaattttctccatctgtagctgtgattctcagactgtggaaagacaccttygcacctaagccatccattagcgatcgctttaatgacaatacccccgagttggggtttaaactaaacaaatccagttcatttccagcttcaatctgatact

SEQ ID NO: 7609 - DNA, 201 bp, Homo sapiens
ctgtagctgtgattctcagactgtggaaagacacctttgcacctaagccatccattagcgatcgctttaatgacaatacccccgagttggggtttaaactraacaaatccagttcatttccagcttcaatctgatactgtaccaactgaagttcatctgcatcaatagcagaaacagtggttatttgctctcccacgccta

SEQ ID NO: 7610 - DNA, 201 bp, Homo sapiens
tgactgtcccaatcaatgccaccgatggctttgactttatactccttactccctggaaaggacctcactgttctaaactgctggagaaggtcacctgccaygatgcttaaagatgctatgtcaccattggcaccctgatcgcagtcatccactgtcacaattgcatatgctgggtccctgtccagttctgatggtgacaat

SEQ ID NO: 7611 - DNA, 201 bp, Homo sapiens
gtcccaggtgcttgtctttaggttcagcctgatgcttctttttccgactaatcatcttacggcagagaacaaacaccaccaccagtaaaaatatccctgcracaaacacaacgattccaattccttccgccaacccaatgttccacggcgtggacacatactggttgggcgcagcatcctcgcagtgacgtcccctgtact

SEQ ID NO: 7612 - DNA, 201 bp, Homo sapiens
tcaaagcatgttccgccattcttacagggttcatctttgcagtatggactaagctgacacctgaagagtaaggagaaacagacataaacctcacgatcctrttgcaaataaatacagcaaaacagaaagcaaaacagaacacattagcaaattaacgtgcagactttttacatgtaccattatatgtttaagaattttata

SEQ ID NO: 7613 - DNA, 201 bp, Homo sapiens
gagaaacagacataaacctcacgatcctattgcaaataaatacagcaaaacagaaagcaaaacagaacacattagcaaattaacgtgcagactttttacaygtaccattatatgtttaagaattttatactacaattgattatgaaagttaagaaaaatacacatacctctgaccagtatataatcctctacactggcaaa

SEQ ID NO: 7614 - DNA, 201 bp, Homo sapiens
caaaacagaacacattagcaaattaacgtgcagactttttacatgtaccattatatgtttaagaattttatactacaattgattatgaaagttaagaaaawtacacatacctctgaccagtatataatcctctacactggcaaacaaagcctccgttgtcgacaacacacgtgcccccatagaggcatgggttggaggaac

SEQ ID NO: 7615 - DNA, 201 bp, Homo sapiens
ctctgaacagagacaattccagggccacttccacagtcaaacttgtactgcagccttccatgatgaatctaggataaaagcaatgactgttcacattactytcatagaaccttcaatgagagcacctgatcacaaatctacaggagagggcttagggagtgagggtagaagttaggccttacatttaagtactacagagca

SEQ ID NO: 7616 - DNA, 201 bp, Homo sapiens
caggaaaattaaactgctacataatggcactgcgttgttagctgtatgtctatataatcattgaagacacaggaggagggacaccaactatgaaccaaggkgtgtgctgtaacaagaggaagcaaaacttactactgtcattctttattcatctccacatctgtcttcttacaataaacatactttgcaatatttttagac

SEQ ID NO: 7617 - DNA, 201 bp, Homo sapiens
taaactgctacataatggcactgcgttgttagctgtatgtctatataatcattgaagacacaggaggagggacaccaactatgaaccaaggggtgtgctgyaacaagaggaagcaaaacttactactgtcattctttattcatctccacatctgtcttcttacaataaacatactttgcaatatttttagactccaataaa

SEQ ID NO: 7618 - DNA, 201 bp, Homo sapiens
accttttcatcgcagaacttccaggggcagtccagtcccgcgcagagtttctggaatacattcagtatcctaactccaatgatttcctcaatgtcagtcayggaagagttaatcttgtgcagaagttgttttgttgagatctgagcactacctggtttctctacaaaaagtaagacgtccagatgtgggtgaggttcagag

SEQ ID NO: 7619 - DNA, 201 bp, Homo sapiens
caggagggttatcattgatgtcgtctactatgatgtccacaaatacttcagcatgagcgcccgtcaaggagtcagttgcgcgtatgctcagcttatatgcygggtgggcctcaaagtccagaggagctatgacattgataactccagtattgaagttaatagtgaactggctgaaagggtctccgtctgtgatgctgtaga

SEQ ID NO: 7620 - DNA, 201 bp, Homo sapiens
caccgttagcttggccatgctgctgatgccactgctcccatacaacttcatgccacggtccgcagcgaggatttccatctcatagagcttggtctctaggwaatcaagtctaccagttaacactatcacaccactggttgggtgaatagcaaacatatctgttcgatctttaaaactgtagtaaaattccccgttggttcc

SEQ ID NO: 7621 - DNA, 201 bp, Homo sapiens
tgtctgacaaaattatctgaatcaaaagagaaaaaaataaaaaaatacctggggagcttccccttaaatgtacacacgtgcagcattttaaagatggcaamattacggagcccacctccagcaggtgacggattgcaaacgcctccattctggcaagggttgctggcgcagtcttccgtggccgtcaggaagcagcctgga

SEQ ID NO: 7622 - DNA, 201 bp, Homo sapiens
gcccccatagaggcatgggttggaggaacacggattgacgcttatctcacagtgggtccctatgtacaaggcactgcatttgcagtaataacctaaatcgkcaaaaaggaacaaaaaagtcctatcactcaatgactcagaaacctggtcttaattatattgctttttatctttattctccgaggtctgtaaaagctcgta

SEQ ID NO: 7623 - DNA, 201 bp, Homo sapiens
agtcatccactgtcacaattgcatatgctgggtccctgtccagttctgatggtgacaatgtcactgctgttatcaccggagcacattcattggcctgttcratgtgcaccgttagcttggccatgctgctgatgccactgctcccatacaacttcatgccacggtccgcagcgaggatttccatctcatagagcttggtct

SEQ ID NO: 7624 - DNA, 201 bp, Homo sapiens
tggctctaacttgaacaacagacgttccaattacagatgcctcagacagggtcaccgcataagactgctgagcaaacacaggagggttatcattgatgtcstctactatgatgtccacaaatacttcagcatgagcgcccgtcaaggagtcagttgcgcgtatgctcagcttatatgccgggtgggcctcaaagtccagag

SEQ ID NO: 7625 - DNA, 201 bp, Homo sapiens
tccccagcagacattcatgcaagtatgtatggtattgtttaaaagtggtccaagaaaaatgaaaatatggtgaggctttaagggtagatagtgcgtctacrttgtgagataacacagtaacacaacaagcaagcaaagcgcagtgttgcagcacactgctgcctcaccattgtcatcgcacgattcggactggaaggagct

SEQ ID NO: 7626 - DNA, 201 bp, Homo sapiens
gaatataaagtctgcaaagagtttaaacaaaaacgttacataaaagcattaacaggcagcacaaacatcaagggaataatggaaaagaaatcattcatctytgaccacagaaaacatgggaaatgactaaagataaaatcccaagagctttgaaaacgatttttctcataaaacataaaacacatgtgaaacaaggaggag

SEQ ID NO: 7627 - DNA, 201 bp, Homo sapiens
cgatgtcgtagcctccagggtaatagtccgtatcgatggcgtttggatctgctgagtacaggggtgtctgctcatcaatcacctcatagttggggaactcytgtatgtccggcagaggaacgcttggcatccaatctgatgtatcccagtgatacccttggtggaaaagaaaacagatgtcagtgtgttttctcctaagct

SEQ ID NO: 7628 - DNA, 201 bp, Homo sapiens
ttaaaagtggtccaagaaaaatgaaaatatggtgaggctttaagggtagatagtgcgtctacattgtgagataacacagtaacacaacaagcaagcaaagygcagtgttgcagcacactgctgcctcaccattgtcatcgcacgattcggactggaaggagctcagagactgcacttcagacaggctttcccgggcactgt

SEQ ID NO: 7629 - DNA, 201 bp, Homo sapiens
tgaacccaataacgtgtaagtaatttcagcgttagagcggatgtctgcgtctgtagcagagatctgcatgatcaattttccaggaaggacgtcttcaggartagtgtctgaatataaagtctgcaaagagtttaaacaaaaacgttacataaaagcattaacaggcagcacaaacatcaagggaataatggaaaagaaatc

SEQ ID NO: 7630 - DNA, 201 bp, Homo sapiens
ctgcggggaagtcttctgggggtggaggaaaatcactttcgatgtcgtagcctccagggtaatagtccgtatcgatggcgtttggatctgctgagtacagrggtgtctgctcatcaatcacctcatagttggggaactcttgtatgtccggcagaggaacgcttggcatccaatctgatgtatcccagtgatacccttggt

SEQ ID NO: 7631 - DNA, 201 bp, Homo sapiens
aattttgcaatcaaaatattatagttgaaagcaaattctccacctgtcgatcttattcccaattttaaatcctgacttgtgcccaaaactcatcaaaccgyatgcaggttctcctcagtgtaacccatacggacaacgaaaatgagggggaatgcttaccagtgatgtcaaaccaaaggggtatgccaggaggctccacag

SEQ ID NO: 7632 - DNA, 201 bp, Homo sapiens
tatagctgtgttttcaggtaaagaaacgctgtatgaggtgggtgagaataacggtctcaagtcatttgtatccagcacctgcaccctgacctttgttcgcrcctccacattagtatttttttcaagtgctttcactatcaatgtgtagtgatccttcacttctctattaagaatagctgtatttcctcctttggtccttat

SEQ ID NO: 7633 - DNA, 201 bp, Homo sapiens
ccttttttcaattaggtgatattcttgctgttttttaaaaaatctcaccttgaattttacgcactaaattgctggtaagatttctaagagatgtcaacttyggagcatcagaatacatttgaaaagggcaaaatgtaatttcaaattttgtgtgtgatctaaaatcacccacatatatgatactgttggaatatacaattt

SEQ ID NO: 7634 - DNA, 201 bp, Homo sapiens
gcaatggaaaggtagaggatgatcaggggaatgaaaacagaattagtttgtgcataatttttaaagatttttcttctcttctttttcttttcttttttttycccaggctgaattgcaatggcacgatctcggcttaccacaacctccgcctcccgggttgaagcgattctcctgcctcagcctcccaagtagctgggatta

SEQ ID NO: 7635 - DNA, 201 bp, Homo sapiens
ttatcttcacatacataatgaacccttggaattaagcaagaattcaggcaatgtatttaaatctgggacttacagtaaaagatgacttaaaaaacttaaaagagtgaaatatgcagattcctcatcagaatatatttttgaaatgaaaagttcccctcaggtatgagaaaatggcaacttcctgatcttaactgatgtata

SEQ ID NO: 7636 - DNA, 201 bp, Homo sapiens
tggcatgcacctgtagtcccagctactcaggaggctgaagcaggagaatcgcttgaacccgggaggcggagcttgcagtgagccgagattgcgccactgcrctccagcctgggcgacagagccagactccgtctcaaaaaaataaaataaaataaaataaaataaacttcattcaaacctttgcttctttcaaacaaacac

SEQ ID NO: 7637 - DNA, 201 bp, Homo sapiens
ggcaggcggatcacgaggtcaagagaccgagaccatcctggccaacatggtgaaaccctgtctctactaaaaatacaaaaagtagctgggtgcggtggtgkgcgcctgtagtcccagctacttgggaggcagaggcaggagaatcgcgtgaacaagggagacggaggttgcactgagctgagatcgcaccactgcactcca

SEQ ID NO: 7638 - DNA, 201 bp, Homo sapiens
gtcagaggctgcagccacaacacaggcggagcgcgtgtgggctggggcacaacgggggtggggggcagattgtgaatctatttcaaggttgcctgatgcactggagtggggagagggagggaaaggaggagagaacagtaccagagaagatgccaaagactgctcagcgtagagaacaagggggccaggaaccgagaggga

SEQ ID NO: 7639 - DNA, 201 bp, Homo sapiens
agtcagaggctgcagccacaacacaggcggagcgcgtgtgggctggggcacaacgggggtggggggcagattgtgaatctatttcaaggttgcctgatgcactggagtggggagagggagggaaaggaggagagaacagtaccagagaagatgccaaagactgctcagcgtagagaacaagggggccaggaaccgagaggg

SEQ ID NO: 7640 - DNA, 201 bp, Homo sapiens
gtctatcttcctccatttatttattcaattttttttcttttttagacagagtctcgctctctcacccaggctggagtgcagtggcgcgatcacggctcackgaagctttgagctttccgggcccccgtctcagcctcctgagtagctgggactataggtgcgtctgtagatttagactgacagaattttacatactcagga

SEQ ID NO: 7641 - DNA, 201 bp, Homo sapiens
agaccagcctggtcaacatggggaaaccccatctctactaaaaatacaaaaattagccgggtgtgctggcatgtgcctgtaatcccagctactcgggaggytgaggcaggaggattccttgaactcgggaggtggaggttgcagtgagctaagatcacaccaccgcactccagcctgagtgaaagagcgagactctgtctc

SEQ ID NO: 7642 - DNA, 201 bp, Homo sapiens
aatatattacatatattgtcattaatatcaattattgtatattattgatattatgtattatatatgttattaatatattattacttttatatacatattayatacataaatatatatacataggcctgcatataagaaattacaggggaatggcaaggctgcggagaaacaggaacgcttttacactgttgaagggaatgt

SEQ ID NO: 7643 - DNA, 201 bp, Homo sapiens
aggtgacagagtgagaccctgtctaaaacacacacacacccacacatacacacgaccctgtctaaaacacacacacacacacacacacacacacacacacmcacacaattaatttttaaaagctgtaccttatttttcaacaagggacttaatgttgtttgtactggcttggatcttaatctggaacctggctttattgat

SEQ ID NO: 7644 - DNA, 201 bp, Homo sapiens
caggtgacagagtgagaccctgtctaaaacacacacacacccacacatacacacgaccctgtctaaaacacacacacacacacacacacacacacacacacacacacaattaatttttaaaagctgtaccttatttttcaacaagggacttaatgttgtttgtactggcttggatcttaatctggaacctggctttattga

SEQ ID NO: 7645 - DNA, 201 bp, Homo sapiens
aatgggtaaagcacaccaacatggcacatgtatacatatgtaacaaacctgcacattgtgcacatgtaccctagaacttaaaggatagtaaaaaaaaaaaatgaaataaaataaaataaacctcagaaccaaataaaaatgagctaactggttcctccgtacagcagacaactgaagatgaactcaaacatgcttccctgt

SEQ ID NO: 7646 - DNA, 201 bp, Homo sapiens
tttcaccatgttagccaggatggtctcgatctcctgacctcgtgatctgcctgcctcggcctcccaaagtgctgggattacaggcgtgagccactgtgccyggttatgctaaatttttatccaaaataaaggcttattttgaataattcaaaaggaaaacaatttatcaagaaacaaaagtatgtaacagataaatgctaa

SEQ ID NO: 7647 - DNA, 201 bp, Homo sapiens
acatttaagctaatttttttttttttgagatggagtctcactctgtcgcccaggctggagtgcagtggcaccatctcggctcactgcaagctccgcccccygggttcacgccattctcctgcctcagcctctggagtagctgggactacaggcgcccgccaccacgcccagctaattttttgtacttttactagagatggg

SEQ ID NO: 7648 - DNA, 201 bp, Homo sapiens
tagctttataaaagcaaactcaaagtttaaaaagcacatttaagctaatttttttttttttgagatggagtctcactctgtcgcccaggctggagtgcagkggcaccatctcggctcactgcaagctccgccccctgggttcacgccattctcctgcctcagcctctggagtagctgggactacaggcgcccgccaccacg

SEQ ID NO: 7649 - DNA, 201 bp, Homo sapiens
cctgcagaatctgaggctgtctccaggtaaaaaaatgtcagaattgaatgagaggactcccaaggtgtccgctgcttggtgtgtaggaaatcctcccccccgccccccggccagccccccaaacacacacttggtcccagaagtcttctgtgatgatgattgttgaggtttgggaagagggtaggaaaacatctctttgag

SEQ ID NO: 7650 - DNA, 201 bp, Homo sapiens
tggggagtcatacagggaccccataccctagtcttcagacgtctcttctgctttcaattctaccttactagctgtttcttgttgaaaattgatggcattamaacataagatcgacagcaaaactcaatttacagggaattgccttcagtgatcctataaatgtcagatatagcagggtcagaagaagaggatagggtacac

SEQ ID NO: 7651 - DNA, 201 bp, Homo sapiens
ccactgcaattgagcttaggttacagagtgagactgtctcacaaaaaaaaaaaaaaaaaatatatacacacacacacacacacacacacacacacacacaygaaagatggcagctagaaaaggaaaaaaataggatttctgaataggattcaggtccaactgcaacaagagagcaagcacttgcaatctgtagtacgagtc

SEQ ID NO: 7652 - DNA, 201 bp, Homo sapiens
accactgcaattgagcttaggttacagagtgagactgtctcacaaaaaaaaaaaaaaaaaatatatacacacacacacacacacacacacacacacacacmtgaaagatggcagctagaaaaggaaaaaaataggatttctgaataggattcaggtccaactgcaacaagagagcaagcacttgcaatctgtagtacgagt

SEQ ID NO: 7653 - DNA, 201 bp, Homo sapiens
cctgggaagccgaggttgcagtgagctgagggcggaccactgcaattgagcttaggttacagagtgagactgtctcacaaaaaaaaaaaaaaaaaatatayacacacacacacacacacacacacacacacacacatgaaagatggcagctagaaaaggaaaaaaataggatttctgaataggattcaggtccaactgcaa

SEQ ID NO: 7654 - DNA, 201 bp, Homo sapiens
gacctgggaagccgaggttgcagtgagctgagggcggaccactgcaattgagcttaggttacagagtgagactgtctcacaaaaaaaaaaaaaaaaaatayatacacacacacacacacacacacacacacacacacatgaaagatggcagctagaaaaggaaaaaaataggatttctgaataggattcaggtccaactgc

SEQ ID NO: 7655 - DNA, 201 bp, Homo sapiens
ttggacctgggaagccgaggttgcagtgagctgagggcggaccactgcaattgagcttaggttacagagtgagactgtctcacaaaaaaaaaaaaaaaaaatatatacacacacacacacacacacacacacacacacacatgaaagatggcagctagaaaaggaaaaaaataggatttctgaataggattcaggtccaac

SEQ ID NO: 7656 - DNA, 201 bp, Homo sapiens
tcaattttgacagtttgttagccaaggtattatgctttaatagatacttcattacatatatatatatatatatatatatatatatatatatatatatatatgcctgtaaaaaactgagatatatccacatatgtatatgtgtatatcttcacatatgatgtgtaaatatgtgaagatatctccatttttacaggcttagag

SEQ ID NO: 7657 - DNA, 201 bp, Homo sapiens
ctcaattttgacagtttgttagccaaggtattatgctttaatagatacttcattacatatatatatatatatatatatatatatatatatatatatatatatgcctgtaaaaaactgagatatatccacatatgtatatgtgtatatcttcacatatgatgtgtaaatatgtgaagatatctccatttttacaggcttaga

SEQ ID NO: 7658 - DNA, 201 bp, Homo sapiens
gattaacatgttaagatatactatataaaaagtgagcatcttcttcctcatgctactccgcatgtgtgtaaagctctgcattttgcagggcacgatgacaacatacacagcagatcttcattccaacaacagggctgtaaggaggtgaggcagcacctcccatctctacagggagagagtcagggggccgggcatggctaa

SEQ ID NO: 7659 - DNA, 201 bp, Homo sapiens
atgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagtact

SEQ ID NO: 7660 - DNA, 201 bp, Homo sapiens
aatgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagtac

SEQ ID NO: 7661 - DNA, 201 bp, Homo sapiens
gaatgcctgacagaagaacaatgatttcatgaccacattcaacataaacaataagcaccctgattctcaaacgttatccggcattgcctaatggggccagcaggtcacaaacacttcagccgtttacaaaatagaaataaagttactaaagaaaaaatacaaaataaggtttatagtcacaacatatgaaaaattacagta

SEQ ID NO: 7662 - DNA, 201 bp, Homo sapiens
aaaaatggacataaagtcccccccagagagatgaatcgcaacagagactcttgttcttaaatacccttgtaactaaaatgtgaggaaacaataaaaaaaaatctaagatgcaaactctaatgtgaaatttaaaaaatacgttgaatagggtattacattcaatgtcttatctaaactacatgacaaataagaagaagaaat

SEQ ID NO: 7663 - DNA, 201 bp, Homo sapiens
tgaatgaatgagggaccaacatggcacctggcacataaagtgagcttcaccagcccacagaatgaatgaatgaatgaatgaatgagggaccaacatggcamctggcacataaagcgagcttcatcagcccacagaatgaatgaatgaatgaatgaatgagggaccaacatggcacctgacacataaagtgagcttcaccag

SEQ ID NO: 7664 - DNA, 201 bp, Homo sapiens
cagaatgaatgaatgaatgaatgaatgagggaccaacatggcacctggcacataaagtgagcttcaccagcccacagaatgaatgaatgaatgaatgaatragggaccaacatggcacctggcacataaagcgagcttcatcagcccacagaatgaatgaatgaatgaatgaatgagggaccaacatggcacctgacacat

SEQ ID NO: 7665 - DNA, 201 bp, Homo sapiens
tgaatgaatgagggaccaacatggcacctcgcacataaagtgagcttcatcagcccacagaatgaatgaatgaatgaatgagggaccaacatggcacctgrcacataaagtgagcttcaccagcccacagaatgaatgaatgaatgaatgaatgagggaccaacatggcacctggcacataaagtgagcttcaccagccca

SEQ ID NO: 7666 - DNA, 201 bp, Homo sapiens
agggaccaacatggcacctggcacataaagtgagcttcaccagcccacagaatgaatgaatgaatgaatgagggaccaacatggcacctcgcacataaagygagcttcatcagcccacagaatgaatgaatgaatgaatgagggaccaacatggcacctgacacataaagtgagcttcaccagcccacagaatgaatgaat

SEQ ID NO: 7667 - DNA, 201 bp, Homo sapiens
atgaatgaatgagggaccaacatggcacctggcacataaagtgagcttcaccagcccacagaatgaatgaatgaatgaatgagggaccaacatggcacctsgcacataaagtgagcttcatcagcccacagaatgaatgaatgaatgaatgagggaccaacatggcacctgacacataaagtgagcttcaccagcccacag

SEQ ID NO: 7668 - DNA, 201 bp, Homo sapiens
gagggaccaacatggcacctcgcacataaactgagcttcatcagcctacagaatgaatgaatgaatgaatgagggaccaacatggcacctggcacataaastgagcttcaccagcccacagaatgaatgcatgaatgaatgaatgagggaccaacatggcacctggcacataaagtgagcttcaccagcccacagaatgaa

SEQ ID NO: 7669 - DNA, 201 bp, Homo sapiens
agggaccaacatggcacctggcacataaagcgagcttcatcagcctacagaatgaatgaatgaatgaatgagggaccaacatggcacctcgcacataaacygagcttcatcagcctacagaatgaatgaatgaatgaatgagggaccaacatggcacctggcacataaagtgagcttcaccagcccacagaatgaatgcat

SEQ ID NO: 7670 - DNA, 201 bp, Homo sapiens
gagggaccaacatggcacctggcacataaagcgagcttcatcagcctacagaatgaatgaatgaatgaatgagggaccaacatggcacctggcacataaascgagcttcatcagcctacagaatgaatgaatgaatgaatgagggaccaacatggcacctcgcacataaactgagcttcatcagcctacagaatgaatgaa

SEQ ID NO: 7671 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaagcgagcttcatcagcctacagaatgaatgaatgaatgaatgagggaccaacatggcacctcgcacataaactgagcttcatcagcctacag

SEQ ID NO: 7672 - DNA, 201 bp, Homo sapiens
ctgcaacctctgtcccccaggttcaagcaattctcctgcctcagcctcccgagtggctggggttacagacacactgtaatttttgtatttttattagagayggggtttctccatgttggccaggctggtcttgaactcctgacctcgtgatccacccgcctcggcctcccaaagtgccaggatcccaggcgtgagccaccg

SEQ ID NO: 7673 - DNA, 201 bp, Homo sapiens
aaaataaaaacgtaaaaattctattgtgtctttcggtttcattttttgtctcatctttttaaaatattttccttctcatatttttaaaatggagatttatrtccttttaacttctagataaccctttatttacatcctctcatttttaaaaatccctttttaaacaattccttttaacatctttcacatcattctagtcct

SEQ ID NO: 7674 - DNA, 201 bp, Homo sapiens
tgacatgtctccagcatataactcaatggttactgaaaatatctcttaattaactcctttttccctgaatactcctaatcagaccaaaccttttactcaawtaattgctgctaattaaacatgcagtgttacgtactgaatttgtaactagtctttttgaactttaaatgtaatctgacacaaattagaagcagataatta

SEQ ID NO: 7675 - DNA, 201 bp, Homo sapiens
agcttcaccagcccacagaatgaatgaatgaatgaatgaatgagggaccaacatggcacctggcacataaagtgagcttcaccagcccacagaatgaatgmatgaatgaatgaatgagggaccaacatggcacctggcacataaagtgagcttcaccagcccacagaatgaatgaatgaatgaatgaatgagggaccaaca

SEQ ID NO: 7676 - DNA, 201 bp, Homo sapiens
tctggggtctagtcctcaacccaattccatgagggaaatccacctgttaaaggcgagtggcaaaaatccaggtaaatgtggaaggggtgggaggggcacgrcacctctttctgaggtttcagccaattacaatgagatgagtcaacactgttatggagcttcctgctctgctcaagagaaaatactctctgacaaaaaagt

SEQ ID NO: 7677 - DNA, 201 bp, Homo sapiens
cccagctgatccctctgctcttcaatccatccctgcagtaccctagtgtctcacctcccagctgactcctgtgctcttcaacccattcctgcggtatcctrgtctctcgccgcccagctgactcctctgctcttcaatccatccccgcggtatcctagtgtctcactgcccaggtgactcctctgcttttcaatccatccc

SEQ ID NO: 7678 - DNA, 201 bp, Homo sapiens
agtaaagtttacacttcagtttctcaatcacactaagccaaatttccagggtacggcagcccccaggggccggtgacgacagcatggagcaaggcagatgsagaacgcgctccccacggcaggaagctctgctggacggcaccggtctactcaggaggcataattcacaaatcaagatcctgcaagaaaccctgcagggtg

SEQ ID NO: 7679 - DNA, 201 bp, Homo sapiens
gatggagaacgcgctccccacggcaggaagctctgctggacggcaccggtctactcaggaggcataattcacaaatcaagatcctgcaagaaaccctgcarggtgggtttacttttctgcggagaacacgtaagatatttcagactgacaaaaacaaacaaataacaacaacaaactttctttctaaattcacaacactta

SEQ ID NO: 7680 - DNA, 201 bp, Homo sapiens
gtacgagtcatcgatgaccccacactgaaagacagggtcctggctctaaaggaaggaatctctgcagccctatgttcacctcacccggcaggaaatttacytggaacacttttcaattactctactagagaataagcacaggaagggaaaaagatcaaggaaaaaaggtaaaaatctggtcacccgataccttccttttac

SEQ ID NO: 7681 - DNA, 201 bp, Homo sapiens
ccttttgcaggaaggagtcctctgggctccatccctttctcacgatgttgtattaatcatagcattattctgacaaacccttgactgcaggcacgcacttyagatacataccattttcacccgatgatgtctctgaaacactttcatatattctacttgatactaagtttaagaactgtaatcatagtatttttggtggta

SEQ ID NO: 7682 - DNA, 201 bp, Homo sapiens
ttcttgcttatatacaagtgaaagaaaatgcaaacactagttgcctctaagtagattttattattcaggtatggtgaggcaacagatcaggtacgaccgcyagtacctgaaagtacctgcaaaggcagtttggtacttccccaagaggaggccataccaccgccactgaaggtggcaaaggccgaaggccgtgctgggcca

SEQ ID NO: 7683 - DNA, 201 bp, Homo sapiens
aacagatgaggggacacccacgatcgcagcagctttctgccttgagacagtttccagacagctatgcacccctatgtgatgtccaagagaaatggaagtakgtgtccacagaaaggcttgtactcaatgttcacagcggatttacaaactgccaaaaactggcagcaatacaaatgcctattactaggtgagtggataaac

SEQ ID NO: 7684 - DNA, 201 bp, Homo sapiens
ctgccttgagacagtttccagacagctatgcacccctatgtgatgtccaagagaaatggaagtatgtgtccacagaaaggcttgtactcaatgttcacagyggatttacaaactgccaaaaactggcagcaatacaaatgcctattactaggtgagtggataaacaaattataatattaatctatctatataaaggataca

SEQ ID NO: 7685 - DNA, 201 bp, Homo sapiens
gagttcaccaagataaaattccaggaaatgcaaactattatttagtgctagaaagcacaccagcatttgactagagatggaggtgggagggttgggagggrgaatacagagaagtgtgaggagacctttgggaatgatgggtgtggtcactgcctgatagtggtgatgttttctcaggtgtaaaagctatgtgaaagctta

SEQ ID NO: 7686 - DNA, 201 bp, Homo sapiens
tgatactgacctacctgggaacagtctgctttaaaggttgtaagaagacgaggcatgtgtacttcaggccctgaggatcacaccccaactttctgctgagktgggggaagagaagcatctagaaacagatctaatgaagctatatttactatattatttaataattccatgctaaaatactgttcttcatcttcagagact

SEQ ID NO: 7687 - DNA, 201 bp, Homo sapiens
atataggctataaaagtatttgttattagaatcaggtgtcaggcactaaatggagcactttaaaaatattatctcactgaagtctcaaaataggtgagcaytaagagatcatctaatggcccaacacttcatttttccataggtaaagtttatagttggttgagagacgtgctgactttcctggaggctactcaggaagac

SEQ ID NO: 7688 - DNA, 201 bp, Homo sapiens
aatgccaggccctgtgataagtgtcttacatgcattatcttatataatctttacatccaacctgcctagatatgtgatgctattaactccatttcactaaygaaaaactcagattgagagaaatgaggcactttcccagggccacagtgaatggcagagctggagtgtgaataccacaaatctcatcttcagcgccagcaa

SEQ ID NO: 7689 - DNA, 201 bp, Homo sapiens
cagtgtgcaattctgagatggcatctgctggtccccaccgacccatcagctgtacaaccagggggtgggggacagtcatgtccatcaggaggggattgtcrgcctccccggtaatctacggatattactaaaggttaagactgaggcaacaaagcgactctattcaaatatcggagattgtgtaattcgcaattaaaatag

SEQ ID NO: 7690 - DNA, 201 bp, Homo sapiens
gcttctgcttcgatgcattttaattattacctctttgtaagataaaaaatcactgaatacaacttacggagaactataaagtaaatttcaactgccaaagrgagaggagggcacaccgaagaatcttatcttctaaccaaaatcctcagatccctcatgtccaccaatcacgtcactagatgctttatgtgcattaaatca

SEQ ID NO: 7691 - DNA, 201 bp, Homo sapiens
tctgcttcgatgcattttaattattacctctttgtaagataaaaaatcactgaatacaacttacggagaactataaagtaaatttcaactgccaaagggaraggagggcacaccgaagaatcttatcttctaaccaaaatcctcagatccctcatgtccaccaatcacgtcactagatgctttatgtgcattaaatcattg

SEQ ID NO: 7692 - DNA, 201 bp, Homo sapiens
tcacgatccaaaccattctttaagggagtcctggtttctgcagggagtgacacaccagctgtctccaagtatgaccgaagctgcctttactcattaagtcwttagcagttcttgttcctacacttcatcatgctttcaccagtccttcctaaagccacgactggcatttacagattacagattgatttcttctgtaacttt

SEQ ID NO: 7693 - DNA, 201 bp, Homo sapiens
tcccgtcaggaggttgccgtgcacacgcagtgagagcggtcgtgatgctgctgcgtgatgctatgacgcagatttggagcacaggagacaggttgagacasgcttgttacgtgtgccactcagcagtgccatcagaaatcacggctttacctgaatgaagcattacggaaggaatgaaagcctagctttccaacctcgaga

SEQ ID NO: 7694 - DNA, 201 bp, Homo sapiens
aacctgccagaagtcacacagtccattagtggggaactgggattcaaccctaaaagtcaggttccagacaatcgtgctaaatgtttggagtccctgcctgyccttcaattggagggaagattaaggggcaactgaacacaacctgcaaatttcaccagagaagttgtgacttgaatgcaatccagaaatgtagctgccaga

SEQ ID NO: 7695 - DNA, 201 bp, Homo sapiens
gcctcgattaatttaacctaatactgaagacatttgacagatgctcccttgataagcctattttgaaataatgctggcatatccctggctttaattattgwccttaaaaaagaaatacaactcaacagactaacacaatctgttcaaaagagacacgcaaaggggtaccagtgttgagaagcaaaggctaagccatcctat

SEQ ID NO: 7696 - DNA, 201 bp, Homo sapiens
acagacaaggaagtccagggaataaatgacttcacaagttactaggttgcagagcttgaatcaaagccataactggaacccaaatctcttgaaatctcagyctacgttcgagagtggcacctagtagagaggtgcacgcttgcattaacacaaatctcataagactgaaatcggcttttctgattggtgagggaaatggct

SEQ ID NO: 7697 - DNA, 201 bp, Homo sapiens
taagactgaaatcggcttttctgattggtgagggaaatggctcacattaggaaaagcaaaagtcaatgatactatctcagagttaatgatctgccaaccaraccctaagaaagcttaaaaaataatcggccttaccttaacatggtatcagtgactttgacctaggcacacatctcaatcactggtcaagagtatcaccga

SEQ ID NO: 7698 - DNA, 201 bp, Homo sapiens
atcaataccgctgaagtggcagtgaggtctgccacaaactttccctccagccccaaatgaagagctacttttataaaacgtttcaaagtttcatttcaaayatgaaaggacaataaaaaccaggaaaagtcaaattaggaatttctgggacacagaaaggaacattagtccacctttgcctccataactatctttccccac

SEQ ID NO: 7699 - DNA, 201 bp, Homo sapiens
taaataattaccatgtattttctaaagcaactaacattcctctcacaagtgaatgactggatgttaatcactaacttgggggataagagggaaaaaacaamcccaaactccctttaccccaccagtattaacgcagcacagtgaaacactttcagacacgtaatacaaacagggtaacaattgttttaatttaacaaattt

SEQ ID NO: 7700 - DNA, 201 bp, Homo sapiens
acttccagtctccctgtggctgggaaacgagcttcttttctcttaagctttcctaggaggagaacataaagagccaagaggacagcagctgctgccacttsagggaggagccagcaacacaaaagccctttcaccagcacattttttaactctctgccgggcctcccacccgtctctaatcaagttcctgctgccaggaat

SEQ ID NO: 7701 - DNA, 201 bp, Homo sapiens
tctggccaggcatttttctagacattcccttagttttaaaaatgaacaaaaagctgcagcatttcattggtgctcaagtaataattaacttgctaagtacmcatcagctaagaacactacaccaaatttattccacacacccacaagagggatgctccagattttattctgcttaaattacaggaaaacctgttgaagctt

SEQ ID NO: 7702 - DNA, 201 bp, Homo sapiens
aatcctcactgtagaccttacagatagcaatctgaggaggagaatcttaattagagctctggaaactggctctctaacgagaccgactttccaaataattkttcacatggccctctccccttccagacctcacatggaagggcagtcacgtggcatggatctgtcagaacagttcaccaacatccagaggcctctccagga

SEQ ID NO: 7703 - DNA, 201 bp, Homo sapiens
aaatggtcaatcgcaaacggcacatgatttaaatttgcgatactgtatgtcacgtacccattctcaccctcatcagggtctacggcactcaggctcatgayagtagtaccaatgggcacgttctcatcaaaagcagctttgtacgctgtctgggtaaattcagggggattgctatttgcacctaagactttcaccaagacc

SEQ ID NO: 7704 - DNA, 201 bp, Homo sapiens
cttcaagttcaaaatgggctgcctgctgtcttttaactggttctaaaatagaaatgagaccagtgttgtaatttaaactgaatttagcttttccaggtgtmcttttaaaaacatacctcaaatgggaataagcaggaatggcctttaccatgaccacaggtgtgttgggaggagcaaattcacttatttctgctctgtaaa

SEQ ID NO: 7705 - DNA, 201 bp, Homo sapiens
aataagcaggaatggcctttaccatgaccacaggtgtgttgggaggagcaaattcacttatttctgctctgtaaacatccttttcaaacttgactggcccrgctttgaactgtggagaagtcacgtgaatgactttaacagaagagaactggggcggagttcctttatctttagcctgtagtgtgagattgtagccgaaag

SEQ ID NO: 7706 - DNA, 201 bp, Homo sapiens
gacaaggtcctctctttcatatttaaacgactcaaaaatcttcatgagtatcaaatgaaaggctactaactgtaacaactaagttatatttttatatttamatcgttaaggcaaatataagcaactgttaaaaattaatgaacattgtttacatttacttacatacaatgaattaaatgatcaaaagctggcaaacataat

SEQ ID NO: 7707 - DNA, 201 bp, Homo sapiens
agctcaggagttcgagaccagcctggccaaaacatggtgaaaccccatctctactaaaaatacaaaaattagcaggatatggtggagcaagcctgtaatcwcagttactccagaggctgaggcaggagaatcacttgaacccgggaggcagagattgcagtgagccgagatcgcgccactgcactccagcctgggcaacag

SEQ ID NO: 7708 - DNA, 201 bp, Homo sapiens
ggagacaaataaaaccttgtaatacccaaggtgctactgaaatcgaacatttcagactatcacatctcttcttagagggggtgtgtgtgtgtgtgtgtgtgagagagagtgtgtgtttgtgtgcgtgctgcgtggttaagaaagttgcgaggaagatttctgacaaacccacaaaactggggtgatattaactgttgtgaa

SEQ ID NO: 7709 - DNA, 201 bp, Homo sapiens
aggagacaaataaaaccttgtaatacccaaggtgctactgaaatcgaacatttcagactatcacatctcttcttagagggggtgtgtgtgtgtgtgtgtgtgagagagagtgtgtgtttgtgtgcgtgctgcgtggttaagaaagttgcgaggaagatttctgacaaacccacaaaactggggtgatattaactgttgtga

SEQ ID NO: 7710 - DNA, 201 bp, Homo sapiens
ggccgcagtggggttgggggaggagacaaataaaaccttgtaatacccaaggtgctactgaaatcgaacatttcagactatcacatctcttcttagagggkgtgtgtgtgtgtgtgtgtgtgagagagagtgtgtgtttgtgtgcgtgctgcgtggttaagaaagttgcgaggaagatttctgacaaacccacaaaactgg

SEQ ID NO: 7711 - DNA, 201 bp, Homo sapiens
cggggtttcactgccaggacggtctcgatctcccaaccttgtgatccgcccgccttcacctcccaaagtgctgggattacaggcgtgagccactgcgcccrgccacctgggactattattaagaagactgatgttccaacaacaagaactagaaagaaaatgctgataaaattctgaaatgtatttataaagagcatttag

SEQ ID NO: 7712 - DNA, 201 bp, Homo sapiens
gtagagacggggtttcactgccaggacggtctcgatctcccaaccttgtgatccgcccgccttcacctcccaaagtgctgggattacaggcgtgagccacygcgcccggccacctgggactattattaagaagactgatgttccaacaacaagaactagaaagaaaatgctgataaaattctgaaatgtatttataaagag

SEQ ID NO: 7713 - DNA, 201 bp, Homo sapiens
atatttttagtagagacggggtttcactgccaggacggtctcgatctcccaaccttgtgatccgcccgccttcacctcccaaagtgctgggattacaggcrtgagccactgcgcccggccacctgggactattattaagaagactgatgttccaacaacaagaactagaaagaaaatgctgataaaattctgaaatgtatt

SEQ ID NO: 7714 - DNA, 201 bp, Homo sapiens
cctcagctcactgcaagctacaactcccgggctcaggccattctcctgcctcagcctccccagtagctgggagtacaggtgcccaccaccacgcccggctrattttttttatatttttagtagagacggggtttcactgccaggacggtctcgatctcccaaccttgtgatccgcccgccttcacctcccaaagtgctggg

SEQ ID NO: 7715 - DNA, 201 bp, Homo sapiens
atgaaggaactgttgaaattctgcttctataagcttcaataatatttaaaatgctgaaggtcatcagtttaacactaaaacttcactagacaaaatacaggtatgtttctgatttgcccagtgaaaacatggtacttcttaggaaaagaagtgtaggcgtcatcagtaactataaccatgaacactggagtatctaagcct

SEQ ID NO: 7716 - DNA, 201 bp, Homo sapiens
ataaatgagagtgtttctgtggggatggcctggcccactctacgcacacagaatgcaaatatacctccctgagagaacagcagaaaaccaaagctttggaratcccacttaatgacagtattatttttgctctgttcattataccaagctctatttggtatgacaactgtcattttcctaactgtaccctattattggtaa

SEQ ID NO: 7717 - DNA, 201 bp, Homo sapiens
cataaatctgttgttcaaagagtggtggattatcattgaggtcggtaacgtccaccgtgacaatcacatcactgctcagcgtgggcataccaccatcaacwgccctcacaaaaatcgtgtgctgccgggactgctcgtaatccagggttctgagtagtgagatgaggccagtgctgctgtctacatgaaaatgatcatgac

SEQ ID NO: 7718 - DNA, 201 bp, Homo sapiens
atgaaaaatgtttataattctaaatacagcaacccatgtaagacatgttcatgtatctgatctctccttcatcctatgtacagctagaaatgaatgactayactgaaatgtactaacaaaatgtcacacttcagtggaaaaagacagaatgaaaccctggttatagtaaaaaaaaaaaaatcagggtgctagataatggca

SEQ ID NO: 7719 - DNA, 201 bp, Homo sapiens
agtgacactttagtgagatgaaaaagtggctcttactgtcatagtcaaagtcccagctaggcttctggatggagtcgctgtcagaaggggagtttgaaggrggtgggggaggcaggtttggcgccacgctgcagaccgccactgcttttcggtgcccgtgcacagactcggggttaaaagtgctgaattcgggatgctctg

SEQ ID NO: 7720 - DNA, 201 bp, Homo sapiens
aaaagttgtaaatgttagccgggcgcggtggctcacgcctgtaatcctagcactttgggagactaaggcgggtggatcacctgaggtcaggagttcgagamcagcctggtcaacatggggaaaccccatctctactaaaaatacaaaaattagccgggtgtgctggcatgtgcctgtaatcccagctactcgggaggctga

SEQ ID NO: 7721 - DNA, 201 bp, Homo sapiens
tcaaaaccagtgatgtgccatgagtgccattttgtgagaagccatttgtattttgagcaaactcagtggcctgatgatgactgacagggatggcaacatamcagcatacatggactcaagatatagcagagaagaacttcttatacatcagctcatttactccttacagcaaccctaagaagtaggtaacgttatcatatc

SEQ ID NO: 7722 - DNA, 201 bp, Homo sapiens
tatgaaagaggtggtgaagcaatcgtatattttttcccacttattttactacattggttggtttgctgtagcaggctatttgttaaaatctgaaactcaaraattttttataacgtgccatctaaagaactacttcataattttataaattctcaatcaaccataattcacaggcccagtaaactaacctgtttactgcta

SEQ ID NO: 7723 - DNA, 201 bp, Homo sapiens
tttaaacttttcatacaactgcttaaggcagcaattgtattaaaagctgctttgttcaatcacaagaaaaacttaaatgtgagatataattttaacgataytttccctacaggcaacaacagacagaaactcttttctccaattcaataccctcagcgtaaacagggtaactcttttgaaaataagcattttcccaaatat

SEQ ID NO: 7724 - DNA, 201 bp, Homo sapiens
catggactcaagatatagcagagaagaacttcttatacatcagctcatttactccttacagcaaccctaagaagtaggtaacgttatcatatcctatttcmcagaaaggaaacagacagtacaagcaacctgccagaagtcacacagtccattagtggggaactgggattcaaccctaaaagtcaggttccagacaatcgt

SEQ ID NO: 7725 - DNA, 201 bp, Homo sapiens
ttcttctaaaatagagacaataatagtatattcaactaacatgcatataatgattagaacacttggcacataatataggctataaaagtatttgttattakaatcaggtgtcaggcactaaatggagcactttaaaaatattatctcactgaagtctcaaaataggtgagcactaagagatcatctaatggcccaacactt

SEQ ID NO: 7726 - DNA, 201 bp, Homo sapiens
tggcccaatgtttgacacagaggaggtccactattgttggattggtaaatggacagatgaataaagcgttaagagtgagaaatgtgaggcaggactgtgtkggggaggggatatagagagggataacataggaaaataaaacatccatccttctcaaattaacagaaaatccaggcacaaccacgaggctggtaacaacac

SEQ ID NO: 7727 - DNA, 201 bp, Homo sapiens
aaagcttaaatatctttagcatagatctctgaaaatctataaatacggcagaaaaataacttttgcagtaaaaatcagatattaatatcttcatatttctwcattagggagaccttcatgtaaaatgcttccatcaattactgtgactgcacattcttcacaaaacagaacacagcccctgtgctgaaaacctaactgcat

SEQ ID NO: 7728 - DNA, 201 bp, Homo sapiens
cttaaactcactgcaatttgggatttctaaaatgcattttccgaagccaaaacaaagagtgtttacttagtctagccttgaaggagaagggctcccagtcyaaagcttaaatatctttagcatagatctctgaaaatctataaatacggcagaaaaataacttttgcagtaaaaatcagatattaatatcttcatatttct

SEQ ID NO: 7729 - DNA, 201 bp, Homo sapiens
aagggggacggtgagtaagcttactctggctttcttgccccgtactagatggccaagaggacagctgctgatgccaaggcaccaaggaggacaaggcaagrgaacgatggcctcatgtaactcgatgcagagggaggtacaaatcacgttagctttggcgtgcaggcctgaaagctgggacctaaccaccatcttaaacat

SEQ ID NO: 7730 - DNA, 201 bp, Homo sapiens
taaaattttttagatccttaaaaaataactgatttccattttgttgcctcaaccaacagactaacttggtatttacatgacaaacccgccttttttcactkaaatatgtaaacaccttcagctgggcaacaaatcgaaagaagaggatcatgggacaaacatgcacaggatctatgaaaagatgaacaccccctgagcagg

SEQ ID NO: 7731 - DNA, 201 bp, Homo sapiens
gacccatcaaggatcaccagaatggagagcttcattctgctccctctggagttattattaatccttttgggtatcagagatccctatgaaaaatgtaaaartggttaaattccctcagtgatccttccaaaaagattcagagggaatttttttttaatcacaaaacattgcatgtaatagttaacaaaactgagtttttca

SEQ ID NO: 7732 - DNA, 201 bp, Homo sapiens
aaatacaaattcaacatgggaaaaaaaaaaacatagcatagtacttacaacactgttgccattcctaaagctcaaatatttccagctcatgacagtatcaratatatgggttcaaaaggaaaagcatgttatcaagtctacagtttagaagatgatttttgaaaaatgactttgtgctaaactcttggattgagattgcct

SEQ ID NO: 7733 - DNA, 201 bp, Homo sapiens
aaagactaaacatctcagaattgtcatattaaatgttaatcactaaaaacatcaattcttccttaaaattaaattttaaaagtagattgtaagcttcctaytagaatgcaaactttttaaggacaaagaattgttacgtgtttggttcaaggccgggtcaatagtgagtgcttataaaaaatgatatccattacagacaag

SEQ ID NO: 7734 - DNA, 201 bp, Homo sapiens
ctgagcggtgggctgttgccactatcaatcaacagcaacactgtcggacaccaaaggtgctggggacctggtggggctataaccatgaggaaaggccacarggagtttcccagtgtggaaggaagggtcttcctcatgcatgcaggacaacagacgggagacgatctgaggattccgctcagagttttggggttcagtacc

SEQ ID NO: 7735 - DNA, 201 bp, Homo sapiens
ataatgcctatcgtgattgctgagataagcttctgcttcgatgcattttaattattacctctttgtaagataaaaaatcactgaatacaacttacggagarctataaagtaaatttcaactgccaaagggagaggagggcacaccgaagaatcttatcttctaaccaaaatcctcagatccctcatgtccaccaatcacgt

SEQ ID NO: 7736 - DNA, 201 bp, Homo sapiens
tttttaacatacttcacaacaaatactgctgtgtactaactatggtatcctccactattacctgacttcaactcataaggaaagaaagcctctgtgtgcaytgcactgaatttcctcctgccgccctgccagcggagtgcctgtgctcccgccggggctggggtgtggctgtggacacctggagagggtttattccttctg

SEQ ID NO: 7737 - DNA, 201 bp, Homo sapiens
tacacacacaagccggctgtggcacctgtcccctgaacgaccctgggtgctcctgcactctacacacacaagccggctgtggcacctgtcccctgaacgaygctgggcgctcctgcactctacacacacgagcctcaacaggggacagaaacaccatgaatcacaaaatcgaaggacctggaagtcagttcgccccaagat

SEQ ID NO: 7738 - DNA, 201 bp, Homo sapiens
taatagatgagacacacttgtcaatgttcctctgactcctaacgaaagttctgttccagccctatccaaaagtgatggcaagacacagtagacgggtggargagtggtataaaaaaagacttcagagaatgagacagaaaggggcaaaacaaggaaaattaggctttgctggtttcccttgggctatctccttcaagctca

SEQ ID NO: 7739 - DNA, 201 bp, Homo sapiens
ctgtagtcaccatctcacagggctcttgtaaagatgaagtctgtggaagctgctcgtaatagatgagacacacttgtcaatgttcctctgactcctaacgmaagttctgttccagccctatccaaaagtgatggcaagacacagtagacgggtggaagagtggtataaaaaaagacttcagagaatgagacagaaaggggc

SEQ ID NO: 7740 - DNA, 201 bp, Homo sapiens
tatgtttcaatataaaattgtgctctttgacatttcttataaatcagtaacaaaaccatctccaaacttctcaaaattcaagagataaagtagacttcgcraagcagatagacgtaaaagtgaacatcaaaggactagtaggtgaagacagtcatgtgacatggtccacacagctggagcgatgaatgcattcagtcaact

SEQ ID NO: 7741 - DNA, 201 bp, Homo sapiens
agttctaatatttcttctatcataatattactccacagtattaaagcccctcatttaaaaattagtcttcttttctgtactggaaaactcacgaggacagyggctgtctttcttgcatagcttgctcacatagctatctctccgtcatcctcaagaaacacttaaacgtgtgaacatgtgaatttcttaaaactatgaatg

SEQ ID NO: 7742 - DNA, 201 bp, Homo sapiens
cttaaataattcacatttaagaatagacattattaatctaatttattttctcccataatctttactaatttcacagaactatcacttaagggatattcaamatgtttctctgcagcaataagtgaaaggcttgtgttttcacttaattcaaaggtttttttccttaagtagttactaagaatctaaatcaacattattttc

SEQ ID NO: 7743 - DNA, 201 bp, Homo sapiens
caatctgtgttgatggtgaacaggtgcatgcaggatgatctgcacctccgaccttaaaaccaggtggagcctgtgtggcaggacaatcaccagggctgaaygttctcctcccagtgctgcggcttttttctcatatggaaataccttaaataattcacatttaagaatagacattattaatctaatttattttctcccata

SEQ ID NO: 7744 - DNA, 201 bp, Homo sapiens
gcttcaccaaaaccacaaacaaaactcccctaagcactaaaatgtcgtccccaatctgtgttgatggtgaacaggtgcatgcaggatgatctgcacctccraccttaaaaccaggtggagcctgtgtggcaggacaatcaccagggctgaacgttctcctcccagtgctgcggcttttttctcatatggaaataccttaaa

SEQ ID NO: 7745 - DNA, 201 bp, Homo sapiens
tgaattatccactctcataaataaagaactgttataaaaagtaatgtaattttccaggtaatcttgctcatttaatttcccataaaagaaaattaatgatyctcaaattctgtattctagaaaacaaatttcctatcaaactagaatatctatgagttttgacctctcttgagaactttaataactgctcaactgtctgca

SEQ ID NO: 7746 - DNA, 201 bp, Homo sapiens
cgtggtcattcgtgtcgctgacattgaccacaatccttgcaaagttgcgttttacaggcacatcttgatctcgtacctaaaaagaattgacacattatcartcccattggtgctttccttataactaattaaaaatcacgctcgaacacacaaaggcctcaggaccaaatggtgggaggagagcgggtagagcgcctacca

SEQ ID NO: 7747 - DNA, 201 bp, Homo sapiens
tagctgtttctttttgttgttgttttttttttgagatggagccttgctctgtcactcaggctggagtgcagtggcacaatctcggctcactgcaagctccrcctcctgggttcacaccattcacctgtctcagcctcccgagtagctgggactacaggcgcccgccaccacgcctggctaatttttttttgtatttttagt

SEQ ID NO: 7748 - DNA, 201 bp, Homo sapiens
gaagaggcctaaacctattacacaaaatttgtgatattaatagcttagctgtttctttttgttgttgttttttttttgagatggagccttgctctgtcacycaggctggagtgcagtggcacaatctcggctcactgcaagctccgcctcctgggttcacaccattcacctgtctcagcctcccgagtagctgggactaca

SEQ ID NO: 7749 - DNA, 201 bp, Homo sapiens
aagaagaggcctaaacctattacacaaaatttgtgatattaatagcttagctgtttctttttgttgttgttttttttttgagatggagccttgctctgtcrctcaggctggagtgcagtggcacaatctcggctcactgcaagctccgcctcctgggttcacaccattcacctgtctcagcctcccgagtagctgggacta

SEQ ID NO: 7750 - DNA, 201 bp, Homo sapiens
aatctgtacataaaatttacaaaaaaaagagacaggaaaattaaaataatcaaatctatataaatacatgaatcatgctgacaacacaggactgatttttygtttgattattttaacacagacagatgtaaatcccaaaagacgttgggaaatggcacagccgatgaaaacctcacgatgacagtagttgggacactggaa

SEQ ID NO: 7751 - DNA, 201 bp, Homo sapiens
tccatggttcagtgttgaaagagagcttgctctgagttaggtaagctaccaaagaactacagggaccaaccagatgcatggaaaacagagagggcaacacmactggtccagggtcaaccaactgcacggaaaagagagggcaacacaattggtcattattttgatttttacaatgaagtattaaataattaaataatttat

SEQ ID NO: 7752 - DNA, 201 bp, Homo sapiens
aatacaactccccacttcacgatttacttagagcacacaagaaggctaaggaaagctgtacctgtgtccatactaccaattccacataaaaaggctgggcrtggtggctcacacctgtaatcccagcactttgggaggctgaggcaggcggatcacctgagctcagaggttcgagaccagcctggccaacatggcgaaacc

SEQ ID NO: 7753 - DNA, 201 bp, Homo sapiens
agttttaagaccatattgatattttcacaattttcacaagcctttatatagtaatgcacatttaacattcagaagggattccctcaaagggaaacgcaatygggtaaaagtgcctctggaagtaggaacatgaacacagtactcggcagctcctctcagcaaggttagcctacctccctacctgtggctggatgaacgaac

SEQ ID NO: 7754 - DNA, 201 bp, Homo sapiens
caattacaaaatactgcaattaaaatcacactcttggccaggtgcggtagctcatgccttaatcccagcactttgggaggcccaggggggtggattacttraggtcaggagttggaggccagcctggccaacatgatgaaaccctgtatctacaaaaagttagccaggcatggtggcgcgtgactgtaatcccagctaatt

SEQ ID NO: 7755 - DNA, 201 bp, Homo sapiens
aatctgatgagtctggatatacatactaatacacctttttatttggatagcaaatgaaagtactgaaaaaatattttctaaaagaattgggtaacactggygaacaattccattattcagagataaccacttttattaccttctgtattttgttagtgtcttcacttgaaatgttttatggcttggtaggcttatcactct

SEQ ID NO: 7756 - DNA, 201 bp, Homo sapiens
tagtcctaaagagccctaaaaataattttattataaatataaattatataaatataaatttatataaattatataaatataaattatataatttatataawttatataaatataaattatataatttatataaatataaattatataatttatataaatataaatttatataatttatataaatataaatttatataattt

SEQ ID NO: 7757 - DNA, 201 bp, Homo sapiens
taacccaccccactttacaggttttgaagattgcaacaacattcccttcttatctttttcaggtcaacttatcctctaggtcagtggttttcccctggggrcaattctgctccctaggagacatctggtaatgcctgcagacatttttggttgtcactacttgtcggaagagggtgctcctggcgtctcgtgggtggagac

SEQ ID NO: 7758 - DNA, 201 bp, Homo sapiens
gtaatgcctgcagacatttttggttgtcactacttgtcggaagagggtgctcctggcgtctcgtgggtggagaccaggggtgttgctaagcatcctacaaygcacaggacagccctacacaaccaaaaatatctggttccaaatgtcagcagtgctgaagctgagaggctgctcaaagatagagtgttttacctccttttc

SEQ ID NO: 7759 - DNA, 201 bp, Homo sapiens
cgtctttactcaggtggtgtcctaagaccacacgtcactacagccggctgcgcgctctttcggcagctgtggccgtctcagcagctattgtttgtccctgmagtactggtgccggcaggattaggcgtggagccaaaaatggaattctattcatagactggcgaggctggaaagcagctcagaactcatttagttcaaact

SEQ ID NO: 7760 - DNA, 201 bp, Homo sapiens
cgggtgtaaaaatgacgcttgaatgtggcacaagcttaattttcattagtcaaaaaccttttaagttaatctctttttttccccaatcaaaaatgtaccaycctctcctaactgtggttgtaaatagttcaggaacgacaaggagccccttgattagtcccacatctaattattgtaatgtgtccaccaagaagttgtgat

SEQ ID NO: 7761 - DNA, 201 bp, Homo sapiens
gagccaccgcacccggccaacgcttttttttttttttttaaaaaccaaacaaaatttttttagaagggtaaacgctaatatacattattcgcaaatttgtrtgactatgacctttaaaaggtaaacaacttactctgttaaaacaaatgtaaatataatttcatgggaatctggcttcttagactatttcgtataggagcc

SEQ ID NO: 7762 - DNA, 201 bp, Homo sapiens
gaaatgtactaacaaaatgtcacacttcagtggaaaaagacagaatgaaaccctggttatagtaaaaaaaaaaaaatcagggtgctagataatggcactgmcaccaccaaaattcagttgaaacaaatgcacaaaatatcttggaaatctagttaaaactatgaaaaatcaaatctgtacataaaatttacaaaaaaaaga

SEQ ID NO: 7763 - DNA, 201 bp, Homo sapiens
cagcgctcctgcagggcgcaaacacccagagacccagggacccggcagccccgcgcaggcctcccgcgtgcaccgctcagcgagcgggtctttcgcagacrgcgggatgccccaggagaccgcgaggccggcgcagcccggcgagctcccggagggaaggcggcgtgtcagaaaggatcggaccccagcaatggccccgga

SEQ ID NO: 7764 - DNA, 201 bp, Homo sapiens
cctccagaaccgcgacagaatccacctctgtcgtttaaatttatggaaagtagccttagggaaataaaccttttttaaaaaaattaatggctttattgagrtataactgatataccaaaaactacatatgtttaacatatacaatctgatgagtctggatatacatactaatacacctttttatttggatagcaaatgaaa

SEQ ID NO: 7765 - DNA, 201 bp, Homo sapiens
caagaaaaaatgaaaaatagagaataactgcagtagttcttatattatctctgtccttaactttctctgagagcaaagttgttcattaagagagctgttcyttaacaaagtaataataaacatttcattttaaagtgacattttcttctttaatactaaccattaataaaataaagtgataacagaagatgtagaatatga

SEQ ID NO: 7766 - DNA, 201 bp, Homo sapiens
gaaaaatgtaatttctaaaagagcttaaccaagatagttgaaaatagagctcacagcaaaatttctgtatggaaggattcattaatgtccacttacttaaytaaacggatactgacgttgtctttccacagcctgattattcaaaggttatagggttgctccaataaacggttcaaaagtaaatcacagtttccaataata

SEQ ID NO: 7767 - DNA, 201 bp, Homo sapiens
atcttcctcttctgccaagcactgataattaaaaatagaaaggaagaaaaactagaaatttttctttccttggtccagaaaaacactgcattctatataayaaaactatgataaatgtaggtgggctgagacagcagacacagtatattctcaccaatgagcagttaccagttcaccccagaaatgtatgcacaatgcagt

SEQ ID NO: 7768 - DNA, 201 bp, Homo sapiens
taatctctttgaggagaagaatggcagctgggacttactacttctctaaaaatctctgttaaagaaggccacaagtttgtttttcttcccccccatgtatrtgtcaatgtgttcaaagacatccactcccaaaatttccaaacagaaataatgtcaaaatgcttagtgagtcaatacagttacacgtttctatttcaaatc

SEQ ID NO: 7769 - DNA, 201 bp, Homo sapiens
gtgcgctgggcattgtggatttcagatttctggatgtgggatgtcaactggtataacgcgtatatctcaaaatccaaataaatccaaaacacttctagtcycaagtatttcagataaagatgctcaacttctattagtctgtctctgtgctggcactctatattctaaaaatcacattctttaagaatacctaccaaccag

SEQ ID NO: 7770 - DNA, 201 bp, Homo sapiens
cataattaagcacaaaaaccttgaagagaaaaaacattcaaaaaagttcactcaaacttgttgtttagaacacaaaattcataagctcactcactaaaccyactcctagaaagctttcttgttgtgacttttaaaatattttgttacactatgacaaaaggggaaggagaaaaagatattgaggagatgtctccctctttt

SEQ ID NO: 7771 - DNA, 201 bp, Homo sapiens
catggttcagtgttgaaagagagcttgctctgagttaggtaagctaccaaagaactacagggaccaaccagatgcatggaaaacagagagggcaacaccaytggtccagggtcaaccaactgcacggaaaagagagggcaacacaattggtcattattttgatttttacaatgaagtattaaataattaaataatttattt

SEQ ID NO: 7772 - DNA, 201 bp, Homo sapiens
tgtaatgtgtccaccaagaagttgtgattgatggtaacatcacgtggaatagcagcttgacacgttcccaggaaaacagtattcttctgcagagcacttamtcactcaccaacagcactgcgcaaatacttatgagcaaatacaactccccacttcacgatttacttagagcacacaagaaggctaaggaaagctgtacct

SEQ ID NO: 7773 - DNA, 201 bp, Homo sapiens
ttgattagtcccacatctaattattgtaatgtgtccaccaagaagttgtgattgatggtaacatcacgtggaatagcagcttgacacgttcccaggaaaayagtattcttctgcagagcacttaatcactcaccaacagcactgcgcaaatacttatgagcaaatacaactccccacttcacgatttacttagagcacaca

SEQ ID NO: 7774 - DNA, 201 bp, Homo sapiens
atagttggctcttcgttcttgtcattcaggtgaccactccatctaaggaggccatgcacaccctgcaaaaatccttaacacatgccctgttttcctccacwgcaccgctcagctgaaactgtgcgttcttttcttctcatctccgtgttgactcgtgtctcctctctccagaagaatagctccaagaagggcacagcacca

SEQ ID NO: 7775 - DNA, 201 bp, Homo sapiens
cactaaaaatacaaaaaaacactaacactaaacaaataacactaaaaatacaaaaaaattacccgggcgtggtggcgggagcctgtagtcccagctactcsggaggctgaggcaggagaatggcgtgaacctgggaggcggagcttgcagtgagctgagatcgcaccactgcactccagcctgggtgacagagtgagactc

SEQ ID NO: 7776 - DNA, 201 bp, Homo sapiens
tgtactacttcacctgaacacgtaccaatcaagaggctctgtgcttagctgtgacttggagaatcatgactctactaatttgttttgtttttgcttctttytcctaagcactaaaagtgactaaattaaatctatgttcataaacagtagtaatgtcataatgtttacgatctcagtcacccacttgttcactgtgcactg

SEQ ID NO: 7777 - DNA, 201 bp, Homo sapiens
atgttggccaggctggtcttgaactcctgacctcgtgatccacccgcctcggcctcccaaagtgccaggatcccaggcgtgagccaccgcacccggccaaygcttttttttttttttttaaaaaccaaacaaaatttttttagaagggtaaacgctaatatacattattcgcaaatttgtatgactatgacctttaaaagg

SEQ ID NO: 7778 - DNA, 201 bp, Homo sapiens
gaggatgatacaggcaatagcactactctacagcccaaggacacaacacgtaactcaggtatattcacctggaaggccagcctcagaatctagatactcartctcacaaaggaggctgctcctaggtaagcaaagcagaaacaaagaggaacccgcattgctactaaactgctttgttgttcttattcttgtaattttgga

SEQ ID NO: 7779 - DNA, 201 bp, Homo sapiens
aacttggtactaagctaaattagaaacaaacaaaactttgacagtaagaggattaatttccataatgaaaagacgtatggatttggcacagcggaaatcaytgccaattataaaacatgctttagagtttaagaagaagaaaactgcgcttcgtgggggcatatggaacaaagggatctgctggtccaagcagcacagggg

SEQ ID NO: 7780 - DNA, 201 bp, Homo sapiens
tttctccatgttggccaggctggtcttgaactcctgacctcgtgatccacccgcctcggcctcccaaagtgccaggatcccaggcgtgagccaccgcaccyggccaacgcttttttttttttttttaaaaaccaaacaaaatttttttagaagggtaaacgctaatatacattattcgcaaatttgtatgactatgacctt

SEQ ID NO: 7781 - DNA, 201 bp, Homo sapiens
ttttttaaacaagtggtataaacgccttctaaattttaaatccttttttcaattaggtgatattcttgctgttttttaaaaaatctcaccttgaattttaygcactaaattgctggtaagatttctaagagatgtcaacttcggagcatcagaatacatttgaaaagggcaaaatgtaatttcaaattttgtgtgtgatct

SEQ ID NO: 7782 - DNA, 201 bp, Homo sapiens
atgctaaagtttagaaaataagcttccttcataataatgtagcaagtttaatattaaaattactatttttcattaaccctcagacaacaaattaacttaayataggtatgtatcaaagcatgccaattcaagcaaaatacaattgaacaagcgttgcaagattataacacagcctctgatacactgtaacaatcaatctgt

SEQ ID NO: 7783 - DNA, 201 bp, Homo sapiens
actaaaaatacaaaaaaacactaacactaaacaaataacactaaaaatacaaaaaaattacccgggcgtggtggcgggagcctgtagtcccagctactcgrgaggctgaggcaggagaatggcgtgaacctgggaggcggagcttgcagtgagctgagatcgcaccactgcactccagcctgggtgacagagtgagactct

SEQ ID NO: 7784 - DNA, 201 bp, Homo sapiens
tatttgcacgttgtgccatgtgattgcattacccatttaaaacaagtgatagaatttatgaggtgtgctacccacacatacacatacatcacaaacacacrtcacaaacacacatctgccttccggccttgctgagcagggtaaactgatgatgaatggtacctggggaaggaggactgagaagtgccattccggctactg

SEQ ID NO: 7785 - DNA, 201 bp, Homo sapiens
ggcacctggaattcaaactcctggcctccagaaccgcgacagaatccacctctgtcgtttaaatttatggaaagtagccttagggaaataaaccttttttwaaaaaattaatggctttattgaggtataactgatataccaaaaactacatatgtttaacatatacaatctgatgagtctggatatacatactaatacacc

SEQ ID NO: 7786 - DNA, 201 bp, Homo sapiens
acccagggacccggcagccccgcgcaggcctcccgcgtgcaccgctcagcgagcgggtctttcgcagacggcgggatgccccaggagaccgcgaggccggsgcagcccggcgagctcccggagggaaggcggcgtgtcagaaaggatcggaccccagcaatggccccggatcggtcccgcgcggtcgcctccttttcccgc

SEQ ID NO: 7787 - DNA, 201 bp, Homo sapiens
gacccagggacccggcagccccgcgcaggcctcccgcgtgcaccgctcagcgagcgggtctttcgcagacggcgggatgccccaggagaccgcgaggccgrcgcagcccggcgagctcccggagggaaggcggcgtgtcagaaaggatcggaccccagcaatggccccggatcggtcccgcgcggtcgcctccttttcccg

SEQ ID NO: 7788 - DNA, 201 bp, Homo sapiens
cctccatccccccaccagaaggctctggcactgttccatcccctaagacacacagaccatggccaacacgtcagactgctttggctgttctctccccatgstgtcccaggtgctcagtcccaccacagcccccaccaccacccactcatccccaactggattcccaaacatgcaattaccttccacatcctactcagcagt

SEQ ID NO: 7789 - DNA, 201 bp, Homo sapiens
atgagagcaataaaaacatatttacctgtctcttcacctattttgaaaacaccaacgccagagccatctctaatggagtatcggatctccccatctcttcyggcgtcctcatcatgagccgacaccgtcattaccaatgaaccaacaggtgcatcttctttcactgtccccttttccacaaagctggaaaacacgggtggg

SEQ ID NO: 7790 - DNA, 201 bp, Homo sapiens
tccccatgtagaagaggaaaaagttagttctaagaaatcatttgcttgtccaggatcaccaattaccaactagaagagccaggattccaagccaggtcttytcagttcagcatgccactaccccgcctctgcctctcgaccaaaacctagacgaggtactaagtgaagaccacattagagaagttttggcacatcatctct

SEQ ID NO: 7791 - DNA, 201 bp, Homo sapiens
cgtcaggagttttcccgtgttatttcactttactctcacttaaaccttccggtatttctaagtgtccccatgtagaagaggaaaaagttagttctaagaartcatttgcttgtccaggatcaccaattaccaactagaagagccaggattccaagccaggtcttttcagttcagcatgccactaccccgcctctgcctctc

SEQ ID NO: 7792 - DNA, 201 bp, Homo sapiens
ccaccccagcatttttttttttttttttttggtaggaacgaggttttgctgttacccaggctggtcttgaactcctggcctcaagcaatcctcccacctgygcctcccaaagtgctgcgattacaggcgtgagccatcgcacccagcccaaaataatgtttttctaaacagcagttacatttttcatgtgctacacaccta

SEQ ID NO: 7793 - DNA, 201 bp, Homo sapiens
ggtatctggcacccacccacaccaggctaattcaacaggcagaactacttaactcttccacttcctttcccacaagggcatgcacacccgccacacgactsgactccgcacaccacctcacctgggcgatcaagccttgctttgttggtggtgatctcttaatatccagaggaaaattaacacaccatgtgactctttaaa

SEQ ID NO: 7794 - DNA, 201 bp, Homo sapiens
ttacattttcccaggcttctacaatgactatatactgcctttttattggaaataaagatcatttttttaatgaggggagttcgctaattctgtccaaatgstatggagactcaaagctgaaaaaaaaaaaaaaaaaaagccaacactatgtaatcatttccaaattcccttttcatgaccttaaatgggacttctaaagct

SEQ ID NO: 7795 - DNA, 201 bp, Homo sapiens
atcactacactgctgattatacactatggacacaggtgagtgaattaactcatagggatacttgggaaggaaaagagaacttatattcttgatttcaacarcaaaattacatttttaaatttaatttgacaagcctgatagcagcgaaaacgaaaaattcaactacttctgattttacgaagtagcatctggccaatgaaa

SEQ ID NO: 7796 - DNA, 201 bp, Homo sapiens
cgtataaaagtatataaaatatgatgctactgctgttcagaaaaattttttaaacacacatacacaattatatgtgcagagaaaaaaggtctgaaataaamaaggtgatcagcagataaatccatccagtgaacagaaacttttttaatctgtaaatttctgtaaccatggatttaaaaatctatatttaaaatgtataca

SEQ ID NO: 7797 - DNA, 201 bp, Homo sapiens
acgtataaaagtatataaaatatgatgctactgctgttcagaaaaattttttaaacacacatacacaattatatgtgcagagaaaaaaggtctgaaataamcaaggtgatcagcagataaatccatccagtgaacagaaacttttttaatctgtaaatttctgtaaccatggatttaaaaatctatatttaaaatgtatac

SEQ ID NO: 7798 - DNA, 201 bp, Homo sapiens
catgtaagatgtcaacaacgtgagaagctggggcagggagcagggagttatgtgagcattctactttctgctccatttttctgcaaatgttttattttttwaaaaagttgtctatgagagctcataatatgtagattgtttccttccttcaattaaaaacttttttgaacttacctgtttttaatctcgttttcattaaat

SEQ ID NO: 7799 - DNA, 201 bp, Homo sapiens
tactgcatgttctcactcacaggtgggaattgaacaatgagaacacatggacacagggtggggaacatcacacaccggggcctgtcgtggggtggggggargggggagggatagcattaggagatatacctaatgtaaatgatgagttaatgggtaaagcacaccaacatggcacatgtatacatatgtaacaaacctgca

SEQ ID NO: 7800 - DNA, 201 bp, Homo sapiens
atactgcatgttctcactcacaggtgggaattgaacaatgagaacacatggacacagggtggggaacatcacacaccggggcctgtcgtggggtggggggrggggggagggatagcattaggagatatacctaatgtaaatgatgagttaatgggtaaagcacaccaacatggcacatgtatacatatgtaacaaacctgc

SEQ ID NO: 7801 - DNA, 201 bp, Homo sapiens
aaccaaatactgcatgttctcactcacaggtgggaattgaacaatgagaacacatggacacagggtggggaacatcacacaccggggcctgtcgtggggtkgggggaggggggagggatagcattaggagatatacctaatgtaaatgatgagttaatgggtaaagcacaccaacatggcacatgtatacatatgtaacaa

SEQ ID NO: 7802 - DNA, 201 bp, Homo sapiens
aaaccaaatactgcatgttctcactcacaggtgggaattgaacaatgagaacacatggacacagggtggggaacatcacacaccggggcctgtcgtggggkggggggaggggggagggatagcattaggagatatacctaatgtaaatgatgagttaatgggtaaagcacaccaacatggcacatgtatacatatgtaaca

SEQ ID NO: 7803 - DNA, 201 bp, Homo sapiens
gacatgtgttacaaatcttgggctcctaaaaattgttttaaatgtccatggttcagtgttgaaagagagcttgctctgagttaggtaagctaccaaagaaytacagggaccaaccagatgcatggaaaacagagagggcaacaccactggtccagggtcaaccaactgcacggaaaagagagggcaacacaattggtcatt

SEQ ID NO: 7804 - DNA, 201 bp, Homo sapiens
aactgaagcgggtttaaacttttaaactcactgcagggcctggcgtgggttcctgctgctgcattctccaagttctaatatttcttctatcataatattamtccacagtattaaagcccctcatttaaaaattagtcttcttttctgtactggaaaactcacgaggacagtggctgtctttcttgcatagcttgctcacat

SEQ ID NO: 7805 - DNA, 201 bp, Homo sapiens
gaactttaataactgctcaactgtctgcatattttggaactagaaggcaattacaatttataaaatgtattcttatgcttcaccaaaaccacaaacaaaaytcccctaagcactaaaatgtcgtccccaatctgtgttgatggtgaacaggtgcatgcaggatgatctgcacctccgaccttaaaaccaggtggagcctgt

SEQ ID NO: 7806 - DNA, 201 bp, Homo sapiens
cagctcctaatggggaaagcactgtggctgtgaaaccaccttttccagagggtattcccagttcccaatgcacacacacacacacacacacacacacacayacactgcacaactataaaaactaagtatttactgacaacgttaagaaaatttgaccaaggataaaatgaaattaagcaggcagcattataaacagcaata

SEQ ID NO: 7807 - DNA, 201 bp, Homo sapiens
aaactacatgacaaataagaagaagaaatggctttagcaagtaaactttactggaggatgaaataatctaatgaatcctcctacctgttgaaaatgaggtratataaaactaaaaacccatagctggtaccataactttgtaccataagctggtatgaatcaaaatttgtaagcttattccctattaaatattgacatgtg

SEQ ID NO: 7808 - DNA, 201 bp, Homo sapiens
ctgacatttaacttctttctttttcatttaggccacagtagattataaacaagcctttagcttctgccatcccagtgtaagctccaagagggcaagattgktgcctcttctgtttcctactattcaccttccagaatggtgcctggcatgtaacaagtgttcaacaaatacttggtaaataaatgagtgaatgacactctg

SEQ ID NO: 7809 - DNA, 201 bp, Homo sapiens
tcctctgctcttcaatccatccccgcggtatcctagtgtctcactgcccagctgactgctctgctcttcaatccatccccgcggtatcctagtgtctcacygtccaggtgactcctctgctcttcaatccatccccatggtatcgtagtgtctcgcctcccagctgattcctgtgctcttcaatcaatccccgcggtatgc

SEQ ID NO: 7810 - DNA, 201 bp, Homo sapiens
gagggaccaacatggcacctggcacataaagcgagcttcatcagcctacagaatgaatgaatgaatgaatgagggaccaacatggcacctcgcacataaastgagcttcatcagcctacagaatgaatgaatgaatgaatgagggaccaacatggcacctggcacataaagtgagcttcaccagcccacagaatgaatgca

SEQ ID NO: 7811 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaactgagcttcatcagcctacagaatgaatgaatgaatgaatgagggaccaacatggcacctggcacataaagtgagcttcaccagcccacag

SEQ ID NO: 7812 - DNA, 201 bp, Homo sapiens
agcgagcttcatcagcctacagaatgaatgaatgaatgaatgagggaccaacatggcacctcgcacataaactgagcttcatcagcctacagaatgaatgmatgaatgaatgagggaccaacatggcacctggcacataaagtgagcttcatcagcctacagaatgaatgaatgaatgaatgagggaccaacatggcacct

SEQ ID NO: 7813 - DNA, 201 bp, Homo sapiens
acctggcacataaagcgagcttcatcagcctacagaatgaatgaatgaatgaatgagggaccaacatggcacctcgcacataaactgagcttcatcagccyacagaatgaatgaatgaatgaatgagggaccaacatggcacctggcacataaagtgagcttcatcagcctacagaatgaatgaatgaatgaatgagggac

SEQ ID NO: 7814 - DNA, 201 bp, Homo sapiens
catggcacctggcacataaagcgagcttcatcagcctacagaatgaatgaatgaatgaatgagggaccaacatggcacctcgcacataaactgagcttcaycagcctacagaatgaatgaatgaatgaatgagggaccaacatggcacctggcacataaagtgagcttcatcagcctacagaatgaatgaatgaatgaatg

SEQ ID NO: 7815 - DNA, 201 bp, Homo sapiens
gagggaccaacatggcacctggcacataaagcgagcttcatcagcctacagaatgaatgaatgaatgaatgagggaccaacatggcacctcgcacataaastgagcttcatcagcctacagaatgaatgaatgaatgaatgagggaccaacatggcacctggcacataaagtgagcttcatcagcctacagaatgaatgaa

SEQ ID NO: 7816 - DNA, 201 bp, Homo sapiens
atgaatgaatgagggaccaacatggcacctggcacataaagcgagcttcatcagcctacagaatgaatgaatgaatgaatgagggaccaacatggcacctsgcacataaactgagcttcatcagcctacagaatgaatgaatgaatgaatgagggaccaacatggcacctggcacataaagtgagcttcatcagcctacag

SEQ ID NO: 7817 - DNA, 201 bp, Homo sapiens
aaagtccctattttctctaggatcgagttcaaatcccttggaacgaccgccactgcccactgtaatccagttcacccttttccaagactctcagtgcagaytccccacttctggcaaactcagtggctactcccacaatccctcctcacactccatggcccctccccacccactcctgacgacccacttactgccccccga

SEQ ID NO: 7818 - DNA, 201 bp, Homo sapiens
aaacaattccttttaacatctttcacatcattctagtcctaaagagccctaaaaataattttattataaatataaattatataaatataaatttatataawttatataaatataaattatataatttatataatttatataaatataaattatataatttatataaatataaattatataatttatataaatataaattta

SEQ ID NO: 7819 - DNA, 201 bp, Homo sapiens
ctctcatttttaaaaatccctttttaaacaattccttttaacatctttcacatcattctagtcctaaagagccctaaaaataattttattataaatataawttatataaatataaatttatataaattatataaatataaattatataatttatataatttatataaatataaattatataatttatataaatataaatta

SEQ ID NO: 7820 - DNA, 201 bp, Homo sapiens
aaccattcaactctcacctgggcactgaccaaacctgccgctgggacagacacaggtgtgtttctcctcccagggatcagacacacattcggatccctcakggcacggatcatcttcacagccatggtggacaggtgggcaccttccctcttcattcaaagaggggagaaagggaaaagataattaacagacatttcaaga

SEQ ID NO: 7821 - DNA, 201 bp, Homo sapiens
cacagcggtgcaatcgtggctcactgcaacctctgccttctgggttcaagcgattctcatgcctcagcctcctgagtagctaggaatacaggcatgcaccmccatgaccagctaacttttgtattttagtagagacggccaggctaatctcgaattcctggctgcaagtcatccacccacctcagcctcccaaagtgctgg

SEQ ID NO: 7822 - DNA, 201 bp, Homo sapiens
cgccacttaaatcactcaggcccttttgtttccatcttcatggcttactacgaataaacacatctacaatacagcagccgggccaaaaaaaatattcacaygcacttctataccgagcccaaagagcaacagggaattttgaagaagctgccacagggcagatggttaaaaaaaaaaaaaaaatggaaaagggcatcaaat

SEQ ID NO: 7823 - DNA, 201 bp, Homo sapiens
aaatgcccatcagtgatagactagataaagaaaatgtggtacacatactcgatggaatactgggcagtcacaaaaaggaattacatgtgccctgtaatttyttcagtgattggaacagtaaaagtaccttttgtttaaaaaaatatttaggctgggctgggcacggtggctcacgcctgtaatcccagcactatgggaggc

SEQ ID NO: 7824 - DNA, 201 bp, Homo sapiens
acacaattggtcattattttgatttttacaatgaagtattaaataattaaataatttatttactattattaaataatttatctattattaaataatttatytattattaataattgataaattatttgatgcttcattattattcataaattaataattaacaaataattactaaatttatttattaataataaatttatt

SEQ ID NO: 7825 - DNA, 201 bp, Homo sapiens
agcattaggtaatatcaaaagtcaaaactgaataatgtttttaaaaaaggtgggcaagatacataacacttgaaacacatgtaggatgtctctataaactrtaacagtttttgttttttgagacagtttcactcttgtcgcccaggctggagtgcagtggcgtgatctcaactcactgcaacctctgcctcccctgttcaa

SEQ ID NO: 7826 - DNA, 201 bp, Homo sapiens
tatgaaagctttacattattcaagtcttattcctgtacatacgaagaagaatttttgtttcaaaaaaattttaggtaaaattacttctgaactttttcttkattgcaccacctacagataagctctccagatctcatgtaaatcactatgaatggtaaaaaggaacaaagacataacatacattgagatattttttgcaaa

SEQ ID NO: 7827 - DNA, 201 bp, Homo sapiens
ataccctagtgcctgaggcatcaggtccaaacctctggtcctggttttctatgtggccaataacctgtgtgtaaaataccttcctattttatctcactctrctttcttcttatgattactccaatacaactgggtaaagtcccctaaatatatttcttggcttctatctgcatgcctgtgtccatgcaattcctcgctgga

SEQ ID NO: 7828 - DNA, 201 bp, Homo sapiens
cagccttgctgcctctccttatttgttcatatttatctcaatccctcatgtcacttctatcaacatctccaacggcaagtaccatatctacacttagggtyttccagtctctaaatctgactaaaatctccaaatactggctgagtaattctgcctgaatatgctatttccctttaaaaaccagcatattgaaaaccacat

SEQ ID NO: 7829 - DNA, 201 bp, Homo sapiens
agtttaacactaaaacttcactagacaaaatacaggtatgtttctgatttgcccagtgaaaacatggtacttcttaggaaaagaagtgtaggcgtcatcartaactataaccatgaacactggagtatctaagcctcttctgcctgatagcaaatggggcccagagctatcctccctcctcctgaaccttgacagcatcat

SEQ ID NO: 7830 - DNA, 201 bp, Homo sapiens
aatgcgactggcccgtcctttccttcctttgcagctatcaaatgttaccggaaacccctggaagttgtttgcagctttagctatttcctattgcagtttgytcagtattcgttccagccacaataaaatgccatttactctggttcagaaaaaaatagttgtaaagtgttactggactaacacatgatgagcacccagtat

SEQ ID NO: 7831 - DNA, 201 bp, Homo sapiens
gcagcctgggcaacaagagcgaaactccgtctcaaaaaaaaataaaaataaaaataaaaataacgatactagtttgacatgcagtattatctcataaatcraaacctttgaattcttttagaaacaatacagtagatcgtgtgtgtgtgtggtgtgtgtgtgtgtaaatatacatttaatgttcttgcttctgccatcagt

SEQ ID NO: 7832 - DNA, 201 bp, Homo sapiens
tgccgttttcccaacatttgaaaatctgggctaaagcgaatttcattgtatcgggagggaaaaggaatggacttattatatgatggtacatacacagcttyaaaaaagaagacatgcatattaattacacagaagaatgtcagtgatacagaaattgagagaaaaatataaacgtataaaagtatataaaatatgatgcta

SEQ ID NO: 7833 - DNA, 201 bp, Homo sapiens
cacatctgccttccggccttgctgagcagggtaaactgatgatgaatggtacctggggaaggaggactgagaagtgccattccggctactgggtacaacasaacagcacaatttgggagggacaaaaagtgcatacatatctgtatttccacaaactccagaaacataaccaggatattgctaagtttcgatttaaaataa

SEQ ID NO: 7834 - DNA, 201 bp, Homo sapiens
acttccactaacaaatacagtcaccactagcctcctgagaccagtggaatttaaattaattaaaattcagtaaagtttacacttcagtttctcaatcacamtaagccaaatttccagggtacggcagcccccaggggccggtgacgacagcatggagcaaggcagatggagaacgcgctccccacggcaggaagctctgct

SEQ ID NO: 7835 - DNA, 201 bp, Homo sapiens
ctaggggctggcggcaccctgcgggtatttagaagcacagacccgaggcgcagggaagaagctgtgggcatacagacaggtgtgactcagaccacacccayagaagtgagcataatactaaagagaacagtgggcctataaaaacggtagagaaaatagcgggccgatcttcaacctaggaagcaatctgctggaagagaa

SEQ ID NO: 7836 - DNA, 201 bp, Homo sapiens
ttcaatttgtatctcagtagataccatcactgggccatttaaaagcttacttactaacaaaactttctgatactttgagcaaattgacctaataaaatagmtattaaaaatcaatgttaactctaaaaaaaatagcggtcgttaactttaattagtcctggctactataaactatttgaaaagaattttttttctcatttt

SEQ ID NO: 7837 - DNA, 201 bp, Homo sapiens
cagaagctccagaaacattttccctgactgaggtcaacaatcaggttagcctgggccggaattccgttccgttcccactgtagaaacgcactcacctgtgygcacctaagccgggcggccaggagccgaccccacacaggtgacacagggatgaggccaggagccgacccccacacaggtgacacagacatgaggccagga

SEQ ID NO: 7838 - DNA, 201 bp, Homo sapiens
gatgaaagaggcacgacaccctgatcggttgcaaagactgttagccaataatgggaggtcgattcacggtccagtcgatctgacgtctctatgacacctasagagaaaaaagaaaagcgtaaagcagcacatcaacgaccaaaactgccagcttcagaaagtgtcaacaactacggcttactgagagctttatatgtctct

SEQ ID NO: 7839 - DNA, 201 bp, Homo sapiens
cagcctttctgtgactcagcttcctttcttctaaaatagagacaataatagtatattcaactaacatgcatataatgattagaacacttggcacataatayaggctataaaagtatttgttattagaatcaggtgtcaggcactaaatggagcactttaaaaatattatctcactgaagtctcaaaataggtgagcactaa

SEQ ID NO: 7840 - DNA, 201 bp, Homo sapiens
aatctgaaatgctgcaaaatctgaaactttggagcaccaacatggtgcgctgggcattgtggatttcagatttctggatgtgggatgtcaactggtataaygcgtatatctcaaaatccaaataaatccaaaacacttctagtcccaagtatttcagataaagatgctcaacttctattagtctgtctctgtgctggcact

SEQ ID NO: 7841 - DNA, 201 bp, Homo sapiens
tcagcctcctgagtagctgggactataggtgcgtctgtagatttagactgacagaattttacatactcaggaaccaccagcacgcctggctcatgtttgtwttttttatagagacggggtttcaccacgttgcccaggctggtctcaaacacccaggctcaagcgatctgcccaactcggcctcccgaactgctaggatta

SEQ ID NO: 7842 - DNA, 201 bp, Homo sapiens
ccccatgctgtcccaggtgctcagtcccaccacagcccccaccaccacccactcatccccaactggattcccaaacatgcaattaccttccacatcctacycagcagttctcacgggacacaatacagctgggacggacttgtggaccacattcctaactgaaatctttgaaaaacctgaatgtactctgcaaacttggct

SEQ ID NO: 7843 - DNA, 201 bp, Homo sapiens
aagcacaagtagtcattctagcctttatggaacaggacattattaaacttttcatttcacatgttatgataaaaacacaaaattattaagttgagaactcwgtgttctccctcactgtgctcttctccactctcattttctatcaacatagtgaaagcgtcagtagaatttaactcatgattaaaatttggaatttcgagt

SEQ ID NO: 7844 - DNA, 201 bp, Homo sapiens
tcccccaaaacaaagaggcaatccacaggtatgaaaaatgaatgacaacattctcctgattctcttccatactcttttatactctacactgactcacctamaactctggcattacaaacttgtcttccaactcttcctccacatgcatttattaccacccttaaagatctcatctactctgcctcaaatcatgaaggatca

SEQ ID NO: 7845 - DNA, 201 bp, Homo sapiens
aaaggaaggggttgggagaacatcaaatgtggaacctagctccagctttgtcactaatcaactgtgtgaattcaaggaacttgcttaatcctttcgactcyatgtattcgagaaattgaaggatggactaaaatctttacagcctcctggctctcaaaccttcatttctcaaaagttatccaaacttgacatttctttctc

SEQ ID NO: 7846 - DNA, 201 bp, Homo sapiens
ctcctcacatacagcttatttgttttcacctttctcttcaacgtttctttctttttctctctccttaacctctgcctcataaaaacaatcctccctttttwaataagattatttaagtcatagtcaagattctctatgttctacctagacaaaaaaaagaagccaatccttttcctaagataacatggtacggtgaggtct

SEQ ID NO: 7847 - DNA, 201 bp, Homo sapiens
gtatagaagcctttattatttttactttatagacttatcttcacatacataatgaacccttggaattaagcaagaattcaggcaatgtatttaaatctggracttacagtaaaagatgacttaaaaaacttaaaagagtgaaatatgcagattcctcatcagaatatatttttgaaatgaaaagttcccctcaggtatgag

SEQ ID NO: 7848 - DNA, 201 bp, Homo sapiens
aggatcggaccccagcaatggccccggatcggtcccgcgcggtcgcctccttttcccgctccgccgccgggacccccctagccagtgctgaatttcccaaytgggaaggaccgagtcactccaccctccgggaagtcgcgcgctcatccgttttcggcagcgccggagcccgagccggggaccgggcggacacccacagag

SEQ ID NO: 7849 - DNA, 201 bp, Homo sapiens
agcctctgatacactgtaacaatcaatctgtgttacttccaaaaggactgtgatccttttagactatataaagcaccactattttaaaaaaaaacttccarttttggaatagttttttttttttcctccttaggatttaaaaaatccttggagaggcgggagaaggttaggcaatccgtgcttcaaatgcaatgcgcacac

SEQ ID NO: 7850 - DNA, 201 bp, Homo sapiens
caaactgtcaaagcatgttccgccattcttacagggttcatctttgcagtatggactaagctgacacctgaagagtaaggagaaacagacataaacctcaygatcctattgcaaataaatacagcaaaacagaaagcaaaacagaacacattagcaaattaacgtgcagactttttacatgtaccattatatgtttaagaa

SEQ ID NO: 7851 - DNA, 201 bp, Homo sapiens
taattaactattaactgaacacataagcattaggtaatatcaaaagtcaaaactgaataatgtttttaaaaaaggtgggcaagatacataacacttgaaayacatgtaggatgtctctataaactgtaacagtttttgttttttgagacagtttcactcttgtcgcccaggctggagtgcagtggcgtgatctcaactcac

SEQ ID NO: 7852 - DNA, 201 bp, Homo sapiens
aattaatacgactttttggaaaactaatatagtgatacaaaaaaatttaaaatgtcattgatgtttgagatagcaaattctagttttataatctatacacygtatagaaatgaacgcatcagtatgtaaagatacatgtataaagatttctttatctgaaagaaagagaacaactcgaatctttacacataagaacaatgt

SEQ ID NO: 7853 - DNA, 201 bp, Homo sapiens
aaaactaatatagtgatacaaaaaaatttaaaatgtcattgatgtttgagatagcaaattctagttttataatctatacaccgtatagaaatgaacgcatmagtatgtaaagatacatgtataaagatttctttatctgaaagaaagagaacaactcgaatctttacacataagaacaatgttgaataagtacagccatgc

SEQ ID NO: 7854 - DNA, 201 bp, Homo sapiens
cattcataccttcacctgcagtaagtaatgatctttctccttcctcttgatggcagatgatgtcaggaggactccttgcgggttaacttcaaaagccttcycatcatttccagttacaatagtaaagaagaagggtggaccgttatgggaagaatcctcatctgttactaccagctgcagcacgctgaagcccactggctt

SEQ ID NO: 7855 - DNA, 201 bp, Homo sapiens
aaaaaatgattcttcaaatgaaatgggctccagggacggtttgggcttggagatccattcaatatggagtctggtggttgatgacttttgagggcgaccaytgtcaactgccttaatctacaacatttgggcagaggggattaaaaacagcaaatcaggagttacaacccagaaatgaatgaagcacagactggtttggtc

SEQ ID NO: 7856 - DNA, 201 bp, Homo sapiens
gataaagacctgctaagtatacttagagccaactgtttgagctgaaattgggagctctgaaaacttaacaggacacatcaacacagaaaaagtaggaaaayctcaaaatctaggaaaatttatcttctaatgagaaacaattacttcccaatgtagaagagatctaacagtctactaaccaacttgcaaaatcgtatctga

SEQ ID NO: 7857 - DNA, 201 bp, Homo sapiens
cgtgtgtgtgtgtggtgtgtgtgtgtgtaaatatacatttaatgttcttgcttctgccatcagttggcaaatttatgttatttactactgtggactaaaawagaacaagaaatgaaaaaggaggagtctattgggctgaaggcatttaagattctaaaatggctattcagtctactttctcagggaatgacacaggaaatg

SEQ ID NO: 7858 - DNA, 201 bp, Homo sapiens
agcatccctcgtgggccaatcaaactgctaggcagtatactagtgtaccgtacaggtgcctctctgcccccttacagataaaaatacagtaaatcatgtayaatttctttctctccagtttaactgaagccatgacactgaccaccatgacccaatctttcaaaaccagtgatgtgccatgagtgccattttgtgagaagc

SEQ ID NO: 7859 - DNA, 201 bp, Homo sapiens
cccacaagggcatgcacacccgccacacgactcgactccgcacaccacctcacctgggcgatcaagccttgctttgttggtggtgatctcttaatatccasaggaaaattaacacaccatgtgactctttaaaaagactaccgcactcacaagcccattagaagatctcatacctactttttcccatcacccaaatgaagg

SEQ ID NO: 7860 - DNA, 201 bp, Homo sapiens
atgatcagctagccaacatggtgaaaccccgtctctacaaaaaatacaaaaattagccaggcatgatggcgggtgcctgtaatcccagctacttgggaggytgaagcagaagaatcgcttgaacccaggaggcagaggttgcagggagccaagatcgtgccactgcactccagcctgggcaacagagcgagactccatctc

SEQ ID NO: 7861 - DNA, 201 bp, Homo sapiens
taatatgtattatatataaaacacacacacacacacacacacacacacacacacacacacacatttttgagacggagtttcactcttgtcccccaggctgragggcagtggcacaatctcgactcactgcaacctccagctcccagattcaagcaattctcctgcctcagcctctggagcagctgagactacaggtgtgcg

SEQ ID NO: 7862 - DNA, 201 bp, Homo sapiens
gaaggaaaggtttccccggagaccccacgatggcttaccaggccagcctaaccattatgcattgagtgcctgttatatacaccaagcattcaaagacttasgtgcgcccacaaagagctgacaatctagaggaaaggcgcgtgtaaataaacaattacactagagtgatactgcagtcatatgtttaagtacataaaagat

SEQ ID NO: 7863 - DNA, 201 bp, Homo sapiens
aactgcaaacacaaatatgacacctgtccatctcttcaatggccaatgagacaagggaagctacaggcactcacctggattcacccacgccttcgctggcmtgatcttgacttgctgactgccaccgcgacggaattcaaactcctgtcctcctaattgtgctagatagcaatatgtcattcagagtaaaaatgctggaag

SEQ ID NO: 7864 - DNA, 201 bp, Homo sapiens
gttcactaaagtcaggcactttggggggagttgagagtcagacttccgtgtgctgctgggaatccaggggcgggatcgtcacctcttcgaagtggccgtcktccccgctctcatagtcactcatcatgacctcggactccacttcgcagcaggctgacacgtcagagcaggaggcggtggaggcgtacacagacatgggca

SEQ ID NO: 7865 - DNA, 100 bp, Homo sapiens
acactttccaataatgaaaaatgtttataattctaaatacagcaacccaygtaagacatgttcatgtatctgatctctccttcatcctatgtacagctag

SEQ ID NO: 7866 - DNA, 100 bp, Homo sapiens
acatttactcagacataccaccccaggtgcctgtccggcctatttcctayaccccgagtattccaagtgactcaagaaacaatctggaccgaaattcctt

SEQ ID NO: 7867 - DNA, 100 bp, Homo sapiens
gcaaacccagaagctatgcacacatcgaagagtcggtggatgtatctccrggctgcttcctgacggccacggaagactgcgccagcaacccttgccagaa

SEQ ID NO: 7868 - DNA, 201 bp, Homo sapiens
ggttcattggaggaaaggaatagccctgtgtgtgatgagcattgagaggaggtctggcgagcaccatctagggctgaagaactaggcagtggctccagcgyggggcggtgggggggacaagtgagccagggcaagaagaatggatttggccctagagtacgggttctccaaatgtaacctcggccctacagatctctgaga

SEQ ID NO: 7869 - DNA, 201 bp, Homo sapiens
ccagtgggccttaggtccctatgccggcgcggggttacagcagtggacagacaggccagtccctgtcctcgaggagcccatgatccgcggggagacaggcrtttaacgacgactcacacgatcacttaaatacaactgtggtgaaccgcacaagagggacgcgcggcggtctgcggggaatgacgaggccgacctcgtctg

SEQ ID NO: 7870 - DNA, 201 bp, Homo sapiens
ggtgatcttggggagagactgttcccaggcaaccctggagtctggctcagcgcacaaatctgtccagggcagatggccgggcccccgtgggcttggccttygcctccttatgatgctgctgctgaaggctctgccggaccttgtcctggggaccggagacggggaggacacaggcacagagtgagaagtggcaggctgaca

SEQ ID NO: 7871 - DNA, 201 bp, Homo sapiens
ggaacaggaccttctctctcccaggcccaacgcaggggccctcactggctgcagctgatctgtttccttataccagatcctcagtctcactaaagacagcratatgggagacacccaggggcctggcccgccagcccaaaagatggtcatcgggaagagaaaaagaaaaaaatgctgcagttgttctctcaagctagggca

SEQ ID NO: 7872 - DNA, 201 bp, Homo sapiens
gacgaggaggcctcgccccaacacagtgtgtcaagctggctggtgccacccactacccgctagaccggtgctgctatgggaaattcctgctgacgtcccayaggctggacccctggaagatgcaggaagcctggaagctggtgggtggctctgacggggaaaggactgcgcccttttgctcctggttccagggagtcctgg

SEQ ID NO: 7873 - DNA, 201 bp, Homo sapiens
agaggctgagcaggaaggaggccaggttttgcacagcgaggaagtgcctcttctgtacttgggccgggtgcactggcgcgtgaacccctctcggacaccgsggggcaggcaccgcgtatcagaggagcagtggcctcacacctggggcccctttccaccctatgcctcaggcacggggtatgtgctgtcagcgtctgctgt

SEQ ID NO: 7874 - DNA, 201 bp, Homo sapiens
ggaccctcttcgggccttcggggttgggggaggagctgctgagcctctcactagcctccctgctcccagcccccgcctcaccggggccgcccctggccctkccccgcctcttgatccccaaccaggaagcttgcagtggtcccggggcccctcccttcctgctcatcctggtgtgcacggctccggagaacctgaaccaga

SEQ ID NO: 7875 - DNA, 201 bp, Homo sapiens
cccctgggggaaggcaggagcagaatttgacattcccttccccaacaataacacggctaaaactcccgcgggaagcgtttcaggcggagagagagccggtyactccatccccacgggattaccctccctaccacaacccacgaatgtagctgaccgaaatcccggccgggttttccgaagggccctcgattcccgccccct

SEQ ID NO: 7876 - DNA, 201 bp, Homo sapiens
gacttacgtgcctgtagaatctactgccacagcccggaccccaccacgatgacagagaatctttgccagtggctccttcatagctggactccataaagacrcagtacctggaagagaagaagaaccaaagttgctaatacacacctaagcctgaggttactaaacatgggaaagatgggaactcaagaccaagagataaca

SEQ ID NO: 7877 - DNA, 201 bp, Homo sapiens
ctcaggaacagcagaaatccaaagcagacaccacctccacccctcacatcagccagacctggagagaacgatcatcttgaatgacaatgatgaacacagcrctccctattttgctaagcgctgtgctaaactatatgccttaactcatcttaatgtctacaacagcttatatgagggctttaaaccaaggcttggtaaact

SEQ ID NO: 7878 - DNA, 201 bp, Homo sapiens
agactctgtctcaaaaaaaaaaaaaaaatagccacaagtttttatacctaaaggataacgggagcaccacaccagggcaggctcaacgattcatccttttrtctccagaacctcagcgcagagccctgcccacagcaggtgcccagtgaatacctgatgacaaaaggaatcagaggaaaatacaaatcagacagaaaagct

SEQ ID NO: 7879 - DNA, 201 bp, Homo sapiens
aaccatagccatggccgggtgcagtggctcacgcctgtaatcccaacacttgcactttgggaggccgaagcaggtggatcacgatgtcaggagttcaagaycagcctggccaagatggtgaaaccccatctctactaaacattaaaaaattaactgggcgtggttcgtgggcgcctgtaatcccagctactcaggaggctg

SEQ ID NO: 7880 - DNA, 201 bp, Homo sapiens
tgaccttctccagcaggggggaacctgaccttctccaggaaggaggaacctcaccctctccaggacgggggaacctgaccctctccagcaatgggggggayctcaccctctccagcaggggagcctcaccttctctagcagggccttcacctcccactcctggcgctgcttccggcttctgtatggattactctccaggcc

SEQ ID NO: 7881 - DNA, 201 bp, Homo sapiens
caggggggaacctgaccttctccagcagtggggaacctgaccttctccagcaggggggaacctgaccttctccaggaaggaggaacctcaccctctccagsacgggggaacctgaccctctccagcaatgggggggatctcaccctctccagcaggggagcctcaccttctctagcagggccttcacctcccactcctggc

SEQ ID NO: 7882 - DNA, 201 bp, Homo sapiens
gaggggaatctcaccctctccaggaagaggaaaccttaccttctccagcaggggggaacctgaccttctccagcagtggggaacctgaccttctccagcasgggggaacctgaccttctccaggaaggaggaacctcaccctctccaggacgggggaacctgaccctctccagcaatgggggggatctcaccctctccagc

SEQ ID NO: 7883 - DNA, 201 bp, Homo sapiens
ccgtccaggagaggggaatctcaccctctccaggaagaggaaaccttaccttctccagcaggggggaacctgaccttctccagcagtggggaacctgaccytctccagcaggggggaacctgaccttctccaggaaggaggaacctcaccctctccaggacgggggaacctgaccctctccagcaatgggggggatctcac

SEQ ID NO: 7884 - DNA, 201 bp, Homo sapiens
gaccccgtccaggagaggggaatctcaccctctccaggaagaggaaaccttaccttctccagcaggggggaacctgaccttctccagcagtggggaacctkaccttctccagcaggggggaacctgaccttctccaggaaggaggaacctcaccctctccaggacgggggaacctgaccctctccagcaatgggggggatc

SEQ ID NO: 7885 - DNA, 201 bp, Homo sapiens
tctgtttccttataccagatcctcagtctcactaaagacagcgatatgggagacacccaggggcctggcccgccagcccaaaagatggtcatcgggaagaraaaaagaaaaaaatgctgcagttgttctctcaagctagggcagaagaggggtgtcaagctcctcaataaacttgtctccacttcttcgagtgcagtgtgg

SEQ ID NO: 7886 - DNA, 201 bp, Homo sapiens
gtttttttgtttttgtttttgttttcttttaaggggtcatctagtcataagggaaaatccttcgggctgtgaccgaagcaacaaaggcaaaaacgcggacsttggttatgaagggtgtggtctccctggtggagtacgtcggtgggttgggatggggagcggctggacagaccggtctcactccgtttggtgccactccac

SEQ ID NO: 7887 - DNA, 201 bp, Homo sapiens
aatgtaagcattagtttctttttataataacttgggcagtcagttctgggcactgacaaaattgagtttgtgatcttggaatactttgattatggggatamagtgatttgcctaaataattgtgacccttagagattctgaggaactgacagcccaataccttaatcaaagcctgtaactcataagaccctggtttactgc

SEQ ID NO: 7888 - DNA, 201 bp, Homo sapiens
tcttcctgtcttctggtggttgtcagtaatccttagtgttccttggcttgtagctgcattactccaatctgttgctgtcatctcatggtcctcttcgtgtstctctcatgatttgtcattggatctagagcccaccctaatcaaatataacgtcattttacctaattatttccgtaacgaccttatttccaaatagggcca

SEQ ID NO: 7889 - DNA, 201 bp, Homo sapiens
aaggagtacatccatctttctttggcttttaagaatcgaatcaatgaatgcaagaatattatttcacttgagtatttctctccacaaacctaatgaattcytggctttctagatacataacgttctttttttttcccttaagtcagaatgtgtagttagttgtggaaatagcctaccagtatgtgtccatgcgtgcagggc

SEQ ID NO: 7890 - DNA, 201 bp, Homo sapiens
ctgagtgggacatttactcagatgagccataattgacactcctttcctgtcgaagtgtgaaggagtacatccatctttctttggcttttaagaatcgaatmaatgaatgcaagaatattatttcacttgagtatttctctccacaaacctaatgaattcttggctttctagatacataacgttctttttttttcccttaag

SEQ ID NO: 7891 - DNA, 201 bp, Homo sapiens
catccagatcaccttgactgctggattaagaaaagaaagtggtttagggagagactgacccctttagcatttaccacagaaaataagtgattaaagccaakatagtggtctaaggtcaagccaaaacatttcacctggggaagtggggaggaggtatggttgctcacccgaattcgctaagattttcctgaaccacgagct

SEQ ID NO: 7892 - DNA, 201 bp, Homo sapiens
ctctagtgatccctgaaaagttccagcatattttgcgagtactcaacaccaacatcgatgggcggcggaaaatagcctttgccatcactgccattaaggtragtgaagtagggtaaggaatagggaatgtaaatgagaattgggttgtgaagacataagcaaaaatgaagcaaggctggggagacttgagtctcatccaga

SEQ ID NO: 7893 - DNA, 201 bp, Homo sapiens; identical to SEQ ID NO: 837

SEQ ID NO: 7894 - DNA, 201 bp, Homo sapiens
ggggtcacaggagagctacctgtcccagcctccatccaactcacccagacactccctgcctccagcacttcccaactctccggctggacctcacctttcgrgatttgtcaatgcgacagaacttctggaccacttccacagggacgggggcggggcctgggaatggatcttgggcctaggggaaaggaggacgcaattagc

SEQ ID NO: 7895 - DNA, 201 bp, Homo sapiens
gtgggtgtgtccaagaagaaataagtctgtaggccttgtctgttaataaatagtttatatacctatggcttcctgtcctttctgtccattctaatagggartgttaaagtgctgggtcctttttccatttagagctgccctactcagttgcccacacagtgctattagttttagcagtggtgatgctgcagaccccccagt

SEQ ID NO: 7896 - DNA, 201 bp, Homo sapiens
aggttcttcagcaagcagcagctcagaacgagcagctttgatacttgtttcctcttcctcagcttcagccacctcaagtcggcttcgagttttggctttakaatgtggtagctgtaacattgttggtggggaggagtggcagaagaaccacaggataagtggggtcacaggagagctacctgtcccagcctccatccaact

SEQ ID NO: 7897 - DNA, 201 bp, Homo sapiens
ccaagaaaccaccccccagccagtgaatctctcactctgtccactgcgagatgaccaatgttggccgaagcacccgtggggcaggagggtcactggaaccrggtggctccacctcacaggatacacgatggctgggttaggggggcaataggcagagctcaggacatgacaccaatcccccacacctggccagaaccctgg

SEQ ID NO: 7898 - DNA, 201 bp, Homo sapiens
atcttgagcggcagtcagagcaacagagggagacccttgctcagctgcagcaggagttccagcgggcccaggcagcaaaggcaggggctcctggcaaggcmtgaccccatggtggggggaggggaggggaggggagggaatgaggcagctctaggatctatactgtagctaataaaatgtaaaaacacctggctctgtttc

SEQ ID NO: 7899 - DNA, 201 bp, Homo sapiens
cctccccttccagaaacctgaaagcaagggttaggatggcagtaaagcttcccaatatgaagcaagtataccaacataaaaacgagaaaagacagtcccawaaggcagggaatgggggtccagattagggctcactcacccaggttcttcagcaagcagcagctcagaacgagcagctttgatacttgtttcctcttcctc

SEQ ID NO: 7900 - DNA, 201 bp, Homo sapiens
cagaatggagaaacctgggggagaggaagagtggttcaattgggaaatgaggtcacaggctatcattcaatcaggaatggactatctcaccccaactgacygctgacagtgaggccactgaccggatgtcccgcaccgcctccatgacgttgatctcgcacataagcttctttgttacccaatcaagggcagccacatgac

SEQ ID NO: 7901 - DNA, 201 bp, Homo sapiens
cagcctcatcactggagcccccgtggcctgacaagctcctgaggaggaccagagaaaagcagggatgggctgaagatcacaaggaccagagctgtttagcmtcaaggtgttgattaaacttcaggcctcagcgaactagtgattaagccctaagcacaggagtggctgacccaggtagcccacggagggcaagctacagct

SEQ ID NO: 7902 - DNA, 201 bp, Homo sapiens
cctgaccttctccagcaggggggaacctgaccttctccaggaaggaggaacctcaccctctccaggacgggggaacctgaccctctccagcaatggggggratctcaccctctccagcaggggagcctcaccttctctagcagggccttcacctcccactcctggcgctgcttccggcttctgtatggattactctccagg

SEQ ID NO: 7903 - DNA, 201 bp, Homo sapiens
accccaaaccacaccttccccagcagcaggggcctcactctctgcagcaggggaacctcacctccaacaggggcaatctcaccctctccagcaggggggawcctgaccctctccaggagagggaatttcaccctctccagcagagggaaacctgaccctctccagcagggggaatctcaccctctccagcagagggaaacc

SEQ ID NO: 7904 - DNA, 201 bp, Homo sapiens
ctcccaggcccaacgcaggggccctcactggctgcagctgatctgtttccttataccagatcctcagtctcactaaagacagcgatatgggagacacccargggcctggcccgccagcccaaaagatggtcatcgggaagagaaaaagaaaaaaatgctgcagttgttctctcaagctagggcagaagaggggtgtcaagc

SEQ ID NO: 7905 - DNA, 201 bp, Homo sapiens
gcatcattgtggagtgggttagctgagcctagccagttgcagttaaggtgagtttgcaggtcttggtcactctgggtttttttgtttttgtttttgttttyttttaaggggtcatctagtcataagggaaaatccttcgggctgtgaccgaagcaacaaaggcaaaaacgcggacgttggttatgaagggtgtggtctccc

SEQ ID NO: 7906 - DNA, 201 bp, Homo sapiens
atcgaatcaatgaatgcaagaatattatttcacttgagtatttctctccacaaacctaatgaattcttggctttctagatacataacgttctttttttttyccttaagtcagaatgtgtagttagttgtggaaatagcctaccagtatgtgtccatgcgtgcagggctaggcctgtcttcttggcttctgttgcatggtag

SEQ ID NO: 7907 - DNA, 201 bp, Homo sapiens
catccatctttctttggcttttaagaatcgaatcaatgaatgcaagaatattatttcacttgagtatttctctccacaaacctaatgaattcttggctttstagatacataacgttctttttttttcccttaagtcagaatgtgtagttagttgtggaaatagcctaccagtatgtgtccatgcgtgcagggctaggcctg

SEQ ID NO: 7908 - DNA, 201 bp, Homo sapiens
cgcttccttcgtcaacatccagcagctacttgatgagcgccctccagtgggccttaggtccctatgccggcgcggggttacagcagtggacagacaggccrgtccctgtcctcgaggagcccatgatccgcggggagacaggcatttaacgacgactcacacgatcacttaaatacaactgtggtgaaccgcacaagaggg

SEQ ID NO: 7909 - DNA, 201 bp, Homo sapiens
gatagggaagtccagcatccagcccagacactccgctcaccttcctccgcttgtcaaaattgatgtatccattctgcgaggaaaatggggatggggtgaargttccaaccctaccttccggccacagagagagaatatcccctctcttaaacacacacagccacatccaactcacaaccacttccctccagcctctctgac

SEQ ID NO: 7910 - DNA, 201 bp, Homo sapiens
cctccaaccctttccttcccttttaaccccccttcttctccctcccctggatctcaagttttccacctatctctttcttgcgtttagcactctccatagtragtcctactaatttctccctttctgcttgtctcccttgtctctccttagtaagcgatacgaatcccagcttcgggatcttgagcggcagtcagagcaaca

SEQ ID NO: 7911 - DNA, 201 bp, Homo sapiens
gtgagggcacgctctccttagaggggcggaacagtttttggcaccttatcgcgagcggcagcttatgcaagagtgacttaaaaaagaaaggcaggtccggrgccaggggctaagtagcggtgcggtttctttttctggattagtttccccatcttgcctaaaaatgtcctagtctagtctttttagcagaactccactccc

SEQ ID NO: 7912 - DNA, 201 bp, Homo sapiens
gaagctctctaggtgccatcttgagtgagggcacgctctccttagaggggcggaacagtttttggcaccttatcgcgagcggcagcttatgcaagagtgayttaaaaaagaaaggcaggtccggagccaggggctaagtagcggtgcggtttctttttctggattagtttccccatcttgcctaaaaatgtcctagtctag

SEQ ID NO: 7913 - DNA, 201 bp, Homo sapiens
tcttggtctgaagtttgtctttcttgggcgggacatccttgcccggcttgggggctgtctccatctcgcccacccgaacggcgatccacgtgcaaaactcytctcagctgccacacagtcggcttgaaaactcccggaagccctctgtccttcatccaatcagcagcgtaccaggtatgaagctctctaggtgccatcttg

SEQ ID NO: 7914 - DNA, 201 bp, Homo sapiens
actgagagagaaagacagagagaatgacccagtcctgattgccctctgtattccctctgctggggtcctaaaggagaggtggtcatcccaagggcttccamccagttcctgagctccatggccactcacagctgtagccaggaggaagtggaagggcaggaactcaagccgtgttactcggtcacagcggcggatacagtg

SEQ ID NO: 7915 - DNA, 201 bp, Homo sapiens
tgagaattgggttgtgaagacataagcaaaaatgaagcaaggctggggagacttgagtctcatccagatcaccttgactgctggattaagaaaagaaagtrgtttagggagagactgacccctttagcatttaccacagaaaataagtgattaaagccaagatagtggtctaaggtcaagccaaaacatttcacctgggga

SEQ ID NO: 7916 - DNA, 201 bp, Homo sapiens
cctttgccatcactgccattaaggtaagtgaagtagggtaaggaatagggaatgtaaatgagaattgggttgtgaagacataagcaaaaatgaagcaaggytggggagacttgagtctcatccagatcaccttgactgctggattaagaaaagaaagtggtttagggagagactgacccctttagcatttaccacagaaaa

SEQ ID NO: 7917 - DNA, 201 bp, Homo sapiens
aaacagtttccggaagcacttctcctagatcgcaccgcctcttcctcctggaagctatataatgatatcgcgtcacttccgctctctcttccacaggaggyctacacgccgccgcttgtgctgcagccatggtaagactggaatccgtgccgtgatccagcggcatcgcagctcgggcaaggaaagccggctgtcagggtt

SEQ ID NO: 7918 - DNA, 201 bp, Homo sapiens; identical to SEQ ID NO: 841

SEQ ID NO: 7919 - DNA, 201 bp, Homo sapiens; identical to SEQ ID NO: 838

SEQ ID NO: 7920 - DNA, 201 bp, Homo sapiens
tgcgagggggccgttgggggcaatgggagagaagcacggaaccccagagagaggctgagcaggaaggaggccaggttttgcacagcgaggaagtgcctctwctgtacttgggccgggtgcactggcgcgtgaacccctctcggacaccggggggcaggcaccgcgtatcagaggagcagtggcctcacacctggggcccct

SEQ ID NO: 7921 - DNA, 201 bp, Homo sapiens
gatccctccctgccttcctcctcaatctatcatggcctaagcactccacttgaccctttaaattgaatttctcaggtagacaacgagtctgctttgcagaygagaggactggatagtatccaattcgacaggattccttatccagagaggataaggaacttgtccaaggtctcagtatttgtttatttaacaaactctagc

SEQ ID NO: 7922 - DNA, 201 bp, Homo sapiens
ctctctgactcttcgatccctccctgccttcctcctcaatctatcatggcctaagcactccacttgaccctttaaattgaatttctcaggtagacaacgartctgctttgcagatgagaggactggatagtatccaattcgacaggattccttatccagagaggataaggaacttgtccaaggtctcagtatttgtttatt

SEQ ID NO: 7923 - DNA, 201 bp, Homo sapiens
gggggcaataggcagagctcaggacatgacaccaatcccccacacctggccagaaccctggagtcccaacctcacccgccagtcacctctgagcctctgtmagtggccggagcccctgtagccacctctggatatcatggtcaggttggaggttatagccacgacattcattctggagccgtcgcaactcagaaaggactg

SEQ ID NO: 7924 - DNA, 201 bp, Homo sapiens
tcccaacctcacccgccagtcacctctgagcctctgtcagtggccggagcccctgtagccacctctggatatcatggtcaggttggaggttatagccacgrcattcattctggagccgtcgcaactcagaaaggactgcaaactcctgggaaggagccctcaaactgcaggagccaaaactcagggacccctgacttttcc

SEQ ID NO: 7925 - DNA, 201 bp, Homo sapiens
agaaaagtggaagtcccaagaaaccaccccccagccagtgaatctctcactctgtccactgcgagatgaccaatgttggccgaagcacccgtggggcaggwgggtcactggaaccaggtggctccacctcacaggatacacgatggctgggttaggggggcaataggcagagctcaggacatgacaccaatcccccacacc

SEQ ID NO: 7926 - DNA, 201 bp, Homo sapiens
ggcctcttctgcacccccactcagcggggagccacaggaggctgagcggcggtgacctcgagaaggcctaggggaggaggctggtggggagaggtggctgrggtcagctggactgtgcagggatggactgctttccaaggcagagtctagtgacgagacagatggccacttcatgtgctaggaacaaacaacatgggactg

SEQ ID NO: 7927 - DNA, 201 bp, Homo sapiens
aagcacacacacagttgttccccccacagccgcccagatgtggaagtactccactctcctcccgagtctgcctttccctcatggcctctgacctcgctccyctggtagcagctgtaccagctcatactctgaagccactgcagagtcacgattgtttttcttaaggacacgactgatgacacttggagccttgtcctggct

SEQ ID NO: 7928 - DNA, 201 bp, Homo sapiens
tgcagagtcacgattgtttttcttaaggacacgactgatgacacttggagccttgtcctggcttgtcacctggcagaacaggagaccaaaagagcaatcartcagccatgatttcccatccttctaccctcagccactgaacccaaccacaaaatgttacttgtgtccaaggctttaaaatgaacaggaaaacccaatatg

SEQ ID NO: 7929 - DNA, 201 bp, Homo sapiens
cagccagaggaaggaaaactgggaatgaagagtcagaggtgagaagctaaagtcatgatctcaccaagggatcaagaggtcgatattggcggcttgtgacrgtaaacacggcaccatcctcctcctcatcccagacggacacaggggcctggaggagcaaggaaggggaagtcagacagttccacaccaccccccattgcc

SEQ ID NO: 7930 - DNA, 201 bp, Homo sapiens
ggagaagcatggagccataaggaagaacctcagtccaacagctccagcccaactaagcccccagttcctggatgtctctggcccaaacttccacccagagktcattcacttcaagccccatcccctggcccactcaccagggaccagcatgctggtgatgcccccagtgtgccccacccccagcacatcttcaaaggggca

SEQ ID NO: 7931 - DNA, 201 bp, Homo sapiens
tctttcttgggcgggacatccttgcccggcttgggggctgtctccatctcgcccacccgaacggcgatccacgtgcaaaactcctctcagctgccacacaktcggcttgaaaactcccggaagccctctgtccttcatccaatcagcagcgtaccaggtatgaagctctctaggtgccatcttgagtgagggcacgctctc

SEQ ID NO: 7932 - DNA, 201 bp, Homo sapiens
actctccggctggacctcacctttcgggatttgtcaatgcgacagaacttctggaccacttccacagggacgggggcggggcctgggaatggatcttgggyctaggggaaaggaggacgcaattagcagacagccttggattgaccccaaccctctcactctcaaggaacgaggcggcctgcctcgccacccatcaggtcc

SEQ ID NO: 7933 - DNA, 201 bp, Homo sapiens
ctcgccacccatcaggtcccacgctcaccccggacaagccgcgctgggactccgggttcttccattctcggggtttcttcgggacctgaggcttcttagaratccgagacttctttaagatgtaagcattttttggtctctgaggacggagctcccgattcttcttgttacgaggaggccctggagaggctccggctgtgg

SEQ ID NO: 7934 - DNA, 201 bp, Homo sapiens
ggacctcacctttcgggatttgtcaatgcgacagaacttctggaccacttccacagggacgggggcggggcctgggaatggatcttgggcctaggggaaasgaggacgcaattagcagacagccttggattgaccccaaccctctcactctcaaggaacgaggcggcctgcctcgccacccatcaggtcccacgctcaccc

SEQ ID NO: 7935 - DNA, 201 bp, Homo sapiens
tgttcactcacccgctgcccccatccttttctgcttcctcagatccatatccacctgactaggattgtggggataggtggcacatttgatgtttctaaatygcctttcctctcatccccagacttaagtaaatccatgtcggggaggcagaaacttgaagcacaactaacagaaaataatatcgtgaaagaggtgagggac

SEQ ID NO: 7936 - DNA, 201 bp, Homo sapiens
ctggaccctcttcgggccttcggggttgggggaggagctgctgagcctctcactagcctccctgctcccagcccccgcctcaccggggccgcccctggccstgccccgcctcttgatccccaaccaggaagcttgcagtggtcccggggcccctcccttcctgctcatcctggtgtgcacggctccggagaacctgaacca

SEQ ID NO: 7937 - DNA, 201 bp, Homo sapiens
gggatgacagaggataactgtgtagaaactaatggcatcacctgagctaggcgtggtggctcatgcctgtaatcccagcactttgggaggccgaggtgggyggatcacctgaggtcaggagtttgagaccagccaagccaacatggcaaaaccccatctctactaaaaatacaaaaattagcgcatgcagtggcatgcact

SEQ ID NO: 7938 - DNA, 201 bp, Homo sapiens
aaaaatagtaataaaataaataaatgcatcacctggccaatcattctcaaaaaccatagccatggccgggtgcagtggctcacgcctgtaatcccaacacytgcactttgggaggccgaagcaggtggatcacgatgtcaggagttcaagaccagcctggccaagatggtgaaaccccatctctactaaacattaaaaaat

SEQ ID NO: 7939 - DNA, 201 bp, Homo sapiens
gaccatctggaacactaactttgtacatcaattaggcaaaatgttaacctcaaaaagagaaattcagttcttcccattagtagatctgtattacacaaathtatttgattattattattttttttttctgagaccgggtctcactctgttgcccatgctagagtgcagtggcatgatcacagctcactgcagccttaacct

SEQ ID NO: 7940 - DNA, 201 bp, Homo sapiens
agctactccggaggctgaagccacagaattgcttgaacccaggaggcggaggttgcagtaagccaagatcatgccactgcactgcagcctgggcggaagaktgagactccgtctcaaaaaaaaaaaaaaaagaaaaattatcccttatataagtgaaagaaaaaaaaaaaagcattccagccactcagtggagagagattg

SEQ ID NO: 7941 - DNA, 201 bp, Homo sapiens
aaagggctgcaatttattttcttttctttctttttttttttttttttttgagacagggtctcactttgtcacccaggctggagtacagtgggacaaccttrgctcattgcagcctcaccctcccagattcaagcgatccttctgccacagctccccaagtagctgggactatagctgtgtgccaccatgcccagctaattt

SEQ ID NO: 7942 - DNA, 201 bp, Homo sapiens
aaagaaaggcaggtccggagccaggggctaagtagcggtgcggtttctttttctggattagtttccccatcttgcctaaaaatgtcctagtctagtctttktagcagaactccactccctaaacatgtcagaactacacttcccatcaagggtcagaaagaaacttccggcacagtcttttcccagcattccttgtttact

SEQ ID NO: 7943 - DNA, 201 bp, Homo sapiens
acccgctagaccggtgctgctatgggaaattcctgctgacgtcccacaggctggacccctggaagatgcaggaagcctggaagctggtgggtggctctgayggggaaaggactgcgcccttttgctcctggttccagggagtcctgggcatcctgcggtgtcgagcaatagcctggcttcagagctgagagtgcctggggc

SEQ ID NO: 7944 - DNA, 201 bp, Homo sapiens
gtcttcacggagcttgttgtccagaccattggctaggacctggctatattttccatcctttacatccttctgtctgttcaagaaccagtctgggatcttgyactggcgtggattctgcataatggtgatcacacgttccacctcatcatcagtgagttctcccgccctcttggtgaggtcagtgtctgctttcctcaacac

SEQ ID NO: 7945 - DNA, 201 bp, Homo sapiens
acgaaggccccagaagtgacgcagccctctatgggcccgaatcttcttcagtcgctccaggtcttcacggagcttgttgtccagaccattggctaggaccwggctatattttccatcctttacatccttctgtctgttcaagaaccagtctgggatcttgtactggcgtggattctgcataatggtgatcacacgttccac

SEQ ID NO: 7946 - DNA, 201 bp, Homo sapiens; identical to SEQ ID NO: 840

SEQ ID NO: 7947 - DNA, 201 bp, Homo sapiens
acaaaattgagtttgtgatcttggaatactttgattatggggatacagtgatttgcctaaataattgtgacccttagagattctgaggaactgacagcccmataccttaatcaaagcctgtaactcataagaccctggtttactgcatcagcttggagtggcaggccccttgttctcctaaatgcaagaatcagaaggcac

SEQ ID NO: 7948 - DNA, 201 bp, Homo sapiens
caaaattgagtttgtgatcttggaatactttgattatggggatacagtgatttgcctaaataattgtgacccttagagattctgaggaactgacagcccartaccttaatcaaagcctgtaactcataagaccctggtttactgcatcagcttggagtggcaggccccttgttctcctaaatgcaagaatcagaaggcact

SEQ ID NO: 7949 - DNA, 201 bp, Homo sapiens
tttgccattcccctctgccctggggctcagagccttgaagcctttgcttggcccttgcatgttaggatatggccaagaatcagaaactgatgcgtttttcsagcactacctgtgtgctgcactcatggaaggtgggaagctatacacaggtatccaacttggttataagacaccagttcccacagggctggatttctcagc

SEQ ID NO: 7950 - DNA, 201 bp, Homo sapiens
ggaggctgaggcaggagaatggcgtgaacccgagaggcggagcttgcagtgagccgagatcgcgccactgcactccagcctgggcgacagagcgagactcmgtctcaaaaaaaaaaaaaaaaagttttttgccttcttcattctataagtgtacagtggagtttttcagaagctacatgatatgtattgacaccatggttc

SEQ ID NO: 7951 - DNA, 201 bp, Homo sapiens
acagggacgggggcggggcctgggaatggatcttgggcctaggggaaaggaggacgcaattagcagacagccttggattgaccccaaccctctcactctcmaggaacgaggcggcctgcctcgccacccatcaggtcccacgctcaccccggacaagccgcgctgggactccgggttcttccattctcggggtttcttcgg

SEQ ID NO: 7952 - DNA, 201 bp, Homo sapiens
attaggagcagatgatagggtattattttagggagctactacagaagcttgggccagagatgatggtggcttccacaggatggcagtgagtgccctcactmtgctttctggaagagaggaaggtggtgaggaattcaggatattaaaaggcagttgaggtgtacatggtcagtttagagacatataaactatcatgggcac

SEQ ID NO: 7953 - DNA, 201 bp, Homo sapiens
gccaggctggtctcaaactcctgacctcaggcgatccacccgccttggcctccaaagtgctgggattacaggcgtgagccaccgcacctggccatattacrtttaattttataacctaaaaatgtgtgggccaggcgcagtggctcacgcctgtaatcccaacactttgggaggccgaggcgggcagatcatctgaggtca

SEQ ID NO: 7954 - DNA, 201 bp, Homo sapiens
ctctccaggagagggaatttcaccctctccagcagagggaaacctgaccctctccagcagggggaatctcaccctctccagcagagggaaacctgaccccrtccaggagaggggaatctcaccctctccaggaagaggaaaccttaccttctccagcaggggggaacctgaccttctccagcagtggggaacctgaccttc

SEQ ID NO: 7955 - DNA, 201 bp, Homo sapiens
cagcttcagccacctcaagtcggcttcgagttttggctttagaatgtggtagctgtaacattgttggtggggaggagtggcagaagaaccacaggataagyggggtcacaggagagctacctgtcccagcctccatccaactcacccagacactccctgcctccagcacttcccaactctccggctggacctcacctttcg

SEQ ID NO: 7956 - DNA, 201 bp, Homo sapiens
ccgagacagagtctcaccccgtcacccaggccggagtgcaatggtgcaatcttatctcactgcaacctcagcctcccaagtagctgagattacaggcacaygcccagctaatttttgtatttttagaagagatggggtttcaccatgttggtcaaactggtcttaaacttctgacctcaggtgatccacccacctcagcct

SEQ ID NO: 7957 - DNA, 201 bp, Homo sapiens
gtgggttagctgagcctagccagttgcagttaaggtgagtttgcaggtcttggtcactctgggtttttttgtttttgtttttgttttcttttaaggggtcmtctagtcataagggaaaatccttcgggctgtgaccgaagcaacaaaggcaaaaacgcggacgttggttatgaagggtgtggtctccctggtggagtacgt

SEQ ID NO: 7958 - DNA, 201 bp, Homo sapiens
cagaaaataagtgattaaagccaagatagtggtctaaggtcaagccaaaacatttcacctggggaagtggggaggaggtatggttgctcacccgaattcgmtaagattttcctgaaccacgagcttgtgagatttcttctagattcggtttctttacccatcccaccatcataacagcaacccttcctgcgaaatttatat

SEQ ID NO: 7959 - DNA, 201 bp, Homo sapiens
gaggtcaggagttcgagaccagcctggtcaacatggtgaaacctcgtcatttaattaataaaaaatttgaaagaccctgctctcttctgaatcaacctaakaatttgacccttggtcatgtttatttatttatcccgagacagagtctcaccccgtcacccaggccggagtgcaatggtgcaatcttatctcactgcaacc

SEQ ID NO: 7960 - DNA, 201 bp, Homo sapiens
aggtcaggagttcgagaccagcctggtcaacatggtgaaacctcgtcatttaattaataaaaaatttgaaagaccctgctctcttctgaatcaacctaatmatttgacccttggtcatgtttatttatttatcccgagacagagtctcaccccgtcacccaggccggagtgcaatggtgcaatcttatctcactgcaacct

SEQ ID NO: 7961 - DNA, 201 bp, Homo sapiens
tcgagaccagcctggtcaacatggtgaaacctcgtcatttaattaataaaaaatttgaaagaccctgctctcttctgaatcaacctaataatttgaccctkggtcatgtttatttatttatcccgagacagagtctcaccccgtcacccaggccggagtgcaatggtgcaatcttatctcactgcaacctcagcctcccaa

SEQ ID NO: 7962 - DNA, 201 bp, Homo sapiens
cctggtcaacatggtgaaacctcgtcatttaattaataaaaaatttgaaagaccctgctctcttctgaatcaacctaataatttgacccttggtcatgttkatttatttatcccgagacagagtctcaccccgtcacccaggccggagtgcaatggtgcaatcttatctcactgcaacctcagcctcccaagtagctgaga

SEQ ID NO: 7963 - DNA, 201 bp, Homo sapiens
atgtttatttatttatcccgagacagagtctcaccccgtcacccaggccggagtgcaatggtgcaatcttatctcactgcaacctcagcctcccaagtagytgagattacaggcacacgcccagctaatttttgtatttttagaagagatggggtttcaccatgttggtcaaactggtcttaaacttctgacctcaggtga

SEQ ID NO: 7964 - DNA, 201 bp, Homo sapiens
catcatctagttctgtatagcccacaagccaagaatggtttttacatttttaagtggttgaaaaaaaatcaaaagaatattttgagactgtgaaaaccgtrtgaaattcaaattccaatatccaacaaataaagttttattggaacggggccacactatttacttaatactgtggctgcttttgctctacaacacacagcc

SEQ ID NO: 7965 - DNA, 201 bp, Homo sapiens
atgaaattcaaattccaatatccaacaaataaagttttattggaacggggccacactatttacttaatactgtggctgcttttgctctacaacacacagcygagtggtcacgacagcgactacagcatcctgatttgcactgctgctttgtacactacaagtcacagtgacacagtcgtaagtgcttcacagcatttcaag

SEQ ID NO: 7966 - DNA, 201 bp, Homo sapiens
cggaattacaggcccccgccacgacacccggctaattttgtgaatttttagtagagacagagtttcgccatgttggccaggctggtctcaaactcctgacmtcaggcgatccacccgccttggcctccaaagtgctgggattacaggcgtgagccaccgcacctggccatattacgtttaattttataacctaaaaatgtg

SEQ ID NO: 7967 - DNA, 201 bp, Homo sapiens
gcctgtaatcccagctacttgggagactgaggcaggagaatcgcttgaatctgggaggcggaggttgcagtgagccgagatcacgccactgcactccaacytgggagacagagcaagactacgtctctctcaaaagatttaaaaaaaaaaaggtcaggcgcagtggctcacgcctataatcccagcactttgggaggctga

SEQ ID NO: 7968 - DNA, 201 bp, Homo sapiens
tctggcagaggctggaaaagactctgaggctgtccctggggaagggagaaaagtggccctgaggacaggcctggctctgtcaccccctcttccccgccttytgaggaacccccaccccagtccaatgcctcagcctccgcacctggttgcttccccccaggctgcccgaagcctgtggatggggctggactgcagggctga

SEQ ID NO: 7969 - DNA, 201 bp, Homo sapiens
cctattttgctaagcgctgtgctaaactatatgccttaactcatcttaatgtctacaacagcttatatgagggctttaaaccaaggcttggtaaactactrcccatgggccaaacctggcccatcatctagttctgtatagcccacaagccaagaatggtttttacatttttaagtggttgaaaaaaaatcaaaagaatat

SEQ ID NO: 7970 - DNA, 201 bp, Homo sapiens
gaaacccccagagtgggaagaagagctcctgcgaggacctacattttgccattcccctctgccctggggctcagagccttgaagcctttgcttggcccttrcatgttaggatatggccaagaatcagaaactgatgcgtttttccagcactacctgtgtgctgcactcatggaaggtgggaagctatacacaggtatccaa

SEQ ID NO: 7971 - DNA, 201 bp, Homo sapiens
gaatattcattgagcttggaaaggggttggaatgagagaaccgtttggaagcactggaatacagctttattcctacacgattagacccgttaccccgtggstctggccgaccgtcctgactcggagatccctgagctgcgccgccgcttccttcgtcaacatccagcagctacttgatgagcgccctccagtgggccttag

SEQ ID NO: 7972 - DNA, 201 bp, Homo sapiens
ggaagcactggaatacagctttattcctacacgattagacccgttaccccgtgggtctggccgaccgtcctgactcggagatccctgagctgcgccgccgyttccttcgtcaacatccagcagctacttgatgagcgccctccagtgggccttaggtccctatgccggcgcggggttacagcagtggacagacaggccagt

SEQ ID NO: 7973 - DNA, 100 bp, Homo sapiens
tggctggctccctttctgaatttctgtctcaatgtgatataattgccacmattcaggatggctacccacatctggtatgaacaccatgacttctgtaagc

SEQ ID NO: 7974 - DNA, 201 bp, Homo sapiens
gtttaccacctcctttttaaagggggaactctgagctgatttttggtagtgcaaatttcctagtcatatgctttcaatatgtgtttgttttttgttcttgktgtctgtcagagattatcatctgttgtggcagagaaaggcatttttcctcctccctcttctctgatgcttgcaaacgctcctagtggccaatgaacattg

SEQ ID NO: 7975 - DNA, 201 bp, Homo sapiens
cccttatatcctcctctccatgaccatttgctttcatgcctccatttagctcagcgtttcatttggaatagaggtctgcatcatacccaacctgcaaagcrgcctgggtggaaattattccatgcagcattccatgatgcttcccctggaataaatttccccctccttagaaattcttttttttttgaaatggagtttcgc

SEQ ID NO: 7976 - DNA, 201 bp, Homo sapiens
gtgaaaaatgtcattgttgaggaggtcactggctaggaattttagaagtgagaacacagtggtcattgctgtagtctagatttgggtggtccttcaacacytcagatgtataattaatttgggatttgtgtatcaaaagttctgctaccttttaatactcaataatactgatattataacctttgaaagggtggagagaga

SEQ ID NO: 7977 - DNA, 201 bp, Homo sapiens
ctgctgcctgcagattcactccttcttggtgttcttggcttctcattggaggcggctgcgttctcatcctacccactactttctccaggcttcatgtccaygacctgcccaatcccaagtctccctcacgctcttccattcagctcctttggctaacccaaagtgcactaattctgaagacccaaagggaggggtgtatca

SEQ ID NO: 7978 - DNA, 201 bp, Homo sapiens
acgggagacaggttagtggcagaatgtgtgtgttcatggggcctttatgatctgtgtagagaacagacttacaatcagttaactgggtgcagcctagaacygaatgtatgttataaaagaggtgcaggaaagtgctgcgaccctgaggatgcagaggttccttcagttggttggactggagtagcctcatggtagtggtgg

SEQ ID NO: 7979 - DNA, 201 bp, Homo sapiens
ctttggcctggtcacctccactttgaaatttgatcattggtatgagtcctgggagagtcgttcaggcagatgcatttgttcatgtaagcccacatttcagkcattcgttcaggacacatttaatgagggccaactctatacctgacactgtgtaaagccctggatgtgtgataacaatgaagaggacatgggctctgcttt

SEQ ID NO: 7980 - DNA, 201 bp, Homo sapiens
tctgatggctccaggaatcctctggattcggagtagtaatagtaatagcactttaaagtaggctcattactagagcggttattgcttttgttcgaaatggyccatctaagtcaggccctattaaatagagcaatttaactgacacttagcgtctttagggagataaattatcctttggcctggtcacctccactttgaaat

SEQ ID NO: 7981 - DNA, 201 bp, Homo sapiens
ttttgttcttgttgtctgtcagagattatcatctgttgtggcagagaaaggcatttttcctcctccctcttctctgatgcttgcaaacgctcctagtggcyaatgaacattggatgcacccatgaagtagaatccacacatttaattctagattgattctctgaggccttccctgccaggctcctttcagccaagcatatt

SEQ ID NO: 7982 - DNA, 201 bp, Homo sapiens
acatgggactcccccaggtgttgtctttcatttcctttttctctaaccctgggattactgaggctgaggaggtgtttaccacctcctttttaaagggggarctctgagctgatttttggtagtgcaaatttcctagtcatatgctttcaatatgtgtttgttttttgttcttgttgtctgtcagagattatcatctgttgt

SEQ ID NO: 7983 - DNA, 201 bp, Homo sapiens
aattcatgttgctccaataggggcttttttcaaactgatgtcttatccttcttagttcctcaagctcgatcctgttcagacatgttataacaagttagtaygagtttatttgggtacagaaaaattttaaaatccatgcataattttttcataatatgcattttcacaaactttgaagatccctttcatttacctatctcc

SEQ ID NO: 7984 - DNA, 201 bp, Homo sapiens
taggaagttccaaactttcccacatcttcctgccttcttctgagctctccaaactgttccaacctctgcccattacccagttcgaaagtcactttcacatkttctggtatctttacagcagtgccccactcctggtacccattttctgtattagttcattttcacactcctataaagaactgccttagactgggtaatttc

SEQ ID NO: 7985 - DNA, 201 bp, Homo sapiens
ccatgtcacgatcagcattttggtcaagaacattcaacaagtctctaggaagttccaaactttcccacatcttcctgccttcttctgagctctccaaactrttccaacctctgcccattacccagttcgaaagtcactttcacattttctggtatctttacagcagtgccccactcctggtacccattttctgtattagtt

SEQ ID NO: 7986 - DNA, 201 bp, Homo sapiens
agttggcaaggcttgaggcttgcaccctctgacaccacagcttgagctgtaccttggccccttttagctggagctggagtggctaggacacagggcaccaygtcccaaggctgcagagagcaactgggtcctgggccctgctcacaaaaccatttttccctcctggcctgtgatgggaggggctgctgtgaagttctctga

SEQ ID NO: 7987 - DNA, 201 bp, Homo sapiens
aataaaaatcaccagtaatcctatcattcagaaaatgttggcatagtattctttcagttatattgtatacgtgtgtgtgtgtgtgtgtgtgtgtgtgtgtscacataatttgtaacgttctttttaaattttatatacagcggacatttttctattcattaaaagcatttctaacttggttttcactcagacttttttacc

SEQ ID NO: 7988 - DNA, 201 bp, Homo sapiens
gaaatttttcctcctggctggagagtccggctgtctgtaaatgcattatcatttgtgcagcacggggtagattgtgatctgagctggaaagtgagccatgscaggcaggggttggagcctgttggagctgattatcgcgggtgttcagtgcaaagctgaatctcttgccccgtgtctcttaaaaaccatggtctctcatgt

SEQ ID NO: 7989 - DNA, 201 bp, Homo sapiens
gcttccgagattcaagcaattctcctgcctcagcctcctgagtagctgggattgcaggcatgcaccaccaagcctggctgattttgtatttttagtagagrtggggtttctccatgttggtcaggctggtctcgaactcctaacctcaggtgatctgcctgccttggcctcccaaagtgctgcaattacaggcgtgagcca

SEQ ID NO: 7990 - DNA, 201 bp, Homo sapiens
aatctggggagagggatcctttctcccaggagtttgttggggtcaagaaacgtaactttaaatgctcctattgcaagattgggtttgtcgatacacaggcrattctttgggtgttccagtcctatggggtgagaaagaatgaatatatatattttttatctgtctctgtatgtgcctgtgtcaattcctagtaaatattta

SEQ ID NO: 7991 - DNA, 201 bp, Homo sapiens
aggctccggcacatggagaatacccaataaatggtagttatcattagggccatttttatgtgaggagggcatattatttgtcatttgtaaagaacacttgrggacgcaaaccaggcagaatgggtaaacaaattgggtaaaatcctatattttttcaaaaagccatttgaatgtgcacctgaggcctgaaaatgtggatta

SEQ ID NO: 7992 - DNA, 201 bp, Homo sapiens
tactccctgcttttgggctttgtgttgtttccaggtttttgttgttacaaacatcactgtgaatgacaggtttgtagctattactagcatacacttaacartcattcctgttgatcagaaaaatccccagaaattccacatccctttgttcctccagagttgaatggcttgcagcagagacagctgcctggcactggcccc

SEQ ID NO: 7993 - DNA, 201 bp, Homo sapiens
gctccttcattcctgccagctcacccttacctctccagtagtaaagggcttgtgcctttgcctgctctgggtgagagtcccagagcacagtagcccatcamactgtgttgcagctgtcactattccctggatacagaaagaaacaaaggccaaagttagggtgctaatggtttgggattcaccatggggagaaggtgaatc

SEQ ID NO: 7994 - DNA, 201 bp, Homo sapiens
taaatgcattatcatttgtgcagcacggggtagattgtgatctgagctggaaagtgagccatgccaggcaggggttggagcctgttggagctgattatcgygggtgttcagtgcaaagctgaatctcttgccccgtgtctcttaaaaaccatggtctctcatgttgttagcataaaggcacttgattgacaaaaggagaga

SEQ ID NO: 7995 - DNA, 201 bp, Homo sapiens
ttgttttccaacttgctctttcccttctgactctattgtggctattcttccgtgtcagtacgttctaactcctgaattctttttaaaggctgatgtggtastatggctatattgcatcataggaggggacctcagaaagtttgtggaaagacataattaaaagataaaaatataaactttactcctcaacataagcttcat

SEQ ID NO: 7996 - DNA, 201 bp, Homo sapiens
ggttctgaagaaaagatgccaatagaaaatatacccacattctaaaaggacctctcagttccttccctgcagagtgtgtgttctaagattgtgcagatatraatgtaaataccagtacactatacatctacatctctagcgatgaacaaacatgggattctgctatacatattgttttccaacttgctctttcccttctga

SEQ ID NO: 7997 - DNA, 201 bp, Homo sapiens
agttttttttcctttccttactaagtcgagaactttcaccttttcacttaaaggaagcactttacagcttctctttggcatacctgaattaccagcatcaytcttcttgtgctttggggccattattaaataaaattggttactgaaacacaaacattgcaagacagaggcagttgatctgataactgagaccgttcttaa

SEQ ID NO: 7998 - DNA, 201 bp, Homo sapiens
atctggggagagggatcctttctcccaggagtttgttggggtcaagaaacgtaactttaaatgctcctattgcaagattgggtttgtcgatacacaggcawttctttgggtgttccagtcctatggggtgagaaagaatgaatatatatattttttatctgtctctgtatgtgcctgtgtcaattcctagtaaatatttat

SEQ ID NO: 7999 - DNA, 201 bp, Homo sapiens
ctgttcagcctacctgagtggcctcttctcctttgtggaagggagcaaatgagtcttttgattaaagttgttataaatattagatgcttgtaaaggctccrgcacatggagaatacccaataaatggtagttatcattagggccatttttatgtgaggagggcatattatttgtcatttgtaaagaacacttggggacgca

SEQ ID NO: 8000 - DNA, 201 bp, Homo sapiens
gttggatttttccatggctatgtttttgtggccagataaaagaattgagtgaagatgaaataaagtttaggcagacccaacccttgtagaaatcccagacmctcagtttactccacgtgacctctggtggactgttcagcctacctgagtggcctcttctcctttgtggaagggagcaaatgagtcttttgattaaagttg

SEQ ID NO: 8001 - DNA, 201 bp, Homo sapiens
caggtgctgggaagcgggtgtgagatggttggatttttccatggctatgtttttgtggccagataaaagaattgagtgaagatgaaataaagtttaggcasacccaacccttgtagaaatcccagacactcagtttactccacgtgacctctggtggactgttcagcctacctgagtggcctcttctcctttgtggaaggg

SEQ ID NO: 8002 - DNA, 201 bp, Homo sapiens
ccgaagtaattaatgcactttctactagtgagagaaggtgtaattcgcaggaatgtgtgtcaagacccaccctgctaaatttataccctgtaatttgcaaygtttgttggcactgaattggcaggttggtgagtctagcctacctgctttgcaattatatctactggccggtattgtaggattgagtaactggagagactc

SEQ ID NO: 8003 - DNA, 201 bp, Homo sapiens
ccaagagggaggaaatggctgctccattgccaccatcctgctcaaggttcagccctactggtcccatatttgtgccttgacctgggttactctgtccccarccccacacagtgggcctcagtgactctctcagtctgtgggggagaaagttaacaattctgattccaagagctttggaaaaatcccacctcctccagcagt

SEQ ID NO: 8004 - DNA, 201 bp, Homo sapiens
gtggattcagaccttacttctggctgcatctgccttgctccagatgtcgactattccccttcctgcaggggaagtcgcacttttagcccaagagggaggamatggctgctccattgccaccatcctgctcaaggttcagccctactggtcccatatttgtgccttgacctgggttactctgtccccaaccccacacagtgg

SEQ ID NO: 8005 - DNA, 201 bp, Homo sapiens
ttccaacctctgcccattacccagttcgaaagtcactttcacattttctggtatctttacagcagtgccccactcctggtacccattttctgtattagttyattttcacactcctataaagaactgccttagactgggtaatttctgaagaaaaaagggctaatttactctcaattctgcaagcttaacaagaagcatgac

SEQ ID NO: 8006 - DNA, 201 bp, Homo sapiens
ctgcttagaaatttcttctgtgagataccctaaatcatctctgtcaagttcaaagttccacagatctctagggcaggggcagaatgccaccagtctctttrctaaagcatagcaagagtgacctttactcccgttcccgataagttcctcatctccatctgagaccacctcagcccggacttcattgtccatgtcacgatc

SEQ ID NO: 8007 - DNA, 201 bp, Homo sapiens
ttgatagggtcttacagcaaaaatgagccctgtgacatcctgtctcttggaagggttggaatgcttttgtccctgttctaaagagtcactctccagggacrgagcatcatgttagttcagcttagattacatgatctccctttggctagaaagggtagaacctctgcctatggtcctactacattatagccactgagaaag

SEQ ID NO: 8008 - DNA, 201 bp, Homo sapiens
gttgatagggtcttacagcaaaaatgagccctgtgacatcctgtctcttggaagggttggaatgcttttgtccctgttctaaagagtcactctccagggayagagcatcatgttagttcagcttagattacatgatctccctttggctagaaagggtagaacctctgcctatggtcctactacattatagccactgagaaa

SEQ ID NO: 8009 - DNA, 201 bp, Homo sapiens
cgggtgttcagtgcaaagctgaatctcttgccccgtgtctcttaaaaaccatggtctctcatgttgttagcataaaggcacttgattgacaaaaggagagrcagggagagtctctggagatgtgctggcactctggttcattatgtttctttattctgctggcatttcctatgtcagtcttgcttcgtgtggagccattat

SEQ ID NO: 8010 - DNA, 201 bp, Homo sapiens
catgtttattttttgtgccatgcttgttcgttttctttattcatttttttcttggtttgtttgcagttctcttaaggagttccaattagggacatagaggrttgttttaaaacacacatttagaaaaaaaaatctcgatgggcatttctggctataaaactctataaaagaccaagtacttcttctttctggcattgaagg

SEQ ID NO: 8011 - DNA, 201 bp, Homo sapiens
accagcatcattcttcttgtgctttggggccattattaaataaaattggttactgaaacacaaacattgcaagacagaggcagttgatctgataactgagrccgttcttaagtgactaataggcagatagtgtagacagtgtgtgtatgctggacaaagggaagattcatatcctgggcaggacagagcaggacgacacga

SEQ ID NO: 8012 - DNA, 201 bp, Homo sapiens
tggtctcgaactcctaacctcaggtgatctgcctgccttggcctcccaaagtgctgcaattacaggcgtgagccaccgcacccagcccctcttagtaattsttacattccatttcttactttcttctgtggcatttatgacttccaacttttataattataaaataattttaattttatagctctttaggtgcacacttct

SEQ ID NO: 8013 - DNA, 201 bp, Homo sapiens
cggcctgggtggaaattattccatgcagcattccatgatgcttcccctggaataaatttccccctccttagaaattcttttttttttgaaatggagtttcrctcttgttgcctaggctggagtgtgatggtgcgatcttggctcactgcaacctctgcttccgagattcaagcaattctcctgcctcagcctcctgagtag

SEQ ID NO: 8014 - DNA, 201 bp, Homo sapiens
attacaactgtggagattatagcagtctcctacagctttggttatgaaaataatatatatcgtctttttattccctttaattgaccattctcttaccttcytttgtctccacatggagacacggctagatatctccctcctttgtatttttttctctcttctccaacactctgagatcaaggcccaagtaagtacacacct

SEQ ID NO: 8015 - DNA, 201 bp, Homo sapiens
ctgaggcttgcctgagtgtggaaggaccggcggcttgggaaggcatttcttcagcagtcctcctcagccagcactctggaaaaggaaaacacaaaactgtkagaacagaaatggtcttatggtccattttatgagctgcatcagccctaataatcagctctgggggagactcgtgttagtttttaaaactagaagtcactt

SEQ ID NO: 8016 - DNA, 201 bp, Homo sapiens
ttctgagaattaaatggaacaggtttagtgaaagcgctgagctgtgtgccaggcacatacgaagtaggagttactgaatggatgtgtgatggtggttcacyctccccgaatcccagactgggcaccttgggctcgctgcctctccatagctgctgcagttcctagtgtttaagagtgtgggttttagagtcatacagacct

SEQ ID NO: 8017 - DNA, 201 bp, Homo sapiens
gggatgagatgcctcccagagttgttctgagaattaaatggaacaggtttagtgaaagcgctgagctgtgtgccaggcacatacgaagtaggagttactgratggatgtgtgatggtggttcaccctccccgaatcccagactgggcaccttgggctcgctgcctctccatagctgctgcagttcctagtgtttaagagtg

SEQ ID NO: 8018 - DNA, 201 bp, Homo sapiens
catgtgttattacgttatcatcacattttgttagggaaaaccgtacacatttccaattaagacaaagaatgtgcaatttcctgaagtcaggattgaggtcrtaactttgagtgctcaagaattccaagtttaattaagccaccaaatgctgttgataaagagaaaatgccctatcaatatcagaggtgatgagagggtgat

SEQ ID NO: 8019 - DNA, 201 bp, Homo sapiens
cttgcttcactggagaagggcccctttggcacacctaccacattgcttcccactttccagtagaaaagaattagagatggactgcctaaataataaggtgscatttatgccatagaagctcacaggcatcctacaaatggaatatgtaagaacagctatttcccgtacaacagtgcccattttatcccttagctttctggc

SEQ ID NO: 8020 - DNA, 201 bp, Homo sapiens
ccccattgataccctcagctaacatcatctcccggtgctttttctaactctggcttatcttaccagccacccagggtcacactaggtcttcatcaggcccstcctggactggggagggtccactggaacctcacttggctttaggacagtgagtgtcatcgaactggacaaggtcagaggaagtcagaaatgttattcctg

SEQ ID NO: 8021 - DNA, 201 bp, Homo sapiens
caactcttttggttagtatagttttaaaattattagctttattttttgtcgtttatgttgttgaaaacaataggcttttaggttacttgagacccagtgarcagctctgttctaatattaattaacatttacaaaacacaaagggccccttttgctggggctcctcgtctaggggggttgctttcgcatttcttctaaacc

SEQ ID NO: 8022 - DNA, 201 bp, Homo sapiens
gcagaatgtgtgtgttcatggggcctttatgatctgtgtagagaacagacttacaatcagttaactgggtgcagcctagaaccgaatgtatgttataaaasaggtgcaggaaagtgctgcgaccctgaggatgcagaggttccttcagttggttggactggagtagcctcatggtagtggtggcattactgatccttgaag

SEQ ID NO: 8023 - DNA, 201 bp, Homo sapiens
gtcgtgcacccccatgccccatgactgtatttttagtagagacggggtttcaccatgttggccaggctggtctccaactcccgacctcaagtgatccaccygcttggcctcccacagtgctggaattataggcatgagccactacatctggcccatgtttcatttaatacagttcttcaaagatatgcttcaggatcttgg

SEQ ID NO: 8024 - DNA, 201 bp, Homo sapiens
ctttttttttttttttgagtctcgctctgttctccaggctggagtgcattggcgtgatcttggctcactgcaacctccacctcccagattcaagcaattckagtgcctcagcctcccgagtagctgggattacagtcgtgcacccccatgccccatgactgtatttttagtagagacggggtttcaccatgttggccaggc

SEQ ID NO: 8025 - DNA, 201 bp, Homo sapiens
ttgtgcagatataaatgtaaataccagtacactatacatctacatctctagcgatgaacaaacatgggattctgctatacatattgttttccaacttgctytttcccttctgactctattgtggctattcttccgtgtcagtacgttctaactcctgaattctttttaaaggctgatgtggtagtatggctatattgcatc

SEQ ID NO: 8026 - DNA, 201 bp, Homo sapiens
gaggaagaaagccaggttcagacatctcccttggctgcaggcagaaatcagcattcagttgtctaatctgtagactcatcaaacataaattattctggatkgcttttctctctgtatagcttgctataaactttatgatttatttttattttattttttgccaaagacaaataaaaaatgtttaaacaaaagaagggggga

SEQ ID NO: 8027 - DNA, 201 bp, Homo sapiens
ataagtgttgtccgctaggatcaggaagacattggtggagagctaaggtaaggcaggctttgcaggcacacccccttttttttcctcaaaaagatactttrtaaaaaagtcttcagttggttctttcttttgaaacctttcctcctgtggtttttggttgtgtgtcctgttgctgaactgtgggcctgtgattcttgggcc

SEQ ID NO: 8028 - DNA, 201 bp, Homo sapiens
aatatattctatagtagtctccccttatcttcggggggtacatttcaagacccccagtggatgcctgaaaccgaatatagtaccaaattgctgtcaactgraacctatttctgtccatgtgttccacctacaaatttaatgcctttccatcctaactaagcacttatcacacactctggctataacttttgcagtttgagg

SEQ ID NO: 8029 - DNA, 201 bp, Homo sapiens
aggcatcacgtctaagggaagtctgagtggcggcctgtcaccagcatcatgactgtttgacttcatagtctaactgcatgactgtggggaagaaggcaggyacggtcatagaagtttgctattttcttcgaaagtgatttcttactattgattttaatcagtttagattgttgttcttctatattctaaagtctctagggg

SEQ ID NO: 8030 - DNA, 201 bp, Homo sapiens
ttgttgtctttggggttttgaagatttgaaggaaactggtcagaattattgacaaagtgctcaggcctcaaaaaatactatcagaataagggactgaagartataacctactttattgtgtttgtgtctggagtatctgagtgttaaaatttgaagcccagggtagctctctgtattgcttgttacattttaggattgctt

SEQ ID NO: 8031 - DNA, 201 bp, Homo sapiens
ttgctctgagacagaccttttaatagtattaaatcaaatgcttccaaaccatagtttagaccccctgctctgggagcagtcatcataggcagggctttgaygaactccctttgcaggatctggttgtctatcctggtcacctggatttacaaaaggctaagaatagcattggagaagacagtcctgtattatttttcactt

SEQ ID NO: 8032 - DNA, 201 bp, Homo sapiens
ttggtgttgggacctcttcaaggcttgagaaaatataaggaggaatttagaatctggggagagggatcctttctcccaggagtttgttggggtcaagaaaygtaactttaaatgctcctattgcaagattgggtttgtcgatacacaggcaattctttgggtgttccagtcctatggggtgagaaagaatgaatatatata

SEQ ID NO: 8033 - DNA, 201 bp, Homo sapiens
ttttaaaactagaagtcactttgcagcctctgcagaccagtgattttagtacagtcctcgtaaattttctttctgaggggaaactggcaggagaatccgayaggctgcaatgtaagcttgtagttcaggtgctgggaagcgggtgtgagatggttggatttttccatggctatgtttttgtggccagataaaagaattgag

SEQ ID NO: 8034 - DNA, 201 bp, Homo sapiens
ttccttaagggtgcagtcaaggggatgagatgcctcccagagttgttctgagaattaaatggaacaggtttagtgaaagcgctgagctgtgtgccaggcayatacgaagtaggagttactgaatggatgtgtgatggtggttcaccctccccgaatcccagactgggcaccttgggctcgctgcctctccatagctgctgc

SEQ ID NO: 8035 - DNA, 201 bp, Homo sapiens
aattcgacatgagatttggacagagacacaaatccaaaccatatctaagatgttgagcaacttaaacaaaaactgcgcccttgcccactatagatgcccastcgttcctcatcccacaggaaatatgggctcagagacctcaatggtgggtagcatcattgagtgttttcctctagccccagcagtttgattctgtttaat

SEQ ID NO: 8036 - DNA, 201 bp, Homo sapiens
ctacattatagccactgagaaagtgataattcaaataaagtagaaggagaatggatgttgtattagtccgttttcacattgctataaagaaccacctgagmctgggtaatttatgaagaaaagaggtttagttgactcacagttccataggtttaacagaaagcatggctgggaggcctcaggaagcttacaatcatggtg

SEQ ID NO: 8037 - DNA, 201 bp, Homo sapiens
tcaaagtcttatctgagacaaagtaaatcccttctgcctatgagcctgtaaaatcaaaatcaagttaattacttccaagatacaatggggatacaggtatwgggtgaatgcttttgtttcaagtgggggaaattggctgaaaaaatggggctgtagtccccacacaagtctgaaacccagcagggcagtcattaaatctta

SEQ ID NO: 8038 - DNA, 201 bp, Homo sapiens
gactccatgtctcacatccagggcacaccgatgcaaaaggtgggctctcaaggccttgggcatctctgcttctgtgagtctgcagggtacagcccccatgrcagctttcacaggctggcattgagtgcctgtggcttttccaggtgcatagtgcaagcaatcagtggatctacattctggggtctgaataatggtgacccc

SEQ ID NO: 8039 - DNA, 201 bp, Homo sapiens
gctcacaaaaccatttttccctcctggcctgtgatgggaggggctgctgtgaagttctctgaaatgccctggagacatttctcctgttgtcttggctattracattcagctccattttacttatgcaaacttctgcagcagggttgaatttctttccagaaaatagggttttcttttctaccacatggccgggctgcacat

SEQ ID NO: 8040 - DNA, 201 bp, Homo sapiens
ctgccagctcacccttacctctccagtagtaaagggcttgtgcctttgcctgctctgggtgagagtcccagagcacagtagcccatcacactgtgttgcarctgtcactattccctggatacagaaagaaacaaaggccaaagttagggtgctaatggtttgggattcaccatggggagaaggtgaatcaacctctctgtg

SEQ ID NO: 8041 - DNA, 201 bp, Homo sapiens
tgccagctcacccttacctctccagtagtaaagggcttgtgcctttgcctgctctgggtgagagtcccagagcacagtagcccatcacactgtgttgcagstgtcactattccctggatacagaaagaaacaaaggccaaagttagggtgctaatggtttgggattcaccatggggagaaggtgaatcaacctctctgtgg

SEQ ID NO: 8042 - DNA, 201 bp, Homo sapiens
gcagtcattatttatttatactttaatcttcatggattactctgagttgctcatagctttccagaaagctccgagtaagtggaagtcgtacatgcacccgragtaattaatgcactttctactagtgagagaaggtgtaattcgcaggaatgtgtgtcaagacccaccctgctaaatttataccctgtaatttgcaatgtt

SEQ ID NO: 8043 - DNA, 201 bp, Homo sapiens
agaaattcaatccatgcagaaaattctatgagtcacttcatttcctgcaacattttttttccattattcatattatggaaaagagcacatcaaaaaggcargtctgcaaataacacagttttcaaaaagattgttttatttttcttacgaagaagttttccagaaatctgtaaccagtatcaggaattctccagctttgta

SEQ ID NO: 8044 - DNA, 201 bp, Homo sapiens
ctccctcacgctcttccattcagctcctttggctaacccaaagtgcactaattctgaagacccaaagggaggggtgtatcacctctttgtcttttctggasctccacgtgtgtcactggcctcctggaaatctcctgttggatcaaaggccccctgtggtgctgtcagccatggcagggtcctccccaagggatgatggtg

SEQ ID NO: 8045 - DNA, 201 bp, Homo sapiens; identical to SEQ ID NO: 857

SEQ ID NO: 8046 - DNA, 201 bp, Homo sapiens; identical to SEQ ID NO: 851

SEQ ID NO: 8047 - DNA, 201 bp, Homo sapiens; identical to SEQ ID NO: 860

SEQ ID NO: 8048 - DNA, 201 bp, Homo sapiens; identical to SEQ ID NO: 859

SEQ ID NO: 8049 - DNA, 201 bp, Homo sapiens; identical to SEQ ID NO: 858

SEQ ID NO: 8050 - DNA, 201 bp, Homo sapiens; identical to SEQ ID NO: 856

SEQ ID NO: 8051 - DNA, 201 bp, Homo sapiens; identical to SEQ ID NO: 855

SEQ ID NO: 8052 - DNA, 201 bp, Homo sapiens; identical to SEQ ID NO: 852

SEQ ID NO: 8053 - DNA, 201 bp, Homo sapiens
aaggtggggtggccggacctggttgcctaaccctcatcctgggagctctggaatcccgtgttaccaacccctgtgcttacttcctatgagacaccttgccytctgtctgtgaggttcctgatttctcttcttgaaacgatattatttcctgctagtctaaatgttctgcctgatttcaaaaaaaaaaaaaaaagatttgag

SEQ ID NO: 8054 - DNA, 201 bp, Homo sapiens
agtgttgagaaataatttggggcatagaatactatttatctccaaagtaattcgaaatacaggcttttgctcatttgtctgttctctgggttttttcgggktttttttgttgttgttttgttttgttttttggtttggttgattttggtttatttatttattttgaggaccaacactaaagggaatggaaaatctttccag

SEQ ID NO: 8055 - DNA, 201 bp, Homo sapiens
accttgccttctgtctgtgaggttcctgatttctcttcttgaaacgatattatttcctgctagtctaaatgttctgcctgatttcaaaaaaaaaaaaaaaagatttgagatatttacagatttcttttttttgtagtcacccagaatctatagaacccttttcttatttcttagaattttagcatggtcttatcttagaat

SEQ ID NO: 8056 - DNA, 201 bp, Homo sapiens
gtcttaccaatggtggtttgttccctcctgaacaattttctgcttcacactggcaagcttcctaaattcatctccagaactgcacgcctggggagttgagytgcaatcagagaaagaaggcagcagagagggatgatgtttcatcggcctggtgcttcacttaaagatgggtctgggggcattgctcttgtgcactgaccc

SEQ ID NO: 8057 - DNA, 201 bp, Homo sapiens
cctctacctctgttggttgtaaatctgtcttaccaatggtggtttgttccctcctgaacaattttctgcttcacactggcaagcttcctaaattcatctcyagaactgcacgcctggggagttgagttgcaatcagagaaagaaggcagcagagagggatgatgtttcatcggcctggtgcttcacttaaagatgggtctg

SEQ ID NO: 8058 - DNA, 201 bp, Homo sapiens
agaatactatttatctccaaagtaattcgaaatacaggcttttgctcatttgtctgttctctgggttttttcggggtttttttgttgttgttttgttttgytttttggtttggttgattttggtttatttatttattttgaggaccaacactaaagggaatggaaaatctttccaggagagtcataagggtaccctaaaga

SEQ ID NO: 8059 - DNA, 201 bp, Homo sapiens
agacagtgttgagaaataatttggggcatagaatactatttatctccaaagtaattcgaaatacaggcttttgctcatttgtctgttctctgggttttttmggggtttttttgttgttgttttgttttgttttttggtttggttgattttggtttatttatttattttgaggaccaacactaaagggaatggaaaatcttt

SEQ ID NO: 8060 - DNA, 201 bp, Homo sapiens
gctgaagggaaacaaacaaaaaggaaccagaggccacttgtatatataggtctcttcagcatttattggtggcagaagaggaagatttctgaagagtgcasctgcctgaaccgagccctgccgaacagctgagaattgcactgcaaccatgaggtaaatattttcccttcgtattcggtagtgctgttgagtcatcttgtc

SEQ ID NO: 8061 - DNA, 201 bp, Homo sapiens; identical to SEQ ID NO: 854

SEQ ID NO: 8062 - DNA, 201 bp, Homo sapiens; identical to SEQ ID NO: 850

SEQ ID NO: 8063 - DNA, 201 bp, Homo sapiens
gcaggagtttataggaaggacccgccttccattcaaagctccaaataggtcttagcaaagagccaggttgtctaagtcccttgatgtaactaaccccaggygcgggagccccggagagtgcttggcttggtatcaggcatcctaatggcagatgcattcccgttgaaaagctcatgtccaaacagatctgtttttattctt

SEQ ID NO: 8064 - DNA, 201 bp, Homo sapiens
cctgtgatctagaagccagcttgactgtcctgaagctgtactagttcaacccagccttctttcagaccacggtcaccacccagatcccgctgaaggccttwaccaacccatgccacaccagcttcaccctgtgcaagcacatggtcatccaagcgcatcaagaaaagcagctgatccaacagattttgtacctgggagatc

SEQ ID NO: 8065 - DNA, 201 bp, Homo sapiens
caagttgctcaacaatatccacaggtataattctgagaacctggcctccctggggagctatgtggagatacaggccaaggagaatgcctgtgatctagaarccagcttgactgtcctgaagctgtactagttcaacccagccttctttcagaccacggtcaccacccagatcccgctgaaggcctttaccaacccatgcca

SEQ ID NO: 8066 - DNA, 201 bp, Homo sapiens
ctggaaatctccccaggtattcctggaacccgaatcaaggtagcccaaaagtgctcatcaggagagtatgtgtctttagaccaggcaaaaaagtcttgaaygatggagttgttgaaaatatatttaacaaatgcttgacttaaaacaaaataagcactgccaacaaatatctgaatgttatgggggggtgcttccttggag

SEQ ID NO: 8067 - DNA, 201 bp, Homo sapiens
ccatacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactg

SEQ ID NO: 8068 - DNA, 201 bp, Homo sapiens
catacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgt

SEQ ID NO: 8069 - DNA, 201 bp, Homo sapiens
atacaacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgtt

SEQ ID NO: 8070 - DNA, 201 bp, Homo sapiens
caacagaattataatgattccatagaaagtattccattgtaaagaaacttatctagaatgataacttatgaattgaggacttaggcttaatgttctggtgtgtgacacttggagctattggtcagttcttatttttaatcagtaaatgcattttaaagaaacagttgaactaaaaaggaggccattcatgatactgttttg

SEQ ID NO: 8071 - DNA, 201 bp, Homo sapiens
taataacatcaaaggctagatcactttcccttgtgtatggaattttggacaccttttaaaatatgggaggactgagtttaaacagtattgggcatagtatrgtattcaattccacactgactccatttatcaggcaccctcttatttccatcctgattttactatcatgatgtggtagtgagatttctatccataaataac

SEQ ID NO: 8072 - DNA, 201 bp, Homo sapiens
ccacactgactccatttatcaggcaccctcttatttccatcctgattttactatcatgatgtggtagtgagatttctatccataaataacttttctgaggrcaaagtgatccagtctctctgctgttcttcaagcttttctgccaagcatttaatcaagatagggtccaccttagaatcaaatttattagcaaaccaatgt

SEQ ID NO: 8073 - DNA, 201 bp, Homo sapiens
ggtggtattttggggtattctgtgttaactatacctaattttgagagatgttggtttccaaacagaagggaaggtaatgtaaactcctaaaatataaatakagtgtgtcttatattgtctgcatttctgcttagcatatttgaggagggattgctctggtttgggcagaggtctagagaactggatgtcatcaacagggcc

SEQ ID NO: 8074 - DNA, 201 bp, Homo sapiens
aaattaatttagaaagctgtcatatttcacacaaccttttgaagaaagtttagtgactcttagcttgatagttccatacaacagaattataatgattccayagaaagtattccattgtaaagaaacttatctagaatgataacttatgaattgaggacttaggcttaatgttctggtgtgtgacacttggagctattggtc

SEQ ID NO: 8075 - DNA, 201 bp, Homo sapiens
gctagatcactttcccttgtgtatggaattttggacaccttttaaaatatgggaggactgagtttaaacagtattgggcatagtatggtattcaattccayactgactccatttatcaggcaccctcttatttccatcctgattttactatcatgatgtggtagtgagatttctatccataaataacttttctgagggcaa

SEQ ID NO: 8076 - DNA, 201 bp, Homo sapiens
caggtacggccccgaccccgcccaggcggtgccggcgctcacagtgtcctcggtggcgcatgaagctgtctcgccacatgaacttcttggcgcagactccrcactcgtagggcttgagacctgtgtgcgtcttcatgtgctcagtcagatggtgcttcatcttgaactttttgttgcacacggggcagtcaaacggccgca

SEQ ID NO: 8077 - DNA, 201 bp, Homo sapiens
tcgcttcacgtatacccagtgtttctgtggcatgatgctagggggtgtgtaggtgggtctccggagcccagccccaggaaccactgcccccctcccatccycaccatcatcgcacagctcatctgcctccagcagcagctttccagatgtggcccctccactgccaacgacaggggctgggaatacagggccacctcctcg

SEQ ID NO: 8078 - DNA, 201 bp, Homo sapiens
ctaccccctagttcttcatcttcatcatcctcacaggtcaacaccagatcttcctcctcctcttcctcctccagatctgggtcttggggaaccaggggtgytggcgctgggcaattaccacctcgcttcacgtatacccagtgtttctgtggcatgatgctagggggtgtgtaggtgggtctccggagcccagccccagga

SEQ ID NO: 8079 - DNA, 201 bp, Homo sapiens
tctccggagcccagccccaggaaccactgcccccctcccatccccaccatcatcgcacagctcatctgcctccagcagcagctttccagatgtggcccctscactgccaacgacaggggctgggaatacagggccacctcctcgacgctccccactgcccactgcagaagctgcaaatgcctcttgggaggaagatgagaa

SEQ ID NO: 8080 - DNA, 201 bp, Homo sapiens
caggggccacagtgcccccactcccggatggcaccccagcaccagggacagtgacagaggtggctgcagcagtagtgatggtggtggtagctgaggcccgsccttctcggagtagttcagtgcacttgtccacaatgtgccacatttggagcacagaccccactgtaaggaagttgacaatgtcagcagcagccatgctga

SEQ ID NO: 8081 - DNA, 201 bp, Homo sapiens
ctccaccttgtggactctgggtggggaccagacacgtctgctggacgggggcgtggccgcactcgcttcgtcgccgctgcccccgcccactccgggagacyctctcttggacggcaaggatggccccgtgggagtcccaggcccaggtacggccccgaccccgcccaggcggtgccggcgctcacagtgtcctcggtggcg

SEQ ID NO: 8082 - DNA, 201 bp, Homo sapiens
ctgccacaggacccccaccctcatatgggccaaagtcattggaggactcacagaagttgacctgctcctcccccttgtctgggggctcactcagggtacgsacatcacttatgctgagggtagcctcaggccctccccccactggaaccctggagctaccccctagttcttcatcttcatcatcctcacaggtcaacacca

SEQ ID NO: 8083 - DNA, 201 bp, Homo sapiens
ctgaaaaccaacgcttgctccatctcccctcaggctatgccccccaagctctctcgccgaccacgccccctttcgccccagcttctctagccccgcccctytccaggcccaccccccccgtgccccgcccactatcgggcctttcgaccccgccccttgtctacctccgcccacaacggaccccgcccccccccgctccgc

SEQ ID NO: 8084 - DNA, 201 bp, Homo sapiens
gggcagggcagctctgctactgaaaaccaacgcttgctccatctcccctcaggctatgccccccaagctctctcgccgaccacgccccctttcgccccagyttctctagccccgcccctttccaggcccaccccccccgtgccccgcccactatcgggcctttcgaccccgccccttgtctacctccgcccacaacggacc

SEQ ID NO: 8085 - DNA, 201 bp, Homo sapiens
aagtaaatgaccaataaatattttaatcactgttaaaaaaaataaaaaccttgtactcctacgacttactccctccttgtctccacccactcctccatgaraaccgagttgggaatttccacgggaagtcgggggtggcggggagagacagggtagaaataaagagcgcatccttgagagggggtaggttctaggacaagg

SEQ ID NO: 8086 - DNA, 201 bp, Homo sapiens
aaccttgtactcctacgacttactccctccttgtctccacccactcctccatgagaaccgagttgggaatttccacgggaagtcgggggtggcggggagaracagggtagaaataaagagcgcatccttgagagggggtaggttctaggacaagggtggggctcaaaggccttgtctccacgacaacacaaacacagactt

SEQ ID NO: 8087 - DNA, 201 bp, Homo sapiens
ctcctacgacttactccctccttgtctccacccactcctccatgagaaccgagttgggaatttccacgggaagtcgggggtggcggggagagacagggtaraaataaagagcgcatccttgagagggggtaggttctaggacaagggtggggctcaaaggccttgtctccacgacaacacaaacacagacttcaggcacag

SEQ ID NO: 8088 - DNA, 201 bp, Homo sapiens
tctgtggagcaggggcttcagtgtacccatcagagggaaaggaagggtttagttctggaaataccttgggggggaggggttgagtagtagaatgggcgggygatggtgaaactgtggttccccttccagaatatatacaagtccacagagataaaggaagacagtaagtgtggtgggagatcacccgggggccacagcgcc

SEQ ID NO: 8089 - DNA, 201 bp, Homo sapiens
ctgctgctgggagattgattctcactggcccggctggaggcatgggagcgcgcagagcccatggtagcaggggccacagtgcccccactcccggatggcascccagcaccagggacagtgacagaggtggctgcagcagtagtgatggtggtggtagctgaggcccggccttctcggagtagttcagtgcacttgtccaca

SEQ ID NO: 8090 - DNA, 201 bp, Homo sapiens; identical to SEQ ID NO: 892

SEQ ID NO: 8091 - DNA, 201 bp, Homo sapiens; identical to SEQ ID NO: 888

SEQ ID NO: 8092 - DNA, 201 bp, Homo sapiens; identical to SEQ ID NO: 885

SEQ ID NO: 8093 - DNA, 201 bp, Homo sapiens; identical to SEQ ID NO: 891

SEQ ID NO: 8094 - DNA, 201 bp, Homo sapiens; identical to SEQ ID NO: 890

SEQ ID NO: 8095 - DNA, 201 bp, Homo sapiens; identical to SEQ ID NO: 889

SEQ ID NO: 8096 - DNA, 201 bp, Homo sapiens; identical to SEQ ID NO: 887

SEQ ID NO: 8097 - DNA, 201 bp, Homo sapiens; identical to SEQ ID NO: 893

SEQ ID NO: 8098 - DNA, 100 bp, Homo sapiens
acgagttcagagccacaagaacctactgaatcaaaggcagccaaggagakgcccaagcaggaggtgaccaaagcagtggtcgtggacctgggcactggct

SEQ ID NO: 8099 - DNA, 201 bp, Homo sapiens; identical to SEQ ID NO: 895

SEQ ID NO: 8100 - DNA, 201 bp, Homo sapiens
tcattagtatttcatcagtgattctcttctatttaaaaaatttttaatcctcatataagaattaagacaattcagtaattgtttagcacccacatgtaagrtacataagatttatgatagggttcttggcacatgttagatacaaactaaagcaaaatgatattttacaaatatgcatatttgtcagaaaaatgttctgta

SEQ ID NO: 8101 - DNA, 201 bp, Homo sapiens
gttctcccaaaatgcttgttctaagcaattttttcattagtatttcatcagtgattctcttctatttaaaaaatttttaatcctcatataagaattaagasaattcagtaattgtttagcacccacatgtaagatacataagatttatgatagggttcttggcacatgttagatacaaactaaagcaaaatgatattttac

SEQ ID NO: 8102 - DNA, 201 bp, Homo sapiens; identical to SEQ ID NO: 896

SEQ ID NO: 8103 - DNA, 201 bp, Homo sapiens; identical to SEQ ID NO: 897

SEQ ID NO: 8104 - DNA, 201 bp, Homo sapiens; identical to SEQ ID NO: 901

SEQ ID NO: 8105 - DNA, 201 bp, Homo sapiens; identical to SEQ ID NO: 902

SEQ ID NO: 8106 - DNA, 201 bp, Homo sapiens; identical to SEQ ID NO: 894

SEQ ID NO: 8107 - DNA, 201 bp, Homo sapiens
attcagtaattgtttagcacccacatgtaagatacataagatttatgatagggttcttggcacatgttagatacaaactaaagcaaaatgatattttacawatatgcatatttgtcagaaaaatgttctgtaaacatatacatcaatttaattttctttctgttaaaatgtgttttctgaatttttgtccatgttttccag

SEQ ID NO: 8108 - DNA, 201 bp, Homo sapiens; identical to SEQ ID NO: 898

SEQ ID NO: 8109 - DNA, 201 bp, Homo sapiens; identical to SEQ ID NO: 899

SEQ ID NO: 8110 - DNA, 100 bp, Homo sapiens
tcagaagatgatatggggaccgactttattaagtcaacaactcacctacrgaaagaaattacctctctgactggcactacaaactccataacaagagact

SEQ ID NO: 8111 - DNA, 201 bp, Homo sapiens; identical to SEQ ID NO: 915

SEQ ID NO: 8112 - DNA, 201 bp, Homo sapiens; identical to SEQ ID NO: 914

SEQ ID NO: 8113 - DNA, 201 bp, Homo sapiens; identical to SEQ ID NO: 913

SEQ ID NO: 8114 - DNA, 201 bp, Homo sapiens
ctgagatctccagggttgctgggagccggggcagcaaccaggggtgcggcttgctctccagggagctgcggcagagcctggggccacagctgcactcagcyggtgcacccacggacagagggtcagactcggctcagcactgggctcaagccctggatgagaacaagaaccaagcttcttagcctcaggctccatctggga

SEQ ID NO: 8115 - DNA, 201 bp, Homo sapiens; identical to SEQ ID NO: 916

SEQ ID NO: 8116 - DNA, 201 bp, Homo sapiens; identical to SEQ ID NO: 912

SEQ ID NO: 8117 - DNA, 201 bp, Homo sapiens
tcgtctttggtgaggcctgtctctgtgccctacaactgcggtgaggcgtggagcgtccccagggagaaccggagcgggaggatggcccgcgaatgtccccragggggatcctgtgctgcttaggaccacgccgtcccctctccacggccccgaggggtgccagcaacccctttcagcagcagggttaggaactggggccct

SEQ ID NO: 8118 - DNA, 201 bp, Homo sapiens
gatcctgtgctgcttaggaccacgccgtcccctctccacggccccgaggggtgccagcaacccctttcagcagcagggttaggaactggggcccttgcaargccacaggtcaggcggttctggccagaagtccgcagtcctagttcttccctgtcctgtcccacaggccactggttgtcagtagaggtttttgcccctcag

SEQ ID NO: 8119 - DNA, 201 bp, Homo sapiens
agatggcctcagagctcccctgcggggctccctggagctatggagaccccatttatccagagtcaggtcggtgcctgagcttgggcagccccaggtggaargagcccatggtgggaggagcctgtagtgggaggagcctgtagtgggaggagcctatgatgggaggggccgtggtggggggagcccgcggtgggaggagcc

SEQ ID NO: 8120 - DNA, 201 bp, Homo sapiens
ccgggccaggggagccaaggggagtgtggtggagggggtagagtgcgggcacctggtggtctcagggaagcgggcctgggaccggggcgtgtaggaagcakcgaggggctcagaaccacctttccgggttcacgaccagcctctctgggtgttccacctgggcagctgctggagactagaaaacatccctcacacgtcaca

SEQ ID NO: 8121 - DNA, 201 bp, Homo sapiens
ggtgggcccgggccaggggagccaaggggagtgtggtggagggggtagagtgcgggcacctggtggtctcagggaagcgggcctgggaccggggcgtgtakgaagcagcgaggggctcagaaccacctttccgggttcacgaccagcctctctgggtgttccacctgggcagctgctggagactagaaaacatccctcaca

SEQ ID NO: 8122 - DNA, 201 bp, Homo sapiens
gctccgcttcagaggcagggcaagtgggcgcggtcctggggcggcggcgggggccgggagaggagggctgggggtctcgagaaggtaaggggcaggcagakcggccggggaggtgggcccgggccaggggagccaaggggagtgtggtggagggggtagagtgcgggcacctggtggtctcagggaagcgggcctgggacc

SEQ ID NO: 8123 - DNA, 201 bp, Homo sapiens
ccgggccgcagcgtcacaaaggccgctggtccccagggcaacccgcggagtgcggagggaggctgggctctgggaagtccgcgcgcggctccgcttcagakgcagggcaagtgggcgcggtcctggggcggcggcgggggccgggagaggagggctgggggtctcgagaaggtaaggggcaggcagagcggccggggaggt

SEQ ID NO: 8124 - DNA, 201 bp, Homo sapiens
ccccgggccgcagcgtcacaaaggccgctggtccccagggcaacccgcggagtgcggagggaggctgggctctgggaagtccgcgcgcggctccgcttcakaggcagggcaagtgggcgcggtcctggggcggcggcgggggccgggagaggagggctgggggtctcgagaaggtaaggggcaggcagagcggccggggag

SEQ ID NO: 8125 - DNA, 201 bp, Homo sapiens
caccagggacaggatcccgggtccacagcgagggcccacagcgtgggaggagggctgctcctccgggcccaggcctgggcgccctcctcccatgctgaccrgccagctggcctcgtctttggtgaggcctgtctctgtgccctacaactgcggtgaggcgtggagcgtccccagggagaaccggagcgggaggatggcccg

SEQ ID NO: 8126 - DNA, 201 bp, Homo sapiens; identical to SEQ ID NO: 930

SEQ ID NO: 8127 - DNA, 201 bp, Homo sapiens
tgctgtggaaatgcccaagatctgagggcaggagaccattctccagtgacagcctcttgggaggttgaggccccagccccttatctcttcaaggctgattyactaataccccagcaccacagaggggagagggactctgtcctcctaaacactaaagtcaagtccaaaagcccccactggaacacagggcctacccggttc

SEQ ID NO: 8128 - DNA, 201 bp, Homo sapiens; identical to SEQ ID NO: 926

SEQ ID NO: 8129 - DNA, 201 bp, Homo sapiens; identical to SEQ ID NO: 935

SEQ ID NO: 8130 - DNA, 201 bp, Homo sapiens; identical to SEQ ID NO: 932

SEQ ID NO: 8131 - DNA, 201 bp, Homo sapiens; identical to SEQ ID NO: 931

SEQ ID NO: 8132 - DNA, 201 bp, Homo sapiens; identical to SEQ ID NO: 918

SEQ ID NO: 8133 - DNA, 201 bp, Homo sapiens; identical to SEQ ID NO: 920

SEQ ID NO: 8134 - DNA, 201 bp, Homo sapiens
aaggggcgtgcaagatggacgccatgaggggctacgcggccaaagtggaggagctgacgaagaaggaagtggggggcgtggagcgcgaacaaaggggcgtscaagatggacgccatgaggggctacgcggccaaagtggaggagctgacgaagaaggaagtggggggcgtggagcgcgaacaaaggggcgtccaagatgga

SEQ ID NO: 8135 - DNA, 201 bp, Homo sapiens
ggaagtggggggcgtggagcgcgaacaaaggggcgtgcaagatggacgccatgaggggctacgcggccaaagtggaggagctgacgaagaaggaagtgggrggcgtggagcgcgaacaaaggggcgtccaagatggacgccatgaggggctacgcggccaaagtggaggagctgacgaagaaggaagtggggggcgtggag

SEQ ID NO: 8136 - DNA, 201 bp, Homo sapiens; identical to SEQ ID NO: 928

SEQ ID NO: 8137 - DNA, 201 bp, Homo sapiens; identical to SEQ ID NO: 921

SEQ ID NO: 8138 - DNA, 201 bp, Homo sapiens; identical to SEQ ID NO: 929

SEQ ID NO: 8139 - DNA, 201 bp, Homo sapiens; identical to SEQ ID NO: 920

SEQ ID NO: 8140 - DNA, 201 bp, Homo sapiens; identical to SEQ ID NO: 922

SEQ ID NO: 8141 - DNA, 201 bp, Homo sapiens
acgcggccaaagtggaggagctgacgaagaaggaagtggggggcgtggagcgcgaacaaaggggcgtccaagatggacgccatgaggggctacgcggccaragtggaggagctgacgaagaaggaagtggggggcgtggagcgcgaacaaaggggcgtccaagatggacgccatgaggggctacgcggccaaagtggagga

SEQ ID NO: 8142 - DNA, 201 bp, Homo sapiens; identical to SEQ ID NO: 919

SEQ ID NO: 8143 - DNA, 201 bp, Homo sapiens; identical to SEQ ID NO: 933

SEQ ID NO: 8144 - DNA, 201 bp, Homo sapiens
aggcttccactcccacccgcccagctcgcgccacatacagtccctcaacgcgctcctgccgcgccgccccctccagacagcagcgttccggatcctagacrctttttgacggctggtcctccccagaaaatgcgccgtgtgagcccaaacatggtggggtttacgctggaccccgagcttgcaatctgtgcttgacaaaac

SEQ ID NO: 8145 - DNA, 201 bp, Homo sapiens
tccccagtattgctctccgaaagtcccctgcaatccctccttggcttccctcttcctcctcctcttgttattacctgtttcctaatggccctgatcctgtytgcttcttctccttccgagattttttgcaggggggaccagaatctccccagttgtgaggagagacgcctccattgaaggaagtagaagagaccatgcctg

SEQ ID NO: 8146 - DNA, 201 bp, Homo sapiens
caatgaaagagaacaaattgtcagaggaaacacgccctccccttcttaccttgcaagtaccaggccgaggaggctgtgaatggggggtttgggacagccgrgctggagaagggatgcagagggagctggtcaccaggccatggctgggagagtccaccctcgtggaggaatcagcaactggggccaaggaagccaaggggg

SEQ ID NO: 8147 - DNA, 201 bp, Homo sapiens
atattcagacagagcagctgaaacagccaatgaaagagaacaaattgtcagaggaaacacgccctccccttcttaccttgcaagtaccaggccgaggaggmtgtgaatggggggtttgggacagccgggctggagaagggatgcagagggagctggtcaccaggccatggctgggagagtccaccctcgtggaggaatcag

SEQ ID NO: 8148 - DNA, 201 bp, Homo sapiens
ggtttcagtaacatccagccctgaccaacactgtcttcaccacctgatttcaataaccattagttctatatgctttttggggcccttcaagtggtgtgggsggggggcaaaccacccccacaccttaagttgccaccttctgctccacccctcacgtcgatttccggtctttctgttgcatttcccccctatttcttagag

SEQ ID NO: 8149 - DNA, 201 bp, Homo sapiens
tgaagggactagaagagtaaaaaccctagaaaggactagagagatgccccatccgcctcatacctgacatataagggtcactgagaggcatcccaccaacmccctacctggcctatagtcatctgtgaggtggcagccaaagttgtagatgagatcgaggtgacgtcgctcctgtaacctgatgcccacatctcggaaggc

SEQ ID NO: 8150 - DNA, 201 bp, Homo sapiens
cccatcccttcacctcacacattttctgaactccttgggtttcagtaacatccagccctgaccaacactgtcttcaccacctgatttcaataaccattagytctatatgctttttggggcccttcaagtggtgtggggggggggcaaaccacccccacaccttaagttgccaccttctgctccacccctcacgtcgatttc

SEQ ID NO: 8151 - DNA, 201 bp, Homo sapiens
tttcccattcttctcatgcactgacctttgcctttccacatagctagaaacagaaacataaatatgtggaggggtacgggaagactgaggctggagggggrcagtccagtctctcccagcagactcagttccccagtattgctctccgaaagtcccctgcaatccctccttggcttccctcttcctcctcctcttgttatt

SEQ ID NO: 8152 - DNA, 201 bp, Homo sapiens
gcttttttttttttttaaagaaacaccaccaaaaggggattagcttagtccatcccttcctcagtcatctgcttcccaccttcctccaaatgttatcccaraacattctggaggcagggagaaggggaggcagctaatcagagtctgagagcacgatgatctcttctggatcgcattgtgtggccacacttgtctgcaggg

SEQ ID NO: 8153 - DNA, 201 bp, Homo sapiens
aggaggcttcgggggtgtctgcagagtgggaagaggtgccttggagccgagctcttctcttttttctctcgccctcctcacttttgtcttgcaacattgcrtatttggagatgacctcatccagccgactcatggccaaactccggttttcccgaaggcgccgggccaacacaggatctgatagtgcagggtcaacgccta

SEQ ID NO: 8154 - DNA, 201 bp, Homo sapiens
cccctgggatgccattccactagggccctgggagacaaagaagtttctctaaggaatcccttgccccagagggtttggttcttgctttccttctcatgctmccccatcagtcaacctggactccctggtggccagtgcaggggaaggacaatgtctctctgaaggctgtaccccatccacacctcaccagaatccaaggag

SEQ ID NO: 8155 - DNA, 201 bp, Homo sapiens
gtccggccggtccgctagatgcgcttcccgccaaatccccctcccccagttcagcccccggccgctccactccctttcagggacaggaaggtaccacagcwttcccctcagactcagcgcccagctctccccaatacctctccctctatatccccgcccccgcctctgatccccgcaccgtccggcccccacctcagaaac

SEQ ID NO: 8156 - DNA, 201 bp, Homo sapiens
ggctttaggttgaagatattttacccaagtcccctccctttcaccccaccctaattttccccattctctcggtgacccgtaactgatcaaaagtccccccrcaccgcgctacgctctcgcgattcctcttagatcccaaccgtgggtccggccggtccgctagatgcgcttcccgccaaatccccctcccccagttcagcc

SEQ ID NO: 8157 - DNA, 201 bp, Homo sapiens
cctatcctgaatgatcaccccaactcctagactctctgaggtgaaagaggttccctcccaacagtccgttctcttttctcctccttgaattatctccatakttcaccctccgatgagtctcctcaaactggggctttaggttgaagatattttacccaagtcccctccctttcaccccaccctaattttccccattctctc

SEQ ID NO: 8158 - DNA, 201 bp, Homo sapiens
atatgctttttggggcccttcaagtggtgtggggggggggcaaaccacccccacaccttaagttgccaccttctgctccacccctcacgtcgatttccggyctttctgttgcatttcccccctatttcttagagttggcaagttgattcttcctcccacactgcaccccaaatcgtcctgacacccccttgcacagacaac

SEQ ID NO: 8159 - DNA, 201 bp, Homo sapiens
gggccctggctgagcagctgcttcatcttcgtcatcatcatccagcacgatgatgctgttagcggtggccataggggatcaaatcccccggagggaggaartggtggggatttcagaattcctgctggaaggggatggggcctcagaatgagcccctccagcatagccccatcccttcacctcacacattttctgaactcc

SEQ ID NO: 8160 - DNA, 201 bp, Homo sapiens
gtgtctgcagagtgggaagaggtgccttggagccgagctcttctcttttttctctcgccctcctcacttttgtcttgcaacattgcatatttggagatgayctcatccagccgactcatggccaaactccggttttcccgaaggcgccgggccaacacaggatctgatagtgcagggtcaacgcctacgtgggaagacata

SEQ ID NO: 8161 - DNA, 201 bp, Homo sapiens
ctcccaacagtccgttctcttttctcctccttgaattatctccatatttcaccctccgatgagtctcctcaaactggggctttaggttgaagatattttamccaagtcccctccctttcaccccaccctaattttccccattctctcggtgacccgtaactgatcaaaagtccccccgcaccgcgctacgctctcgcgatt

SEQ ID NO: 8162 - DNA, 201 bp, Homo sapiens
aaacaggaggatttagaggataaaatgggtgggaaaaaggaagagacaggatgtggcacgtggaatattcagacagagcagctgaaacagccaatgaaagmgaacaaattgtcagaggaaacacgccctccccttcttaccttgcaagtaccaggccgaggaggctgtgaatggggggtttgggacagccgggctggagaa

SEQ ID NO: 8163 - DNA, 201 bp, Homo sapiens
ggccacacttgtctgcagggaagtgagagacaaagagtcaaagagatctggagtacaggagaaaagaaacaggaggatttagaggataaaatgggtgggaraaaggaagagacaggatgtggcacgtggaatattcagacagagcagctgaaacagccaatgaaagagaacaaattgtcagaggaaacacgccctcccctt

SEQ ID NO: 8164 - DNA, 201 bp, Homo sapiens
ccttgagaacagtgcagagctcattgatgtagacatagagcttggctggccggctccgggcccgagacaggaccctagagaggatgttgcagaactccgcygaggccaaaaacagagagtgggcacgttgctgccggttatagaggaatgggaccacctcagggtggtctgctgtctgcatcttacaaagttcaaggaact

SEQ ID NO: 8165 - DNA, 201 bp, Homo sapiens
tttttttttttttaaagaaacaccaccaaaaggggattagcttagtccatcccttcctcagtcatctgcttcccaccttcctccaaatgttatcccagaamattctggaggcagggagaaggggaggcagctaatcagagtctgagagcacgatgatctcttctggatcgcattgtgtggccacacttgtctgcagggaag

SEQ ID NO: 8166 - DNA, 201 bp, Homo sapiens
caccaggccatggctgggagagtccaccctcgtggaggaatcagcaactggggccaaggaagccaagggggaaggtgggctgggcagggtacatatctttytcccattcttctcatgcactgacctttgcctttccacatagctagaaacagaaacataaatatgtggaggggtacgggaagactgaggctggaggggggc

SEQ ID NO: 8167 - DNA, 201 bp, Homo sapiens
accccgtctctactaaaaatacaaaattagcctggtgtggtggcacatgcctgtaatcccagctactcgggagaccgaggcagtagaattgcttgaacccrggaagcagaggttgcggtgagccgagattgtgccattgcactccagcctgggcaataagagggaaaccccgtttcaaaaaaaaaaaaaaaaatcccaaat

SEQ ID NO: 8168 - DNA, 201 bp, Homo sapiens
ccccaactcactgtacacagcaagctccagggtgacctgtccttgcaggtatggcaggtgtatggtggccagataggtgccctcctgaaagggttgaactstaggcagccagaaggtcccatttccggtccatgggccccatggctcatcatcatcccaagcagcaaatgccacggccccttcttgggctgctggcatctg

SEQ ID NO: 8169 - DNA, 201 bp, Homo sapiens
cccatgtcaaagcccctcaaatttccaggaaacttctagcctcccattacccctctaactcccaggaacctctttctatctctacttacttgcccaggcaycctcttatccatcatccctccccctattacggtccccacaatccagtgcccaccctctacccctggagacctctgtcccccaactcactgtacacagcaa

SEQ ID NO: 8170 - DNA, 201 bp, Homo sapiens
tcccaggttcaagtgattctcctgcctcggcctgccaagtagctgagattacaggcatgcaccaccatgctcaactaattttttgtatttttagtagagayggggtttcaccatgttggccaggctggtctcaaactcctgaccttaggtgatccacctgccttgggctcccaaactgctgggactataggtgtgagccac

SEQ ID NO: 8171 - DNA, 201 bp, Homo sapiens
gggcgcctataatcccagccactggggaggctgaggcagagaactacttgaacccgggaagcggaggttgcagtgagccgagatcgcgccactgcactccmgcctgggcgacagagcgagactcgtctcaaaaaagaaaatcaaatacaatgaaaagaaaaatacaacataccaaagtttgtgggacaccacttaggtggg

SEQ ID NO: 8172 - DNA, 201 bp, Homo sapiens
catgccaccacacccgggtaatttttgtacttttagtagagacaaggtttccccatatcggtcaaactggtctcgaactcctgacctcaggtgatctgccsgcctcggcctcccaaagtgctgggattacaggcgtgagccaccgtgcctggctgcatattttttagaagatacaatgatactctgttttataaccataac

SEQ ID NO: 8173 - DNA, 201 bp, Homo sapiens; identical to SEQ ID NO: 7868

SEQ ID NO: 8174 - DNA, 201 bp, Homo sapiens; identical to SEQ ID NO: 7869

SEQ ID NO: 8175 - DNA, 201 bp, Homo sapiens
ccccggaataccccgcctccgctgccaggagggagagctcccagatatccaggtcagactctcctcattcttgaattatctgcacagtccctcccacgtcycagcctagaaaagcttctgactcctgggcctcaaactgcaatgcacctttcagtgcaataggagctatccaatctccagccgcgtccatccgcccactcg

SEQ ID NO: 8176 - DNA, 201 bp, Homo sapiens
cctgagtagctaggactacaggcgcccgccactatgcccaactaatttttttgtatttttagtagagacggggtttcaccgtgttagccaggatggtctcsatctcctgacctcgtgatctgcccatctcggcctcccaaagtgctgggattacaggcttgagccaccgcgcctggccctaaattttttaaaaaagtggta

SEQ ID NO: 8177 - DNA, 201 bp, Homo sapiens
ctctactaaaaatacaaaaaaaaaaaaaaaaaaaattagcggggcgtggttgtgggtgcctgtgatcccatcaacttgggaggctgaggcaggagaattgyttgaacccaggaggcagaggttgcagtgagccaagatcaccccattgcactccagcatgggtgacaagagtgaaactccgtctcaaaaaataaatatgta

SEQ ID NO: 8178 - DNA, 201 bp, Homo sapiens
cataaagcgagaccaccggctgatctggacccttagaatctacccacccttctccacctcccctccccagctacctgttgccatggtgatgagaacaggckcctgctgaggctctggctgtggtcgcaagaggctggagaggctgaggactgggctggatatgctgaccatcagccaagccccatccagggcccgcgggca

SEQ ID NO: 8179 - DNA, 201 bp, Homo sapiens
catcggaatggtggcgcagggccgagagccacctctgcccctcggccttctgagagcggccccctgggccaccccggagttcccactccacctccaggccyccagaagggtagaagtgggacacaaggcagagcaattccgggggtgcctcccctggggcggcccgtgcaagggttgctggcatcagggacactttggggg

SEQ ID NO: 8180 - DNA, 201 bp, Homo sapiens
ggaaatccccgctctggttaggtgaaggtgcctgggggaccggtgtttccccactggccaggcagggacccgggtagatcctctccagttctcaccaggayaccccagccttaccgcgccctcctggactacccagcagccccgagttcgagccctccccaaccccaggccctcccccgccccccaactcctgtgtgtgct

SEQ ID NO: 8181 - DNA, 201 bp, Homo sapiens
cctctagttcttgggcgatgagtcgcggggttcgctcacccaaagccacagcgaggagcagagacagggacttcatggcgctgcgacctcctcagccatgwagcctcctcttcctcctttcactttcactttcctccaaagggcggcatgaggggcggtggaaatccccgctctggttaggtgaaggtgcctgggggaccg

SEQ ID NO: 8182 - DNA, 201 bp, Homo sapiens
ccctctagttcttgggcgatgagtcgcggggttcgctcacccaaagccacagcgaggagcagagacagggacttcatggcgctgcgacctcctcagccatkaagcctcctcttcctcctttcactttcactttcctccaaagggcggcatgaggggcggtggaaatccccgctctggttaggtgaaggtgcctgggggacc

SEQ ID NO: 8183 - DNA, 201 bp, Homo sapiens
ggcgcaggtggggatagagtgctgggttttgaaagagtgacccgcaaagctgagggtgcagagcaagacacagatctgggaagagcagagaaaaaacgctsctgcttctgaacccctcccacctcgcatcacctgacaagtctctcaaggtctggtgtcgggaaaccccacctcttcaaagccccgcccttcgaaacacca

SEQ ID NO: 8184 - DNA, 201 bp, Homo sapiens
ggagagatttcatttctaattttacatcagtacaacagctttcattttcttaaatccctgatcaagcagaaatgcttgaaaagaaagagcacagcaggccrggcgtggtggctcatgcctgtaatcccagcactttggaaggccaaggtgggtggatcaccttaggtcaggagttcaagaccatcctggccaacatggtga

SEQ ID NO: 8185 - DNA, 201 bp, Homo sapiens
tttacattgtctttcccattttctcccaaacatctatcaagcttgtccaacctccagcccagggaccacatgcagccaaggacggcttggaatacagcccracacaaattcataaactttcttaaaacattatgagattttttcacattttttttttttagcttatcagccatcgttagtgttcgtatattttatgcatgg

SEQ ID NO: 8186 - DNA, 201 bp, Homo sapiens
aaagtgactacaagtctgatcccatcacctacctgtttaaaaatcccaaatatgggccagacgcagtggttcatgcctataatcccagcactttgggaggmcgaggcgggtggatcacctgagttcgggagtttgaaaccagcctgaccaacatggtgaaaccccgtctctactaaaaatacaaaattagcctggtgtggt

SEQ ID NO: 8187 - DNA, 201 bp, Homo sapiens
ctagcctcccattacccctctaactcccaggaacctctttctatctctacttacttgcccaggcaccctcttatccatcatccctccccctattacggtcmccacaatccagtgcccaccctctacccctggagacctctgtcccccaactcactgtacacagcaagctccagggtgacctgtccttgcaggtatggcagg

SEQ ID NO: 8188 - DNA, 201 bp, Homo sapiens
tagggaaatcagtccatactgtcctccctaagagaccctcagtttgcctgctggcttcctcagaactaaagaaggttaggtttcttctcctgaaatagggwacccactgtctctccattggtgcgtcacagaaatacccatgtcaaagcccctcaaatttccaggaaacttctagcctcccattacccctctaactcccag

SEQ ID NO: 8189 - DNA, 201 bp, Homo sapiens; identical to SEQ ID NO: 7908

SEQ ID NO: 8190 - DNA, 201 bp, Homo sapiens
cagccatgaagcctcctcttcctcctttcactttcactttcctccaaagggcggcatgaggggcggtggaaatccccgctctggttaggtgaaggtgcctsggggaccggtgtttccccactggccaggcagggacccgggtagatcctctccagttctcaccaggacaccccagccttaccgcgccctcctggactaccc

SEQ ID NO: 8191 - DNA, 201 bp, Homo sapiens
agtgtggtgcgggggcgccccggggataccgcctgaaggcagcctggagggcgcccgcggggtctgagtgtagagaaggaagttgcagctgtagagtcacygccgggaaaggggctggaagggcagcgttcggggaacttcaaatgcacagactaccccgtagtgagactcactttacaaaggggaagctgaggcctgagg

SEQ ID NO: 8192 - DNA, 201 bp, Homo sapiens
cgtgcaagggttgctggcatcagggacactttggggggttctggggaaagaggacgaaatgagcatagggaaatcagtccatactgtcctccctaagagaycctcagtttgcctgctggcttcctcagaactaaagaaggttaggtttcttctcctgaaatagggaacccactgtctctccattggtgcgtcacagaaata

SEQ ID NO: 8193 - DNA, 201 bp, Homo sapiens
ccaacctcaggtcatggtcagggtagggctgacacttaccagcccagcccagtgccttgaagagcccaagcagaagaaaggcagacaggaaaaggcctacrctgtcctcaagggagggccctgaaagacctggcaggcagaaggggtgagagtgagctcctgtcttcctgggtgctggctcagattccgcagagctcccag

SEQ ID NO: 8194 - DNA, 201 bp, Homo sapiens
tcagcccaggagttgcagccaggagcagatgtcccttacccaggtgctggcgtcgccactctagcccaaagggagggggacccggagccagagatgaggcrgcctcggaggtggggggcatgtaggcaaagctcaagtccagcagagcatcttgtcccagtctcactcgaggggcaggggtgtgggtgaggacagtcagta

SEQ ID NO: 8195 - DNA, 201 bp, Homo sapiens
tcacacctgtaatcccagcactttgggaggccaaggcggaaagatcacgaggtcaggagatcgagaccatcctggctaacacggtgaaaccccgtctctamtaaaaatacaaaaaattggccgggtgtggttgcgggtgcctgtagtcccagctacttgggaggctgaggcaggagaatggcacgaacctcggaggtggag

SEQ ID NO: 8196 - DNA, 201 bp, Homo sapiens
aaggattttaatatattgttaaattctagtttttttttgtttttgtttttgtttttgagacggagtctcgctctgtcgcccaggctggagtgcagtggcgsgatctcggctcactgcaagctccgcctcccgggttcacgccattctcctgcctcagcctcccgcgtagctgggactacaggcgcccgccaccacgcccgg

SEQ ID NO: 8197 - DNA, 201 bp, Homo sapiens
ctcctgggtttaagcgattcttctgcctcagcctcctgagtagctgggattacaggcacacgccaccatggatggctaatttttgtatttttagtagagayggggtttcaccatgttggccaggctggactcaaactcctgtcttcaagtgatccacccgcctcagcctcccaaagtgctgggattacaggagtgagccac

SEQ ID NO: 8198 - DNA, 201 bp, Homo sapiens
ttttaatgtgatgattctcattaaagaggtagtatggtgtagtgtttaaaagtacgggttctggccgggcgcggtggctcacgcctgtaatcccagcactytgggaggccgaggcgggagaatcacgaggtcaagagtttgagaccagcctgaccaacatggtgaaaccccatctctactaaaaatacaaaaattagctgg

SEQ ID NO: 8199 - DNA, 201 bp, Homo sapiens
tgggacatttgttcaataagtaaaacaataaacagataaatttcagaagtagggccgggcgcggtggctcacgcctgtaatcccagcactttgggaggccsaggcgggcggatcacgaggtcaggagatcaagaccatccttgctaacacggtgaaacctcacctctaccaaaaatacaaaaaattagccaggcttggtgg

SEQ ID NO: 8200 - DNA, 201 bp, Homo sapiens; identical to SEQ ID NO: 7940

SEQ ID NO: 8201 - DNA, 201 bp, Homo sapiens
gaactcctgacctcaggtgatccgccctcctcagcctcccaaagtgctaggattacaggcgtgaaccaacgcacctggccaagactgtaatttctttttcttttttttttgttgttgagacgaagttttccttttgtcacccaggctggagtgcaatggtgtgatctcagctcactgcaacctctgcctcccaggttcaag

SEQ ID NO: 8202 - DNA, 201 bp, Homo sapiens
aaaatacaaaattagcctggtgtggtggcacatgcctgtaatcccagctactcgggagaccgaggcagtagaattgcttgaacccgggaagcagaggttgyggtgagccgagattgtgccattgcactccagcctgggcaataagagggaaaccccgtttcaaaaaaaaaaaaaaaaatcccaaatacggccaggcgtggt

SEQ ID NO: 8203 - DNA, 201 bp, Homo sapiens
gacctttgcctatcttttaaaagaatcaagtaaaataacaggctttttccgggcatggtggctaacacatgtaatcccagcactttgggaggctgaggcgrgtggattacctgaggtcaggagttcgagagcagcctggccaacatggtgaaaccccatctctactaaaaatacaaaaaaaaaaaaaaaaaaaattagcgg

SEQ ID NO: 8204 - DNA, 201 bp, Homo sapiens
aactcaggaggcagaagttgaaatgagcagagatcacaccattgcactccagcctgggcaacagggtgagactctgtctcaaaaaaaaaaaaaaaaaaaamaagtatatttggggccaggcagctcacacgtgtaatcccagcagtttcggaggccaaggtgggcagatcaattgagcccaggagtccaagaccagcctgg

SEQ ID NO: 8205 - DNA, 201 bp, Homo sapiens
ccacctcttcaaagccccgcccttcgaaacaccagaaagtaacccccctgcccggccctgctttccccctaccccctgccaagctgcagttttttttttgttttttttttttaactgggtgagggctagaaggagcggtagagattgattcattctagccaaaccacctctcttaacaaaaaaaggaaactgaaccccgat

SEQ ID NO: 8206 - DNA, 201 bp, Homo sapiens
ccataaagcgagaccaccggctgatctggacccttagaatctacccacccttctccacctcccctccccagctacctgttgccatggtgatgagaacaggstcctgctgaggctctggctgtggtcgcaagaggctggagaggctgaggactgggctggatatgctgaccatcagccaagccccatccagggcccgcgggc

SEQ ID NO: 8207 - DNA, 201 bp, Homo sapiens
cacagtgtgtccatatgatgggaggcaaggacagaggcagaggggacagcaagggagagaaatgaaaatgatacagtgtgcagctgggcgcggtggctcasgcctgtaatcccagcactttgggaggctgaggtgggcagatcacaaagtcaggagatcgagaccatcctgaccaacatggtgaaaccccgtctctactaa

SEQ ID NO: 8208 - DNA, 201 bp, Homo sapiens
atggggtttcaccatgttagccaggatggtcttggtctcctgacctagtaatccacctgcctcggcctcccaaagtgctgggattacaggcgtgagccacygcgcccggcctccttaggtttgtagacattaattgggccataatgcttacttgggtagagaagttctttgccatccctcctctgctttggaaaacacagc

SEQ ID NO: 8209 - DNA, 201 bp, Homo sapiens
ctggttcaagcgattcttctgtctcagcctcccatgcagctgggattataggtgcgcaccaccacacctggctaattttttgtatttttagtagagacggsgtttcaccatgttggccaggctggtctcaaacttctgacctcaaatgatccatctgccttggcctccaaaagtcctgggatgacaaatgtgagccactgc

SEQ ID NO: 8210 - DNA, 201 bp, Homo sapiens
ggtggctcacacctgtaatctcaacactttgggaggccaaggcaggcagattacctgatgtcgggatttcaagaccagcctggccaacatggtgaaacccygtctctactaaaaatacaaaaattagctgggcatggtggtgggagactgtaatcccagctacttgggaggctgcgggaggagaatcccttgaatctggga

SEQ ID NO: 8211 - DNA, 201 bp, Homo sapiens
actcgagcccacctgtttgcggaccacagagcggcagcacatccctacacggggctgtcaggcaaggtcaacgcgctagagtgcaagagcctttgctttgmggattgccgcagcgccgggtgtgggcgcaggtggggatagagtgctgggttttgaaagagtgacccgcaaagctgagggtgcagagcaagacacagatct

SEQ ID NO: 8212 - DNA, 201 bp, Homo sapiens
gcgtccacaaccgtgcccagctaatttttgtatttttggtagagatggggtttcaccatgttgcccaggctggtcttgaactcccgacctcaggtgatccrcctgctttggtctcccaaagtgctgggattacaggcatgagccaccacgcctggcctctagctctgcttcttacacactgtgtgtccttgggcaaattat

SEQ ID NO: 8213 - DNA, 201 bp, Homo sapiens
gtgtataggaaacataaatgatttctgtgtttagatttgggtctgatcccaaagatattaaatatatgcaaatattccaaagtctgaaaaaatccaacatmcaaaaacacttctgacccaagcatttcagataagggaccagaattattagattaaataaggtatattattaagttaattttacctgtttctgcttatttt

SEQ ID NO: 8214 - DNA, 201 bp, Homo sapiens
aaggtatattattaagttaattttacctgtttctgcttatttttttaatgtgagtactagagtatttaaatttacatatgtggcttgcattatctttctaytggacagcactgcctaagtaactttttaaaatccctacacccaaggaaacatatagattaagtagcatgctcaaagagtcctacagttaggatatagtgc

SEQ ID NO: 8215 - DNA, 201 bp, Homo sapiens; identical to SEQ ID NO: 7941

SEQ ID NO: 8216 - DNA, 201 bp, Homo sapiens
cacgcctggctaatttttttgcatttttagtagagacagggtttcaccatgttggccaggccagtctcaaactcctgacctccaatgatccacccgcctcrgcctcccaaagtgctgggattacaggcgtgagccaccgcgcccggccaaaatctaccattcgaatagtattacatgcttccttccagaaagaaacgggcc

SEQ ID NO: 8217 - DNA, 201 bp, Homo sapiens
tgggcttggtggcacacgcctgtaatcccagctactcaggaggctgaggcaggagaatcgcttgaacccaggaggtggaggttgcagcgagccaagatcgygccactgcactccagcctgggcaacagagcgagactctgtctcaaaaaaaaagtgcttttataagggaagagcgctatggaaacataagatttcgttgtt

SEQ ID NO: 8218 - DNA, 201 bp, Homo sapiens
tatcatggacttgctggttaacttggaaaaatcatttaacctgtattttcctcactagtccaaagatctgacctttgcctatcttttaaaagaatcaagtraaataacaggctttttccgggcatggtggctaacacatgtaatcccagcactttgggaggctgaggcgagtggattacctgaggtcaggagttcgagagc

SEQ ID NO: 8219 - DNA, 201 bp, Homo sapiens; identical to SEQ ID NO: 7950

SEQ ID NO: 8220 - DNA, 201 bp, Homo sapiens; identical to SEQ ID NO: 7952

SEQ ID NO: 8221 - DNA, 201 bp, Homo sapiens
tttgagaccagcctgggcaacatagcaagaccccatctctatttaaaagaaaaaatttaaaaaaataataaacaagacctaaaggttttacagtttaactyttttttttttttttttttttttggagacagggtctcactctgtcacccatcaaaggtgcaatcctcccaacacagcctcccgagtagctgggaccatagg

SEQ ID NO: 8222 - DNA, 201 bp, Homo sapiens
taaacaaacaaacaaaaaaccaaaaaagaccaaagagaataactactaaaggggagacaaatacagtattagaaaatatttaatctggtcaggtgctgtgkctcacgcctgtaatcccagcactttgggaggccgaggcgggcagatcacttgaggtcaggagttcgagaccagctgggcaacatggcgaaaccctgtctc

SEQ ID NO: 8223 - DNA, 201 bp, Homo sapiens
aaattagccaggtgtgggggcaggcacctgtagtcctagctacttgggaggctgaggcagaagaatcacttgaacctgggaggtagaggttgccgtaagcygaaatcatgccactacactccagcctgggcaacagagtgagactccgtctcaaaactaaataaataaataaaataaaaatcccaaatacctaggaagtca

SEQ ID NO: 8224 - DNA, 201 bp, Homo sapiens
ggctaattttttgtatttttagtagagatggggtttcatcatgttggctaagctggtcttgaactcctgacctcaggtgatcctcccgcctcggcctcccraagtgcagggattacaggcatgagccatcgcacccggcctgtaatttcttatattgtttacatgttgcaataatattttggatgtacaggttgagcatcg

SEQ ID NO: 8225 - DNA, 201 bp, Homo sapiens
ggtgcccgccaccatgcccggctaatttttttctatttttagtagaggtggggtttcaccgtgttagccaggatggtctcgatctcctgacctcataatcygcccgcctcggcctcccaaagtgctgggattacaggagtgagccaccgcgcctggtctctctgtgctctcttatcctgaagtatgccgaaaaggagtgca

SEQ ID NO: 8226 - DNA, 201 bp, Homo sapiens
ggactgcagaatccgaggccacttctgacacaacctgaaccactctatctccaagcaccacccttgaggaaccaggcctttcttgattacaggcgaagacwatgattgagccatgactgtcagtcttgtggtgctgtacagaatatttactgactctagaaggttccagctctagcctagacctgagcacagacctctatg

SEQ ID NO: 8227 - DNA, 201 bp, Homo sapiens
tctcctgcttcagcctcccaagtagctgggactacaagcacatgccaccatgcccagatgatttttgtatttttagtagagacggggtttcaccatgttgrccaggctggtcttgaactcctaacctcatgatccacctgtcttggcctcccaaagtgctgggattacaggtgtgagccactgtgcccggccgaatatatt

SEQ ID NO: 8228 - DNA, 201 bp, Homo sapiens
ggggtttcaccatgttggccaggctggtcttgaactcctgacctcaggtgatccgccctcctcagcctcccaaagtgctaggattacaggcgtgaaccaaygcacctggccaagactgtaatttctttttcttttttttttgttgttgagacgaagttttccttttgtcacccaggctggagtgcaatggtgtgatctcag

SEQ ID NO: 8229 - DNA, 201 bp, Homo sapiens
tacagccggacgcggtggctcacgcctgtaatcccagcactttgggaggccgcagcgagcagatcacgaggtcaggagatcgagaccatcctggctaacayggtgaaaccccgtctctactaaaaatacaaaaaaatagccgggtgccctggcgggcgcctatactcccagctacttgggaggctgagccaggagaatggc

SEQ ID NO: 8230 - DNA, 201 bp, Homo sapiens
ttcccagaaatgtctaggtccttcaggtagaagtaatctttttcttcttgtaattatttttatgttctttttaatcctagcttctgaggcctataaggttwaactgttctcatcttcatggaattgttcagtagagtaaaaacagtatgcaatttcacttagtttgtcaaaatccagaaacatacttttgaattgttaaaa

SEQ ID NO: 8231 - DNA, 201 bp, Homo sapiens
agattccgcagagctcccagctcttacctgctacctccagggtgacctcagcgctgcgccccgaggcaggcaggctgggatggtgaattcgacaggcatascgtgccccatgctgctcagtggtgactgggggcggctgcaagtgcccagagaggctgacagagccatcggaatggtggcgcagggccgagagccacctct

SEQ ID NO: 8232 - DNA, 201 bp, Homo sapiens
gcctcagcctcctgagtagctgggactacaggtgcccaccaccaggcctggctaatttttgtatttttagtagaaacggggtttcaccatgttggccaggmtggtctcgaactcctgaccttgtgatccacctgcctcggtctcccaaagtgttgggattaccagtgtgagctactgcacccggccatcaagtgcttatag

SEQ ID NO: 8233 - DNA, 201 bp, Homo sapiens
attctcctgcctcagcctcctgagtagctgggactacaggtgcctgccaccacgcccggctaatttttttgaaattttttagtagagacggggtttcaccrtgttagccaggatggtctcgatctcctgacctcatgatctgcctgcctcagcctcccaaagtgctgggtttacaggcgtgagccactgtgcccggcctga

SEQ ID NO: 8234 - DNA, 201 bp, Homo sapiens
gtggctcacacctgtaatcccaacactttggtagcctgaggcgggtggattacctgaggtcaggagttcaagaccagcctggccaacatggcaaaaccctrtctctactaaaaatacaaaaattagccaggtgtgggggcaggcacctgtagtcctagctacttgggaggctgaggcagaagaatcacttgaacctgggag

SEQ ID NO: 8235 - DNA, 201 bp, Homo sapiens
tcccagtgtggctcagggaagccaaaagattggagacccctgatctaaatactccatgtacatgaaggtcactttcactgctgtttcttcccagaaatgtytaggtccttcaggtagaagtaatctttttcttcttgtaattatttttatgttctttttaatcctagcttctgaggcctataaggttaaactgttctcatc

SEQ ID NO: 8236 - DNA, 201 bp, Homo sapiens
aggctgaggtgggtggatcacctgaggtcaggagttcaagaccagcctggctaacatgaccaaaccctgtctccactaaaaatacaaaaattagctgggcytggtggtgggcgcctgtagtctcagctacttgggaggctgagacaggagaattacttgaactcaggaggcagaagttgaaatgagcagagatcacaccat

SEQ ID NO: 8237 - DNA, 201 bp, Homo sapiens
tggcacatgcctgtggtctcagctactcaggagactgaggcacgaggatcacttgagccacggaggtggaggttgcagtgagctgagatcatgccactgcwctccagcctgcactgcactccagcctgggcgacagagggagaccctgtctcaaataaataaataaataagcatatttgtcaataaacatttaaaaatatt

SEQ ID NO: 8238 - DNA, 201 bp, Homo sapiens
ataaataaataaataaatagcaggcaggcgcagtggctcacgcttgtaatcccagcacttcgggaggcgaggtgggaggatcacctgaagttgggagttcragaccagccttaccaacatggagaaacctcatctctactaaaaatacaaaattagctgggtgtggtggcaggcacctgtaatcccagctactcgggaggc

SEQ ID NO: 8239 - DNA, 201 bp, Homo sapiens
ctctactaaaaatacaaaattagctgggtgtggtggcaggcacctgtaatcccagctactcgggaggctgaggcaggagaattgcttgaaccagggaggcrgaggttccggtgagcgtgagatcacgccattgcactccagcctgggcaacaagagcaaaactctgtctcaaaaataaataaataaataaaataaaaataa

SEQ ID NO: 8240 - DNA, 201 bp, Homo sapiens
aataaataaataaataaaataaaaataaataaatagcacagcaccttgctttgaccccagttgtttgtgaaatacagacaatcttaccacccgggcacttscagggctccctgtctgcatgtccttcactttctactttacattaggattatccgtggcaaatacgcccagaacctcctggagagcagagtctacatcaga

SEQ ID NO: 8241 - DNA, 201 bp, Homo sapiens
tcatctttgtgacccttaagggcacccagggccaccccagagattctgatttaatcggccaagctaagcatgggattgaatcaggtttcagtatattttaraaacctccaacagtgtggactgagaactgctgagtcctaactcattcttggtgctaaaaagtatttattgaatcaatggataaattaacacagtgccatc

SEQ ID NO: 8242 - DNA, 201 bp, Homo sapiens
gaccagcctgggcagaagaaaaagaaaataaaaagtgtaaattgggaggccgaggcaggcagatcacgaggccaggagatcgagaccatcctggctaacamggtgaaaccccgtctctactaaaaatacaaaaaaattagccgggcatggtggcggcacctgtagtcccagctactcgggaggctgaggcaggagaatggc

SEQ ID NO: 8243 - DNA, 201 bp, Homo sapiens
ttacatttaaagaatcattctgggctgggcttggtggctcatgcctataatcccagcactttgggaggccgaggtgggtagatcacgaggtcaggagatcragaccatcctggctaacacggtgaaaccccgtctctactaaaaatacaaaaattagctgggcgtggtggcacatgcctgtagtcgcagctactcgggagg

SEQ ID NO: 8244 - DNA, 201 bp, Homo sapiens
cctgagtagctgggactacaggcgcccgccaccacgcccagataatttttttgtatttttagtagagacggggtttcaccgtgttagccaggatggtctcratctcctgacctcatgatccacctgcctcggcctcccaaagtgctgggattacaggcgtgagccactgggcccggccggtttcgataagttttatgagga

SEQ ID NO: 8245 - DNA, 201 bp, Homo sapiens
gcagtgagccgagatcgcaccattgcaccccagcctgggcgacagagactctgtctcaaaaaaaaagagaaggaaaaaaatcttcaggccatgtgtataasgtgtataggaaacataaatgatttctgtgtttagatttgggtctgatcccaaagatattaaatatatgcaaatattccaaagtctgaaaaaatccaacat

SEQ ID NO: 8246 - DNA, 201 bp, Homo sapiens
gtgagcgtgagatcacgccattgcactccagcctgggcaacaagagcaaaactctgtctcaaaaataaataaataaataaaataaaaataaataaatagcwcagcaccttgctttgaccccagttgtttgtgaaatacagacaatcttaccacccgggcacttccagggctccctgtctgcatgtccttcactttctactt

SEQ ID NO: 8247 - DNA, 201 bp, Homo sapiens
gaaatgcaaatcaaaaccgcaatgagataccatcttacatggtatcttacatagaatggcgatcattaaaaaggaaacaaggccgggcgcggtggctcacrcctgtaatcccagcactttgggaggccgaggcgggcgaatcacgaggtctaaaacggtgaaaccccgtctctactaaaaatacaaaaaattagccgggcg

SEQ ID NO: 8248 - DNA, 201 bp, Homo sapiens; identical to SEQ ID NO: 7971

SEQ ID NO: 8249 - DNA, 201 bp, Homo sapiens; identical to SEQ ID NO: 7972

SEQ ID NO: 8250 - DNA, 201 bp, Homo sapiens
tctcctgaaatagggaacccactgtctctccattggtgcgtcacagaaatacccatgtcaaagcccctcaaatttccaggaaacttctagcctcccattayccctctaactcccaggaacctctttctatctctacttacttgcccaggcaccctcttatccatcatccctccccctattacggtccccacaatccagtgc

SEQ ID NO: 8251 - DNA, 201 bp, Homo sapiens
tctagcctcccattacccctctaactcccaggaacctctttctatctctacttacttgcccaggcaccctcttatccatcatccctccccctattacggtmcccacaatccagtgcccaccctctacccctggagacctctgtcccccaactcactgtacacagcaagctccagggtgacctgtccttgcaggtatggcag

SEQ ID NO: 8252 - DNA, 201 bp, Homo sapiens
cacgcctggctaatttttttgtatttttagtagggacggcgtttcactgtgttagccagatggtctccatctcccgacctcgtgatccacccacctcggcytcccaaagtgctgggattacaggcgtgagccaccgcgcccggccaatttcctttcttaattgcctctgcccacctcttctcttctgcttccatattacag

SEQ ID NO: 8253 - DNA, 100 bp, Homo sapiens
gagccacctctgcccctcggccttctgagagcggccccctgggccacccyggagttcccactccacctccaggcccccagaagggtagaagtgggacaca

SEQ ID NO: 8254 - DNA, 201 bp, Homo sapiens
ccactcgagcccacctgtttgcggaccacagagcggcagcacatccctacacggggctgtcaggcaaggtcaacgcgctagagtgcaagagcctttgcttygcggattgccgcagcgccgggtgtgggcgcaggtggggatagagtgctgggttttgaaagagtgacccgcaaagctgagggtgcagagcaagacacagat

SEQ ID NO: 8255 - DNA, 201 bp, Homo sapiens; identical to SEQ ID NO: 7875

SEQ ID NO: 8256 - DNA, 201 bp, Homo sapiens; identical to SEQ ID NO: 7897

SEQ ID NO: 8257 - DNA, 201 bp, Homo sapiens; identical to SEQ ID NO: 7909

SEQ ID NO: 8258 - DNA, 201 bp, Homo sapiens; identical to SEQ ID NO: 7921

SEQ ID NO: 8259 - DNA, 201 bp, Homo sapiens; identical to SEQ ID NO: 7922

SEQ ID NO: 8260 - DNA, 201 bp, Homo sapiens; identical to SEQ ID NO: 7923

SEQ ID NO: 8261 - DNA, 201 bp, Homo sapiens; identical to SEQ ID NO: 7924

SEQ ID NO: 8262 - DNA, 201 bp, Homo sapiens; identical to SEQ ID NO: 7925

SEQ ID NO: 8263 - DNA, 201 bp, Homo sapiens; identical to SEQ ID NO: 7926

SEQ ID NO: 8264 - DNA, 201 bp, Homo sapiens; identical to SEQ ID NO: 7927

SEQ ID NO: 8265 - DNA, 201 bp, Homo sapiens; identical to SEQ ID NO: 7928

SEQ ID NO: 8266 - DNA, 201 bp, Homo sapiens; identical to SEQ ID NO: 7929

SEQ ID NO: 8267 - DNA, 201 bp, Homo sapiens; identical to SEQ ID NO: 7949

SEQ ID NO: 8268 - DNA, 201 bp, Homo sapiens; identical to SEQ ID NO: 7968

SEQ ID NO: 8269 - DNA, 201 bp, Homo sapiens; identical to SEQ ID NO: 7970

SEQ ID NO: 8270 - DNA, 100 bp, Homo sapiens; identical to SEQ ID NO: 7973

SEQ ID NO: 8271 - DNA, 201 bp, Homo sapiens
atatacaattttgaaggtaaagaccattttatactactatttttattaatatttcctccctccttgtgtaagatcattgctagacatgtagacaataaatktttgctggttaagtttgctgaagttgaagctagccaaatatttaaacagcccatgcctacaatatatattgggtcatttttaaggcctattttcttaagc

SEQ ID NO: 8272 - DNA, 201 bp, Homo sapiens
aaaaaaaggtactggtcaccacaagattttattcatccactggaccacccgctggtgggggtgttttcaaaaaagtgctagcattttcaatcagggcgacratctagagtcccttctggtgcactgttacagaattctgattactgtaggttcaacttttcagtttgtgacaggattagctttaatttattgcaattaatt

SEQ ID NO: 8273 - DNA, 201 bp, Homo sapiens
gattccaaaagtagaggagacagaatcacttatccttgttacactgcttttcttcatctcttgccctttcctttcacatacattttttccctcttctcatyattacctgtctttcaaacactgtattctgcctttgcaacactgagatccaaatacccacaagtggttaacttgtgtcatcacaagatctataaggtgaac

SEQ ID NO: 8274 - DNA, 201 bp, Homo sapiens
aaacatcatttattctgaaggaatatgagagggaaatgcaatcatcagttttaacaaagaaaccaccaatcaagtttctctctggggtatagggatgcaartaagaattttagaagttatgatttggcaaaaataaattttacatagtcatattcttaataaaagtgattaacacacaacagaaattattcataacactgc

SEQ ID NO: 8275 - DNA, 201 bp, Homo sapiens
ctctgcaaccaggatttggtatgttttattagagcaaatttttaacaaaaggtggctttcatttacagaatttaatgtgtgtggggactgtccaacccatrtggactcaagtaaggataaccattaagcttgctaatgtattttcttattttcagtttacatacaaattttttttgtttgcttcacattcataaaaacccc

SEQ ID NO: 8276 - DNA, 201 bp, Homo sapiens
ccaatcatgtatgaaggaaataagggacaatctacacttgcctttcatggatgggaatctggctacatagttccacctaaagtatcttctgtcacaggatrtatctaccagaacaatttcttattatctctaaagtgaattagagacatagcctcctggaaaaaacaaaaaactactctgcaaccaggatttggtatgttt

SEQ ID NO: 8277 - DNA, 201 bp, Homo sapiens
tgtgaataatccctgaggggtttgtcataactgtaaaaaaaaactagaccttgtataagccccccaaaattaaatccaatcatgtatgaaggaaataaggracaatctacacttgcctttcatggatgggaatctggctacatagttccacctaaagtatcttctgtcacaggatatatctaccagaacaatttcttatta

SEQ ID NO: 8278 - DNA, 201 bp, Homo sapiens
acaccaaatacattgtgaaataaggaataaagacataatcaaagatatgcctaacatggggtagactgtactcttgtaacactttaggacctcactgcttrtaactgaaaatatttaaatgtgaataatccctgaggggtttgtcataactgtaaaaaaaaactagaccttgtataagccccccaaaattaaatccaatca

SEQ ID NO: 8279 - DNA, 201 bp, Homo sapiens
ggaaatctatcagaaagaggttgaaaggaactgggaaactgaagtgagactcgtggtcaataggagttaaaaatatttatgtacattcatacatacatatmtgtttgtctaaatgtttaacaatttataaagctgaaaactcatttagttctcccccctcccctacacaccaaatacattgtgaaataaggaataaagaca

SEQ ID NO: 8280 - DNA, 201 bp, Homo sapiens
gaggagtgaaaaggaccatctagtgctccatggcaaacaggttaccaagccatgctctagagctatactgtccaaacggtagccgctagacacgtggctayctaaatttaatcaaaattaaatagcactacaaaaaaagtagtttattggcaccaattacaccagttaagtgaaaaaccaagatttattataatagagata

SEQ ID NO: 8281 - DNA, 201 bp, Homo sapiens
cataataaaatgagataatgcccacctatgtcacccctcaactcagaaagaaatgagttacaaaccctgaatatccaaatagaggaatatagaaaaatttmattgattccaaaagtagaggagacagaatcacttatccttgttacactgcttttcttcatctcttgccctttcctttcacatacattttttccctcttct

SEQ ID NO: 8282 - DNA, 201 bp, Homo sapiens
tcttctttacaatatagccttagatgtacttttttaaattcaacacagacttgaagaaaatgggctaaatgcaaaaaaaaaaaaaaaaaaaaaaaagacaytcacatagaacttacctcttttctgatcatgacatcatttttgtaattgctgttgttggcatatctaagctttcctgtgggaagtggaaaaaaatcaatt

SEQ ID NO: 8283 - DNA, 201 bp, Homo sapiens
ataaactgataggatgccactgaaattatcttggctagcaaactgactatagttctaaaatgagcctctgtaataatgaaaacttcgccaaaatgctttawcatacttactttgactgatttacatcaataagagaacctatttttgatgtggtaaaagatatgtgctcatctccaattacaatttcaagctcctaaaaaa

SEQ ID NO: 8284 - DNA, 201 bp, Homo sapiens
attatcttggctagcaaactgactatagttctaaaatgagcctctgtaataatgaaaacttcgccaaaatgctttaacatacttactttgactgatttacrtcaataagagaacctatttttgatgtggtaaaagatatgtgctcatctccaattacaatttcaagctcctaaaaaatatagcagaaaaatgtagttaata

SEQ ID NO: 8285 - DNA, 201 bp, Homo sapiens
ggttagttctctgaactttctcattcctatggatgcaaacactgtatctaatttaaatggaaactctttcaatctataaattgccttcttctttacaatayagccttagatgtacttttttaaattcaacacagacttgaagaaaatgggctaaatgcaaaaaaaaaaaaaaaaaaaaaaaagacattcacatagaactta

SEQ ID NO: 8286 - DNA, 201 bp, Homo sapiens
atggaaactctttcaatctataaattgccttcttctttacaatatagccttagatgtacttttttaaattcaacacagacttgaagaaaatgggctaaatrcaaaaaaaaaaaaaaaaaaaaaaaagacattcacatagaacttacctcttttctgatcatgacatcatttttgtaattgctgttgttggcatatctaagc

SEQ ID NO: 8287 - DNA, 201 bp, Homo sapiens
ctttcccagcaccgcgtgccgtgggcctcttctcaccgtccggccgaaattcgaactccagaaactcgtgcccaaacttgcccttgtgccctacgtagtascgcaggtagaaatcgctagccacagccatttttgtacccgggaagcccgccgaaaacgcagccaacgtgtcccccggcgccttgcagtgacgtcatcgcg

SEQ ID NO: 8288 - DNA, 201 bp, Homo sapiens
acatggggtagactgtactcttgtaacactttaggacctcactgcttataactgaaaatatttaaatgtgaataatccctgaggggtttgtcataactgtaaaaaaaaactagaccttgtataagccccccaaaattaaatccaatcatgtatgaaggaaataagggacaatctacacttgcctttcatggatgggaatct

SEQ ID NO: 8289 - DNA, 201 bp, Homo sapiens
ttttaaattcaacacagacttgaagaaaatgggctaaatgcaaaaaaaaaaaaaaaaaaaaaaaagacattcacatagaacttacctcttttctgatcatsacatcatttttgtaattgctgttgttggcatatctaagctttcctgtgggaagtggaaaaaaatcaatttataatagcaaaaactgctaaaaaaattaac

SEQ ID NO: 8290 - DNA, 201 bp, Homo sapiens
tgtaatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctc

SEQ ID NO: 8291 - DNA, 201 bp, Homo sapiens
gtaatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcg

SEQ ID NO: 8292 - DNA, 201 bp, Homo sapiens
taatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcgg

SEQ ID NO: 8293 - DNA, 201 bp, Homo sapiens
aatcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcggc

SEQ ID NO: 8294 - DNA, 201 bp, Homo sapiens
atcccaggactgtgggtggctgacgctggtggatcccttgacctcaggggtttgaagccagcctgggcaacatggggaaacccatctctacaaaaaataacataacataacataacataacataacataacataacataacataacataacataattagctgggtgaggtggcgtgggcctgtattcccagcacctcggca

SEQ ID NO: 8295 - DNA, 201 bp, Homo sapiens
tcccaggactgtgggtggctgacgctggtggatcccttgacctcaggggtttgaagccagcctgggcaacatggggaaacccatctctacaaaaaataachtaacataacataacataacataacataacataacataacataacataacataattagctgggtgaggtggcgtgggcctgtattcccagcacctcggcag

SEQ ID NO: 8296 - DNA, 201 bp, Homo sapiens
atttgtcttactcattactgtaccttaaaattttgtatttgcttgttgtccagcacaaaacgtgcattcaaaaaaacccaaaaaatatatatccaaatgarctttcttgttgcaggtaggcaagatcaatgtaacattctctaaggatagcgctgtcagaaaacacactgttgcacactacttgggtagcagtttcacctc

SEQ ID NO: 8297 - DNA, 201 bp, Homo sapiens
aaggtgaactgtaataaatgcaagtatactgaggcaggagaatcgcttgagcctgggaggcagaggttgcagtgagctgagatcaagccactgcactccarcttgggtaacagagcgagactctgtccctaaatcaataaatcaataaatgcaagtgtagttcacgtcaaggttagttctctgaactttctcattcctatg

SEQ ID NO: 8298 - DNA, 201 bp, Homo sapiens
cccagaggtatctgtattcttgctacaagcagatcccaattttagttgcaagttttctagcagccaacagagggagtggggggcgagggggaaagaaacayggtttcttagatataaactatatccttaaaataaagactgctcacgcgcactacccccaagtttaggaccaacaaagaattgctttccagagacataaag

SEQ ID NO: 8299 - DNA, 201 bp, Homo sapiens
ggtatagggatgcaaataagaattttagaagttatgatttggcaaaaataaattttacatagtcatattcttaataaaagtgattaacacacaacagaaaytattcataacactgcattgtgaaaacatcctaacgttggctggggtgactacagagaaagatgtctaaatttagagctatgcactgactccttcactact

SEQ ID NO: 8300 - DNA, 201 bp, Homo sapiens
tccctccttgtgtaagatcattgctagacatgtagacaataaatgtttgctggttaagtttgctgaagttgaagctagccaaatatttaaacagcccatgyctacaatatatattgggtcatttttaaggcctattttcttaagctacatcatgaactagaaagagaatctgcaaaaggcactaagattcctttaaagttt

SEQ ID NO: 8301 - DNA, 201 bp, Homo sapiens
ttaagcttgctaatgtattttcttattttcagtttacatacaaattttttttgtttgcttcacattcataaaaaccccaatactgtaaatgacaaataacycctcccatcccttaattaaatatacaaacagcctgaaaacatacaatttaaattggtttaatcttgaagtgtaatccaataagactgaaaactaaacatt

SEQ ID NO: 8302 - DNA, 201 bp, Homo sapiens
aatgtgtaatattaataaccaccaccactttagcacctactgtatgtcaggccctagtggtagggactttgtactctctgtaatcttgaaaataaccttaytaacctattttacaaatgtgtaatccaaaactcatagagcagaagaaaatacttgttgatatttataaccactaataatgatggtacttatatttgatcc

SEQ ID NO: 8303 - DNA, 201 bp, Homo sapiens
aatttcaagctcctaaaaaatatagcagaaaaatgtagttaatataaaaatctatcccagaggtatctgtattcttgctacaagcagatcccaattttagytgcaagttttctagcagccaacagagggagtggggggcgagggggaaagaaacatggtttcttagatataaactatatccttaaaataaagactgctcac

SEQ ID NO: 8304 - DNA, 201 bp, Homo sapiens
cttctactgagagacaagataataagcctttaatgacataaaaatcaggattacatctgcataataaactgataggatgccactgaaattatcttggctarcaaactgactatagttctaaaatgagcctctgtaataatgaaaacttcgccaaaatgctttaacatacttactttgactgatttacatcaataagagaac

SEQ ID NO: 8305 - DNA, 201 bp, Homo sapiens
tgttggattaaaagtttttggacaatcaatgaaatactctgctaacttctactgagagacaagataataagcctttaatgacataaaaatcaggattacawctgcataataaactgataggatgccactgaaattatcttggctagcaaactgactatagttctaaaatgagcctctgtaataatgaaaacttcgccaaaa

SEQ ID NO: 8306 - DNA, 201 bp, Homo sapiens
atacagctgttggattaaaagtttttggacaatcaatgaaatactctgctaacttctactgagagacaagataataagcctttaatgacataaaaatcagrattacatctgcataataaactgataggatgccactgaaattatcttggctagcaaactgactatagttctaaaatgagcctctgtaataatgaaaacttc

SEQ ID NO: 8307 - DNA, 201 bp, Homo sapiens
taatacaacttgggcattattatatacagctgttggattaaaagtttttggacaatcaatgaaatactctgctaacttctactgagagacaagataataascctttaatgacataaaaatcaggattacatctgcataataaactgataggatgccactgaaattatcttggctagcaaactgactatagttctaaaatga

SEQ ID NO: 8308 - DNA, 201 bp, Homo sapiens
ccatagaagagatgctcagaaatgaaattactaggccaaaggtgaatgaaaaatgtcaacagtttttgatgcatattaccaaactgctttccaaaaaccaytaccaatttataatcccagtagggtatcaatgccacacccttaccaaatgtaggaaaagaaatttgatagtttaaaagcatttggatggtctttgtgaac

SEQ ID NO: 8309 - DNA, 201 bp, Homo sapiens
aatttttaattaatttaataattctctccttgttagacactggggttaatttcctattataaataatacttcaatgagcatcttcatgcataataaagctyttccaatatttaggaatagttccatagaagagatgctcagaaatgaaattactaggccaaaggtgaatgaaaaatgtcaacagtttttgatgcatattac

SEQ ID NO: 8310 - DNA, 201 bp, Homo sapiens
tcttgtaccaaatagtaaaatactcgaaggccttcaggatccctaaaatttaaaaaggtaaaagttactttttcttcctaggataaaacaattctttaaaygcctaaaacaaaacaaatcaaaatctcataacaattaagttaacaaaatttaggagaaaggaaggattttgctgacaactaaaatgaacatacaattaat

SEQ ID NO: 8311 - DNA, 201 bp, Homo sapiens
tttattataatagagatattacagtaaaaaagatgttaagtatagaatctaggtaggggtaggcatataggtgttcactttatagttctcaagagtttttwatgttttatccttttcacgttagaaaaaaattgtttaaatagcaccataaattcagttatacaaggcacacctcaagtaatcagtaggcctcatttggcc

SEQ ID NO: 8312 - DNA, 201 bp, Homo sapiens
catgcataataaagcttttccaatatttaggaatagttccatagaagagatgctcagaaatgaaattactaggccaaaggtgaatgaaaaatgtcaacagwttttgatgcatattaccaaactgctttccaaaaaccattaccaatttataatcccagtagggtatcaatgccacacccttaccaaatgtaggaaaagaaa

SEQ ID NO: 8313 - DNA, 201 bp, Homo sapiens
ctagtttatatttaattttaatccatcatgattgctgtattatctgatgtatgcttccccttatggctagtcagttgcccagacacagctataatgtgcawcaggtactctaaaatgatagaaatgacagtctttgatggcttggcaccaggcacagtggctcatgcctgtaatcccagcaatttgggaggctgagatggg

SEQ ID NO: 8314 - DNA, 201 bp, Homo sapiens
ccacgaggcggaggttgcagtgagccgagatcgcaccactgcactgcagcctggacgacagagcaagactctgtctcaaaaaaaaaaaaaaaaaaaaaaaraaaagaaaagaaacgcgtcttcgggaggctcaatatcaccaatggaagtatgtgtaacagtgtagtggcagatacattgattagaaccactgttctagca

SEQ ID NO: 8315 - DNA, 201 bp, Homo sapiens
ggcggaggttgcagtgagccgagatcgcaccactgcactgcagcctggacgacagagcaagactctgtctcaaaaaaaaaaaaaaaaaaaaaaaaaaaagraaagaaacgcgtcttcgggaggctcaatatcaccaatggaagtatgtgtaacagtgtagtggcagatacattgattagaaccactgttctagcataaaac

SEQ ID NO: 8316 - DNA, 201 bp, Homo sapiens
ggttgcagtgagccgagatcgcaccactgcactgcagcctggacgacagagcaagactctgtctcaaaaaaaaaaaaaaaaaaaaaaaaaaaagaaaagawacgcgtcttcgggaggctcaatatcaccaatggaagtatgtgtaacagtgtagtggcagatacattgattagaaccactgttctagcataaaacttccct

SEQ ID NO: 8317 - DNA, 201 bp, Homo sapiens
acataacataacataacataattagctgggtgaggtggcgtgggcctgtattcccagcacctcggcaggctgaggtgagggatcacttgcactagggaggsggaggttgcagtgagctgagatcgtgccactgcactcagatctgggtgacagagtgagaccttgtttcaaaataataataataattgcaggactgtggtt

SEQ ID NO: 8318 - DNA, 201 bp, Homo sapiens
ccctacgtagtagcgcaggtagaaatcgctagccacagccatttttgtacccgggaagcccgccgaaaacgcagccaacgtgtcccccggcgccttgcagkgacgtcatcgcgcggaataagtgcgtcaccacaggcgcttctcttcctcctgcagtgcagccctagactaaagcgtgaaagccgagtatcgcgtgagagt

SEQ ID NO: 8319 - DNA, 201 bp, Homo sapiens
aggcggaggttgcagtgagctgagatcgtgccactgcactcagatctgggtgacagagtgagaccttgtttcaaaataataataataattgcaggactgtrgttaacgtgagttctgcctgaaatgcttgatactcttctcctttcctaatatacgttccttctctaattttttattcttgctctcacagaacattgtcca

SEQ ID NO: 8320 - DNA, 201 bp, Homo sapiens
catgattgctgtattatctgatgtatgcttccccttatggctagtcagttgcccagacacagctataatgtgcaacaggtactctaaaatgatagaaatgmcagtctttgatggcttggcaccaggcacagtggctcatgcctgtaatcccagcaatttgggaggctgagatgggtggatcacctgaggtcagcagttaga

SEQ ID NO: 8321 - DNA, 201 bp, Homo sapiens
gttagctagtttatatttaattttaatccatcatgattgctgtattatctgatgtatgcttccccttatggctagtcagttgcccagacacagctataatrtgcaacaggtactctaaaatgatagaaatgacagtctttgatggcttggcaccaggcacagtggctcatgcctgtaatcccagcaatttgggaggctgag

SEQ ID NO: 8322 - DNA, 201 bp, Homo sapiens
attttagaattatgactaggaagcatacaaacgatgcttctggatcaaagttgatgagtttgttagctagtttatatttaattttaatccatcatgattgytgtattatctgatgtatgcttccccttatggctagtcagttgcccagacacagctataatgtgcaacaggtactctaaaatgatagaaatgacagtcttt

SEQ ID NO: 8323 - DNA, 201 bp, Homo sapiens
tgggatgaggtgcagacagtacttggaaaaagtctgattatttcaagtggtctctttattaaggaaggaggtaaaaggaacataacctgagcgcaataaawatctagtttcatataaaactagtattatacaaaattcagtttctaatgatcactgtccatcagcaacttacaatcaaataaaagacagatcaaagtataa

SEQ ID NO: 8324 - DNA, 100 bp, Homo sapiens
gggtacaaaaatggctgtggctagcgatttctacctgcgctactacgtarggcacaagggcaagtttgggcacgagtttctggagttcgaatttcggccg

SEQ ID NO: 8325 - DNA, 201 bp, Homo sapiens
aaaccaacctaatgtagatgttcctagtgtgctgtaattactgtatagatttttccctatattgtttatctgcaggcctaaaaccaataattaaaaagctrtatctgtaatgaatcttcaagttaacagacactattgaagacaatcctagctatttatttaatcagaggcctaattatgcagtttatgacacacacagaa

SEQ ID NO: 8326 - DNA, 201 bp, Homo sapiens
cactactaggaggtagcacagaaaaacagaactaagagataaaattaaagagaatttaccaggtgcctattaaatagaaagccaaagaatcaacttagacwcattccaaataaataacgggaaacaaaatagtattatcaatttttaatatttatacacttaaagaatcactaaatacaaacctgtcggccaaccctatca

SEQ ID NO: 8327 - DNA, 201 bp, Homo sapiens
agcgtcgtggccgggggcagggcggcggggtaggttgttcctgaggtgggaggcggtacccgtggctgagaagaaggaggcctgagagcgacatgtccccrgcggctcaggcggagcggcccgtggcgctgtttttctgagtccggggtggcctggcagccggccgaggacgagggtcggcgggggctgcccccgtggtgg

SEQ ID NO: 8328 - DNA, 201 bp, Homo sapiens; identical to SEQ ID NO: 1151

SEQ ID NO: 8329 - DNA, 201 bp, Homo sapiens; identical to SEQ ID NO: 1158

SEQ ID NO: 8330 - DNA, 201 bp, Homo sapiens; identical to SEQ ID NO: 1160

SEQ ID NO: 8331 - DNA, 201 bp, Homo sapiens; identical to SEQ ID NO: 1161

SEQ ID NO: 8332 - DNA, 201 bp, Homo sapiens; identical to SEQ ID NO: 1162

SEQ ID NO: 8333 - DNA, 201 bp, Homo sapiens; identical to SEQ ID NO: 1164

SEQ ID NO: 8334 - DNA, 201 bp, Homo sapiens; identical to SEQ ID NO: 1165

SEQ ID NO: 8335 - DNA, 201 bp, Homo sapiens; identical to SEQ ID NO: 1166

SEQ ID NO: 8336 - DNA, 201 bp, Homo sapiens; identical to SEQ ID NO: 1167

SEQ ID NO: 8337 - DNA, 201 bp, Homo sapiens; identical to SEQ ID NO: 1168

SEQ ID NO: 8338 - DNA, 201 bp, Homo sapiens; identical to SEQ ID NO: 1169

SEQ ID NO: 8339 - DNA, 201 bp, Homo sapiens
ctttccttctgggctgtctccatctgaccctaccccttccatgtcccaccccactcccaccaaaaagtacaaaatcaggatgtttttcactgtccattgckttgtgttttaataaacaatttgcagtgacactctgtgttgggactgagttcgaacttgatctcaaagcgctgaagtgatggggtgggaaaaaggagaccc

SEQ ID NO: 8340 - DNA, 201 bp, Homo sapiens; identical to SEQ ID NO: 1155

SEQ ID NO: 8341 - DNA, 201 bp, Homo sapiens; identical to SEQ ID NO: 1154

SEQ ID NO: 8342 - DNA, 201 bp, Homo sapiens
atggctgggacagtggatggtaggttgtgttctgacctgcttttttgacttgagtggagggatatggttgaggaagcccttgggaggtaattgagctgatsactattttggaaacacttaaagctaaattgtaggggattcagaatcagttggataaggatgaagcataacatggtactagccacaagctttggagtcagg

SEQ ID NO: 8343 - DNA, 201 bp, Homo sapiens
catcaaagaggagggggactacgtgctggtcttgaaatttgcagaggtctactttgcacagtcccagcaaaaggtgaggcctagtcaggctgctgcttgaycagtaggacattgctgctcttggacaatccacgattatggggctagagagtgtgagagtctctccagaaaggcagaacagatgagctctagagaagcatg

SEQ ID NO: 8344 - DNA, 201 bp, Homo sapiens
ggttattagcattgccctggaaatgcctctggctgttctggggtctttgcttttcttttgtgtcttgcctctgatgtgctttctctttgtcttttgtcctyagcctcagactatggcatgaaactgccaatcctgcgttccaaccctgaggaccagatcctgtatcaaactgagcggtacaatgaggagacctttggctac

SEQ ID NO: 8345 - DNA, 201 bp, Homo sapiens
agagcgaaactccgtctccaaaaaacaaaaacaaaaacaaaaaaacaattccccacccatgcacaaaattttctgtgtatccgtaaatcaaatgtagtcgrtgttccagatttgtaatgatcacagtcctcatggaagaaggaaattcttagagctcagttggaagagaaacagcagtctttcagtcttcataggtttgta

SEQ ID NO: 8346 - DNA, 201 bp, Homo sapiens
gtgaccaggagatctgagggtagggtgggagtgacgctagagcaccaaggggggctttacagctgtgttctcatggaggacaggcttctgctcattctggytttcccactcttgtggttcccagttgcagttttccagttagttttattacttccttttcttttgatccattccctaaactgccttgagtggaggcatttg

SEQ ID NO: 8347 - DNA, 201 bp, Homo sapiens
tactggcctcactggagaaagaagtgatccagaagaacagtctagtgaccaggagatctgagggtagggtgggagtgacgctagagcaccaaggggggctytacagctgtgttctcatggaggacaggcttctgctcattctggctttcccactcttgtggttcccagttgcagttttccagttagttttattacttcctt

SEQ ID NO: 8348 - DNA, 201 bp, Homo sapiens
gtcactgctacctctgatttgctcaaagccatgggagttgtttagaattctctacctctactgtcacctaacaggcaggcttcatctgcaggccttccaartagtggaagttcacaggtagaaaatttaggtccctgaatccgtgggttcgctgtctcagcccattcagaacaattctttaggtactggcctcactggaga

SEQ ID NO: 8349 - DNA, 201 bp, Homo sapiens
tcctttcacctggggaaggatttggctttggggaggtaagagcttgaaacatgggatgagagaggagtcactgctacctctgatttgctcaaagccatggsagttgtttagaattctctacctctactgtcacctaacaggcaggcttcatctgcaggccttccaaatagtggaagttcacaggtagaaaatttaggtccc

SEQ ID NO: 8350 - DNA, 201 bp, Homo sapiens
gcatgaaccatcacgcctgaccatgttccagatttgtaacttggtcattttgagttcctcttcactctgactaggaaaagacctggttatttgacctgagrgcacagaattttgcttgagtttagggaaggctatttcctcttcagagaaagatacctgctaaagtcgcaggtcctcgagaaacttgctttacgtctctga

SEQ ID NO: 8351 - DNA, 201 bp, Homo sapiens
aatctgggtaagaattggagcagtattaaggcatggatggggagtgggaggtggcgcttgtcagctgcagtttggaccagcttgttgcaacattgcgcttrccaggttcctgagaaaggcattttgctggctttaggtcgggctgagatgcgcataagcttgcactctcaggaggcagctctctactaaggagtcagtcct

SEQ ID NO: 8352 - DNA, 201 bp, Homo sapiens
ctaggagattgatactgtatgctgggttcagaggctaccaaattggcagtatgccacctccagacaaccaggagacagactcactcttcactttctctcaytctttttctgcgatgcccagatttggctcttgcttttactaaaatagttagttcttcccaagtcgattgcagtgtcctggagtttgttatattaaggagt

SEQ ID NO: 8353 - DNA, 201 bp, Homo sapiens; identical to SEQ ID NO: 1150

SEQ ID NO: 8354 - DNA, 201 bp, Homo sapiens
tctgttgtgcagagaataaagccgagtaagaccacacaggtttagttcccagatactgcccttattcagaaattctggttttaatttgctgatgcaggtgktgtgtgtgtgtgtgtgtgtgtgtgtgtttctttggcttggtcagcagtcagccaagatctgtgtccttgggttattggctcatggttgcagttccttgga

SEQ ID NO: 8355 - DNA, 201 bp, Homo sapiens
ttaagtaatttttgttcacatggttgagttttcttcactgtgggactgagactgccgcagattacgttactgtcagttcctcactttttccacttggcaaraaaaaaaaaaagattcggcctggtgtggtggctcacgcctataatcctagcactttgggaggccgatgcgggcagatcacctgaggttggagttggagac

SEQ ID NO: 8356 - DNA, 201 bp, Homo sapiens; identical to SEQ ID NO: 1152

SEQ ID NO: 8357 - DNA, 201 bp, Homo sapiens; identical to SEQ ID NO: 1163

SEQ ID NO: 8358 - DNA, 201 bp, Homo sapiens; identical to SEQ ID NO: 1157

SEQ ID NO: 8359 - DNA, 201 bp, Homo sapiens; identical to SEQ ID NO: 1153

SEQ ID NO: 8360 - DNA, 201 bp, Homo sapiens; identical to SEQ ID NO: 1156

SEQ ID NO: 8361 - DNA, 201 bp, Homo sapiens
agataccaggccttacattggttacatcgtcctattcagtctgttgtgcagagaataaagccgagtaagaccacacaggtttagttcccagatactgcccytattcagaaattctggttttaatttgctgatgcaggtggtgtgtgtgtgtgtgtgtgtgtgtgtgtttctttggcttggtcagcagtcagccaagatctg

SEQ ID NO: 8362 - DNA, 201 bp, Homo sapiens
acatggaattaaaaatagggcagaacatagctccagaggggaaaaaagttggttggggaccagagcctatcaggttgctaatgctgtaaccttaaggaatrccctttcctgggctgccttcctttcacctggggaaggatttggctttggggaggtaagagcttgaaacatgggatgagagaggagtcactgctacctctg

SEQ ID NO: 8363 - DNA, 201 bp, Homo sapiens
aatctttgtttcttctgttggagggattggaaaacaggtttcagaaggaagttctttgctaggagattgatactgtatgctgggttcagaggctaccaaaytggcagtatgccacctccagacaaccaggagacagactcactcttcactttctctcattctttttctgcgatgcccagatttggctcttgcttttactaa

SEQ ID NO: 8364 - DNA, 201 bp, Homo sapiens
gcctttcacacatgtgagggtcttgggacacagggctgttttgtgaagttctatgtttgtcttggagtttgttgagccctggcatgtagatcacagtagcmtgggttcagctgactcagggctccagtctttagcagcggtaacagcagccaaagccagactttatagcaggaggtcattactatctctatcctggaccct

SEQ ID NO: 8365 - DNA, 201 bp, Homo sapiens
tgttgcccaggctggtcttgaacttctgtcctcaagtgatcttcccaccttggcctcccaaactgctgggattacaggcatgaaccatcacgcctgaccawgttccagatttgtaacttggtcattttgagttcctcttcactctgactaggaaaagacctggttatttgacctgagggcacagaattttgcttgagttta

SEQ ID NO: 8366 - DNA, 201 bp, Homo sapiens
gaaatagaaagaaaaaagtctgaagacaaaagtgcaatgagtttcctcttccattgtctcatcagtccctctgatctcgtggctaatgtcacttacaggamctgttaacagttatgtttatttttttgaggtcttgacctcaaccactgggtctttttgttaatcttttaccttttgccatgtcttctcccttgttgatga

SEQ ID NO: 8367 - DNA, 201 bp, Homo sapiens
ggtgactttttttttctgctgttggtttatctgagtgaatgttcaagtaagtaggtgaggtggagttttgtgagtctgtgggaaggaaggaaattagcatyacacctttcttttatgagcctgtttttgtttacagctttggaactttttgaatgaaaattataaaaaaaacacacaacaactaaagctggaattttattc

SEQ ID NO: 8368 - DNA, 201 bp, Homo sapiens
gataaggatgaagcataacatggtactagccacaagctttggagtcaggtctatgtatatcttgttgctgccatttaatcagatgtttgtcttggatggawgcttttaatttccctataaattgggattaataatggtacctattggtgtaccctgacctttgtagtcatttgggatcacctaaaacttgtccttattctg

SEQ ID NO: 8369 - DNA, 201 bp, Homo sapiens; identical to SEQ ID NO: 1159

SEQ ID NO: 8370 - DNA, 100 bp, Homo sapiens
tgtgaacgaaaggaaggaacatctttctatggctaacaaaaactaaaggrgaagtgaggaaacaggaagaagtatggtgggggctggggtagactcccct

SEQ ID NO: 8371 - DNA, 100 bp, Homo sapiens
gtttccaagcccacccttttcccctgagctcagggttagggatgggcgcyttcctctctggttgtgaacgaaaggaaggaacatctttctatggctaaca

SEQ ID NO: 8372 - DNA, 100 bp, Homo sapiens
aaggaaaccctgactcctggggccatttcctaatggtactgtaagccaarcagctttgcttctgcctctgtttccaagcccacccttttcccctgagctc

SEQ ID NO: 8373 - DNA, 100 bp, Homo sapiens
ggaggccaaaccaactctttgccagcagccacaacatgcattgacagcgkcacagtgagatataactgatgggctttgaacctggttggccggggaagct

SEQ ID NO: 8374 - DNA, 100 bp, Homo sapiens
caggtaataagatggcatttccctgctgttaatttctaacctaaaaaaargaacagtgactcctctgagttcagagtcctttccactaggtatacaaatg

SEQ ID NO: 8375 - DNA, 201 bp, Homo sapiens
ggggtgccctgcctgcgcacctgccggaacccccgtggagactgcctgcgggacgtccggggcctggaaggtgggctggggccggtcgggaggggtggccwgggctccgccgcctgtggccttctcctggcccctcgaggagcctctgtggccccagcttccagcacattctggtgctgtcggcgaggcccgctgcttggg

SEQ ID NO: 8376 - DNA, 201 bp, Homo sapiens
ggagtgcacctacaaagctgagggtgagcggccggcagcccctggggctggggtccgggggtctctgtctgcgcccagcctctgacgggcctgggccctcygtccccatagcctgtgtctgcacctacaatggacagcgcttccacccaggggacgtcatctaccacacgacggatggcacgggtggctgcatctccgccc

SEQ ID NO: 8377 - DNA, 201 bp, Homo sapiens
ccccagtctgggggtgcaatgcagttcccagggaactccacccctgtcggagctgctccctgcccgccgttggtagcatgggatgcccgtggaaggcacamggccgcccccacgcatcggcctgcccttcttccttgtctccagcctttgtacggagcgcggcgtggagtgcacctacaaagctgagggtgagcggccggc

SEQ ID NO: 8378 - DNA, 201 bp, Homo sapiens
gggtcctgacgccacctgctccatggggccaggctgaggagatgctcctggagggtctgggctcagacttcagactcacatggacagaggcctcctaggaccccccaacccagcacagagagagcccttgccacgggccacccccacgcactgtggcctcccgtccctctggtgtccatgctgcatctgtggccgcagcct

SEQ ID NO: 8379 - DNA, 201 bp, Homo sapiens
gaggcccctgtcctgggccgctgaggctggctgaggatcctgtcctgggccccctgaggctggctgaggcccctctcctgggcccctgaggctggttgagratcctgtcctgagccccctgaggctggctgatgcccctgtcccgggcccctgaggctggctgaggcccctgtcctgggcccctgaggctggctgaggatc

SEQ ID NO: 8380 - DNA, 201 bp, Homo sapiens
gccgctgaggctggctgaggatcctgtcctgggccccctgaggctggctgaggcccctctcctgggcccctgaggctggttgaggatcctgtcctgagccycctgaggctggctgatgcccctgtcccgggcccctgaggctggctgaggcccctgtcctgggcccctgaggctggctgaggatcctgtcctgggccccct

SEQ ID NO: 8381 - DNA, 201 bp, Homo sapiens
gtcctggccccctgaggctggctgaggcccctgtcccgggcccctgaggctggctgatgcccctgtcccgggcccctgaggctggctgaggcccccgtccygggcccctggagctggctgaggccccagctcgctgtggggccgccatgttgttcccctgcaacgcccactgcgtggacacagcaggcgcccgtcataggc

SEQ ID NO: 8382 - DNA, 201 bp, Homo sapiens
acacagtctccctatggtgagaccctgcacccaacatacagtctctgcacgatgagaccctgcacccaacacacagtctcccacgatgagaccctgcaccmaacacacagtctccctatggtgagaccctgcacccgacacacagtctctccacaatgagaccctgcacccgacacacagtctctgcacgatgagagcctg

SEQ ID NO: 8383 - DNA, 201 bp, Homo sapiens
agaccctgcacccaacacacagtctcccacgatgagaccctgcaccaaacacacagtctccctatggtgagaccctgcacccgacacacagtctctccacratgagaccctgcacccgacacacagtctctgcacgatgagagcctgcacccaacacacagtctcccacgatgagaccctacacccaacacacagtctctc

SEQ ID NO: 8384 - DNA, 201 bp, Homo sapiens
caccaaacacacagtctccctatggtgagaccctgcacccgacacacagtctctccacaatgagaccctgcacccgacacacagtctctgcacgatgagascctgcacccaacacacagtctcccacgatgagaccctacacccaacacacagtctctccacgatgagaccctgcacccaacacacagtctctccacgatg

SEQ ID NO: 8385 - DNA, 201 bp, Homo sapiens
catccactcattcactcactcactcatccactcactcacttattccctcattcattccttcactcattggttaaccatgtttatggcatttttcttgcacytccagccctacactaggcccaggggctaaacttcaggggtttgttgcccacctggccccaggggccaaatgagaattaggccaaggctgagctgatgtgc

SEQ ID NO: 8386 - DNA, 201 bp, Homo sapiens
cctgctaccacagaggctccatgatccccaatggggagtcggtgcacgacagcggggctatctggtaagagctcccgctgtggactgggggggtccctcgygtctcctggcccaggctgaggctctgaccaccatctcctcacagcacctgcacacatgggaagctgagctgcatcggaggccaagcccccgccccaggtg

SEQ ID NO: 8387 - DNA, 201 bp, Homo sapiens
gcacctgcacacatgggaagctgagctgcatcggaggccaagcccccgccccaggtgagtgccagaaaggaggcactgtggcccccagcctcctcatctcyataagaaatcctgaaaaatggcttcagggttagccccaccacaagtcagcggggctggtggttgtccatcagctgctcagtgtcaggcatggtttgtgcc

SEQ ID NO: 8388 - DNA, 201 bp, Homo sapiens
cttggggtgcccccagtgtgcacaggttgctctaagggcccccgtcctctgtgctgggcttgagggcaaggagcgcccaggtcagtgtggccttggacccrgccgaggaggggaggggagggtagccgagagggctgggctcactcactgctggctgcccactgccgggctgtgtgtcctgagaatcccctcttcctggca

SEQ ID NO: 8389 - DNA, 201 bp, Homo sapiens
ctccatgatccccaatggggagtcggtgcacgacagcggggctatctggtaagagctcccgctgtggactgggggggtccctcgcgtctcctggcccaggstgaggctctgaccaccatctcctcacagcacctgcacacatgggaagctgagctgcatcggaggccaagcccccgccccaggtgagtgccagaaaggagg

SEQ ID NO: 8390 - DNA, 201 bp, Homo sapiens
tccacagactgcaccaactggtaggtcccagcccccctccaggcccccaggatgtgctatgggacagacctgctgggggttgcgacccaggccggcaggcwccctcgtctgggctacggtgtaggcaggcctggggtgagacccggtcagcctcctgacgcggaggctggaggctggtctcctggggccggcacccacgtg

SEQ ID NO: 8391 - DNA, 201 bp, Homo sapiens
ccccaggggccacctactccacagactgcaccaactggtaggtcccagcccccctccaggcccccaggatgtgctatgggacagacctgctgggggttgcracccaggccggcaggcaccctcgtctgggctacggtgtaggcaggcctggggtgagacccggtcagcctcctgacgcggaggctggaggctggtctcctg

SEQ ID NO: 8392 - DNA, 201 bp, Homo sapiens
gcagggagggcaggggcaggcagacgtgagccctctctctgcctcccgcagcccagaagtgccccaacaacatgcagtaccacgagtgccgctccccctgygcagacacctgctccaaccaggagcactcccgggcctgtgaggaccactgtgtggccggctgcttctgccctgagggtgaggctcccccgcccctgggaa

SEQ ID NO: 8393 - DNA, 201 bp, Homo sapiens
ggagccaccgatggcccttctaaccccaccccagggacccggccctgggggctctgctgctcgggtgctgggctgacgggtaccgggacctgcaggcagascccgcctctgtgcttgccgcagacaccaagctgacacccatggaattcgggaacctgcagaagatggacgaccccacggagcagtgtcaggaccctgtcc

SEQ ID NO: 8394 - DNA, 201 bp, Homo sapiens
gcccattgggccccttgctctgtgtggctgctctgggtggcgacccctgactgcacgccctctcctgaaatgacagacctgcctccttcttggtctttgartctctgccaccaggcagtggccttgcaaatgtgacctgcaccagccaaggccccactccctgcctcctcctgccaggcccatgaagccccatacaagccc

SEQ ID NO: 8395 - DNA, 201 bp, Homo sapiens
cacaccctctgacactccgggcacacacatgcacagatacacggatgcagctgccctccctcctagcacagcacacacgtgcacacacgcgatcccgcaaygccggcctgtctcaggagtgcaggcagggagcaaatcgcccattgggccccttgctctgtgtggctgctctgggtggcgacccctgactgcacgccctct

SEQ ID NO: 8396 - DNA, 201 bp, Homo sapiens
ctcctctcccacagtaaggccccacatcgccctcagccccttcctcagtgtcccctgggggctcagtgttgtgtgcacacacaccctctgacactccgggmacacacatgcacagatacacggatgcagctgccctccctcctagcacagcacacacgtgcacacacgcgatcccgcaacgccggcctgtctcaggagtgc

SEQ ID NO: 8397 - DNA, 201 bp, Homo sapiens
ggctctgtggggacttcaacgggatgcccgtggtcagcgagctcctctcccacagtaaggccccacatcgccctcagccccttcctcagtgtcccctgggrgctcagtgttgtgtgcacacacaccctctgacactccgggcacacacatgcacagatacacggatgcagctgccctccctcctagcacagcacacacgtg

SEQ ID NO: 8398 - DNA, 201 bp, Homo sapiens
ggtgtctgatgtctctccctttgcagctggagctggacaccaaatacgccaacaagacctgtgggctctgtggggacttcaacgggatgcccgtggtcagsgagctcctctcccacagtaaggccccacatcgccctcagccccttcctcagtgtcccctgggggctcagtgttgtgtgcacacacaccctctgacactcc

SEQ ID NO: 8399 - DNA, 201 bp, Homo sapiens
ctgtcttcccatctctgaggaccatccctgtggtacgaggtgagtggagcccggaggcctgggtggggaagggtcatagctttgctgagctccccgctcargcctggaggtgccgggtggagagaggccccagctttccgggtgaacactgggtgggtattggagccagagggcccagcatctccctgcacacgtttctgg

SEQ ID NO: 8400 - DNA, 201 bp, Homo sapiens
tgtctgggcctcgatggggatctcctgcggggggaggtctcagcctctgagctgggatgtgatggtgaggcccacaagggaactgtttcaccgcccccctsaggctaagagggtgatgggggaggctccaggtcctgtggtctggactgccccttgctgggccagcaggtcccttcctctgcttctgagggacacctggga

SEQ ID NO: 8401 - DNA, 201 bp, Homo sapiens
ttccctgtctgggcctcgatggggatctcctgcggggggaggtctcagcctctgagctgggatgtgatggtgaggcccacaagggaactgtttcaccgccsccctcaggctaagagggtgatgggggaggctccaggtcctgtggtctggactgccccttgctgggccagcaggtcccttcctctgcttctgagggacacc

SEQ ID NO: 8402 - DNA, 201 bp, Homo sapiens
acgttccctgtctgggcctcgatggggatctcctgcggggggaggtctcagcctctgagctgggatgtgatggtgaggcccacaagggaactgtttcaccscccccctcaggctaagagggtgatgggggaggctccaggtcctgtggtctggactgccccttgctgggccagcaggtcccttcctctgcttctgagggac

SEQ ID NO: 8403 - DNA, 201 bp, Homo sapiens
tcccagtgaggtgccatgcataggcgccggggtcaggacttaggcgggtccttcgaggccacgtcagcttctttttctccaggaggggcttgcctctggcyccggccctcggtgctcagctgcactgcccggggcctccccaggtgtagctggaggtgggaaggaggaagcagcacctgtggtcgctgttggccacctggg

SEQ ID NO: 8404 - DNA, 201 bp, Homo sapiens
ccccatctcccagtgaggtgccatgcataggcgccggggtcaggacttaggcgggtccttcgaggccacgtcagcttctttttctccaggaggggcttgcstctggctccggccctcggtgctcagctgcactgcccggggcctccccaggtgtagctggaggtgggaaggaggaagcagcacctgtggtcgctgttggcc

SEQ ID NO: 8405 - DNA, 201 bp, Homo sapiens
cccaggactcctttcgtgttgtcaccgagaacgtcccctgcggcaccacagggaccacctgctccaaggccatcaagattttcctgggggtgagcgaggcygggtggtcgcatgccctccaggaggctcccatggcagcgtctggtcaggtgggctggggttcttgctgggggccctgagtgaccccttgccatgcagggc

SEQ ID NO: 8406 - DNA, 201 bp, Homo sapiens
catcctccttgcgggaaggagggcagggcctgcctggtccttgatggcctctgcttccccagaaccactgtggcgggaaagacagcacccaggactccttycgtgttgtcaccgagaacgtcccctgcggcaccacagggaccacctgctccaaggccatcaagattttcctgggggtgagcgaggctgggtggtcgcatg

SEQ ID NO: 8407 - DNA, 201 bp, Homo sapiens
cggccactacctcaccttcgacggacagagctacagcttcaacggagactgcgagtacacgctggtgcaggtgagccggcgcgtttggggtcctcacggcrgcccccgtggcccgaagctgctcactgcctctctgcggctgccccagggtgcacacaggttgtccccgcctcatcctccttgcgggaaggagggcagggc

SEQ ID NO: 8408 - DNA, 201 bp, Homo sapiens
caggcaccctgtgtgtgctctagcctgacccccagatgtcccccagcacctgtgacagcaggatgtggcggtgcacagatgacccctgcctggccacctgygccgtgtacggggacggccactacctcaccttcgacggacagagctacagcttcaacggagactgcgagtacacgctggtgcaggtgagccggcgcgttt

SEQ ID NO: 8409 - DNA, 201 bp, Homo sapiens
tgagctgtccctgggaggacctggcaggccccgtgccctgccccatcactcagtggtgtctgctggccctgcagtacagcccccagtgtgtgcctggctgygtgtgccccgacgggctggtggcggacggcgagggcggctgcatcactgcggaggactgcccctgcgtgcacaatgaggccagctaccgggccggccaga

SEQ ID NO: 8410 - DNA, 201 bp, Homo sapiens
taattggggggtcccgatctggcccaccctcccctgtccccatcttgtgatggccgggaggtgcaggggagggaagcagctttagaacagccctggggtgyggggcctctgcgagtgagttcctgggaccccaccgagcccttccttcctccctgcagctctgttctgcgactactacaaccccgaaggccagtgcgagtg

SEQ ID NO: 8411 - DNA, 201 bp, Homo sapiens
gggtattggagccagagggcccagcatctccctgcacacgtttctgggacttcccagatgcaggaaggacccctgggtgccccgtccagggcagcagcacytcctgcaggaccctggggaggggcaggaggtacagggcagaggcagggggtgcagggcgaggatgagggcgacgcccccaaacaccatgctgcttccacc

SEQ ID NO: 8412 - DNA, 201 bp, Homo sapiens
gcagacgtgagccctctctctgcctcccgcagcccagaagtgccccaacaacatgcagtaccacgagtgccgctccccctgcgcagacacctgctccaacsaggagcactcccgggcctgtgaggaccactgtgtggccggctgcttctgccctgagggtgaggctcccccgcccctgggaaacacaggtgcaccccgaca

SEQ ID NO: 8413 - DNA, 201 bp, Homo sapiens
cacgcccggggacacaggggctggctgtcagaagagctgccacacactggacatgacctgtgtaagtccctgaggactccccaatgacagaccctccatcygcccctgcctgctaagggcgcctgtccccagggtgggcagtggtgagcctctgacacattaggccatgggctgccccacgtcccagaggacccctgccca

SEQ ID NO: 8414 - DNA, 201 bp, Homo sapiens
gactgcaccaactggtaggtcccagcccccctccaggcccccaggatgtgctatgggacagacctgctgggggttgcgacccaggccggcaggcaccctcrtctgggctacggtgtaggcaggcctggggtgagacccggtcagcctcctgacgcggaggctggaggctggtctcctggggccggcacccacgtggcacca

SEQ ID NO: 8415 - DNA, 201 bp, Homo sapiens
gggacagacctgctgggggttgcgacccaggccggcaggcaccctcgtctgggctacggtgtaggcaggcctggggtgagacccggtcagcctcctgacgyggaggctggaggctggtctcctggggccggcacccacgtggcaccatctcttgctctcagcacctgctccggaggccggtggagctgccaggaggttcca

SEQ ID NO: 8416 - DNA, 201 bp, Homo sapiens
ctggggtgagacccggtcagcctcctgacgcggaggctggaggctggtctcctggggccggcacccacgtggcaccatctcttgctctcagcacctgctcyggaggccggtggagctgccaggaggttccatgcccgggtacctgctctgtgcttggaggtgcccacttctcaacgtttgacgggaagcaatacacggtgc

SEQ ID NO: 8417 - DNA, 201 bp, Homo sapiens
gggacagggcactcttccccgccgtccacacaatgagtgttggccggaggaagctggccctgctctgggccctggctctcgctctggcctgcacccggcayacaggtacggcttggcccctggccgctctactggtcctgggtggtgcggtactgagtgggcctcaggcagctcagtctttgccctgggttccgggcaggc

SEQ ID NO: 8418 - DNA, 201 bp, Homo sapiens
gggggtgtcccggtgtgcaactccagccctcgagggccggcctgctcccacagcctctccggagagggtagaaggtgccctgggcccagtcagggtcagaytccaccccacacagcaggcaagaacaggtgcccagacaccaatggtgtcccggggtctgtgcccccaggatggagactgctttcgggggtgtctcttccg

SEQ ID NO: 8419 - DNA, 201 bp, Homo sapiens
gtgcccagacaccaatggtgtcccggggtctgtgcccccaggatggagactgctttcgggggtgtctcttccgtgggcctcggcccctcctcggaaatctyaggctcgagcctcatctgtccatctgcccctggtggggatgggtgtctgatgtctctccctttgcagctggagctggacaccaaatacgccaacaagacc

SEQ ID NO: 8420 - DNA, 201 bp, Homo sapiens
tgggagccacttccctaaaactcagtcggttcgcctggctcttcagaacctgtgccgctcatgtgggttctgagcagggaccgcgggtggggacaggaagwcagacctgctggcgcagctccagaccggtgacagagccgcagggaggggcggggcggcccccaagtgcgggcctctcatgctcagctgccttctcttctg

SEQ ID NO: 8421 - DNA, 201 bp, Homo sapiens
gtcctgccctcagcagcccccgggcctggcctcatgggggtgtcaggggtctggcagcccaggctggccccggggatgcatggctatcacttgcctcacamtgctcagggctcaggtacccccatgtcctcgccctcttctgggggatgtctcagggccccaaggcatcatctgagcttctctgagagtagaaagctctgg

SEQ ID NO: 8422 - DNA, 201 bp, Homo sapiens
aacggcaccattgagaggagggtctacccctgcagccccaccacccctgtccccccaaccaccttctccttctccacacccccgcttggtaaggcaaatgyggccgaggagccccagggtgagcccctcccactgcctggcacagctgcccttgctggacgctgaggtcacagcagctctgggcatgggcggcagcccctg

SEQ ID NO: 8423 - DNA, 201 bp, Homo sapiens
cagtggggaagtgttcctgaaccagatctacacccagctgcccatctctgcaggtgagggcagtggcttcttccccaccccggggctgcctggggtcccgmcccacagcccccagcaaaacccttgtcctttgtgtccccagccaacgtcaccatcttcagaccctcaaccttcttcatcatcgcccagaccagcctgggc

SEQ ID NO: 8424 - DNA, 201 bp, Homo sapiens
ccatgcagctgttcatgcagctggcgcccaagctccgtgggcagacctgcggtaagagggctgccttctgggcttggagcccacccactctggccagggcrcatggtcctcaacctgcctaacccgcccccaggtctctgtgggaacttcaacagcatccaggccgatgacttccggaccctcagtggggtggtggaggcc

SEQ ID NO: 8425 - DNA, 201 bp, Homo sapiens
gctctccccctcctgcccagatgccctggcgcccaaggacccctgcacggccaaccccttccgcaagtcctgggcccagaagcagtgcagcatcctccacrgccccaccttcgccgcctgccacgcacacgtatgctggccggggggcgtttctctgggcccaagggggtcatggtgacccaaggagcccccagaagggag

SEQ ID NO: 8426 - DNA, 201 bp, Homo sapiens
ggagtggggttttctagtgagggagaggagcacagccgggtggactggcagggccaggtgggctgggcgttggatggagtgtgaggacccctggtgtgtcrtgttccgcagccctgtgacagcagtgccttcactgtactggctgagctgcgcaggtgcgggctgacggacagcgagacctgcctgaagagcgtgacactg

SEQ ID NO: 8427 - DNA, 201 bp, Homo sapiens
ccgcctgccccaacatcaggaacagcttcgaggacccctgctctctgagcgtggagaatggtacgggtgtccacggctcgcctctgtgctggccgcctggygctggttcacccgcttccatttggcactgcaggcagcgaggctggccctgcgtgtgcctgtgagccgggtggggtggctcacgaaggggcccaaggacag

SEQ ID NO: 8428 - DNA, 201 bp, Homo sapiens
tgtactggctgagctgcgcaggtgcgggctgacggacagcgagacctgcctgaagagcgtgacactgagcctggatggggtgcagacggtgagtggagcckggcagggcaaaccccgggaagagggaaggggcctgtctcttctgcaagtcacctctgcccaagcccttcatccctggcatgaacagcgagaggcggggac

SEQ ID NO: 8429 - DNA, 201 bp, Homo sapiens
ctggctgcgtgtgccccgacgggctggtggcggacggcgagggcggctgcatcactgcggaggactgcccctgcgtgcacaatgaggccagctaccgggcyggccagaccatccgggtgggctgcaacacctggtatgccgggggctcaaagcccatggggggtgtcaggcccaggaaaccagaggccctccttaaagacg

SEQ ID NO: 8430 - DNA, 201 bp, Homo sapiens
tggagaatggtacgggtgtccacggctcgcctctgtgctggccgcctggcgctggttcacccgcttccatttggcactgcaggcagcgaggctggccctgygtgtgcctgtgagccgggtggggtggctcacgaaggggcccaaggacaggctcatggtgggcgcccaccccagcttatgtggagcttcaggaatgtgggg

SEQ ID NO: 8431 - DNA, 201 bp, Homo sapiens
tctgagcgtggagaatggtacgggtgtccacggctcgcctctgtgctggccgcctggcgctggttcacccgcttccatttggcactgcaggcagcgaggcyggccctgcgtgtgcctgtgagccgggtggggtggctcacgaaggggcccaaggacaggctcatggtgggcgcccaccccagcttatgtggagcttcagga

SEQ ID NO: 8432 - DNA, 201 bp, Homo sapiens
ccactgtggtgtgggtgagctgtccctgggaggacctggcaggccccgtgccctgccccatcactcagtggtgtctgctggccctgcagtacagcccccartgtgtgcctggctgcgtgtgccccgacgggctggtggcggacggcgagggcggctgcatcactgcggaggactgcccctgcgtgcacaatgaggccagct

SEQ ID NO: 8433 - DNA, 201 bp, Homo sapiens
ccagcctcccacaggctcccccagcttggctgcatgtcactgctgcccctggggtcacccttgggggtccccgatgttgagacctcaaggaagcactccasctccccagcgctagtcctcacagggccatgaaggctgcagatcagagcctccagcacccacccagcattgggcctcacccagcactgggccctctgcacc

SEQ ID NO: 8434 - DNA, 201 bp, Homo sapiens
cccctcctgggatccccaggctcttattctgccccttcctagctcctcgtgacccccgagctccagaggtcaatgtccccatcccagacgcgacttcacgrtcacgatgaccgtgtcacatttgcgaccgcaggcatctgccctgcctggggtctctcctcactgcgctcccagcccctcagccctgccttcctccacagg

SEQ ID NO: 8435 - DNA, 201 bp, Homo sapiens
tccctgtggtacgaggtgagtggagcccggaggcctgggtggggaagggtcatagctttgctgagctccccgctcaggcctggaggtgccgggtggagagrggccccagctttccgggtgaacactgggtgggtattggagccagagggcccagcatctccctgcacacgtttctgggacttcccagatgcaggaaggacc

SEQ ID NO: 8436 - DNA, 201 bp, Homo sapiens
ctgctgactctggaacgtctcctctggctgcggagcccccgccccacgtggggccgtgcgtgaatcctaccagcccctgtctccgcaggggtcccgctccrtggggcgactgtcttcccatctctgaggaccatccctgtggtacgaggtgagtggagcccggaggcctgggtggggaagggtcatagctttgctgagctc

SEQ ID NO: 8437 - DNA, 201 bp, Homo sapiens
gctgggacctgctgactctggaacgtctcctctggctgcggagcccccgccccacgtggggccgtgcgtgaatcctaccagcccctgtctccgcaggggtyccgctccgtggggcgactgtcttcccatctctgaggaccatccctgtggtacgaggtgagtggagcccggaggcctgggtggggaagggtcatagctttg

SEQ ID NO: 8438 - DNA, 201 bp, Homo sapiens
gagctgggacctgctgactctggaacgtctcctctggctgcggagcccccgccccacgtggggccgtgcgtgaatcctaccagcccctgtctccgcagggktcccgctccgtggggcgactgtcttcccatctctgaggaccatccctgtggtacgaggtgagtggagcccggaggcctgggtggggaagggtcatagctt

SEQ ID NO: 8439 - DNA, 201 bp, Homo sapiens
caccctgccctctctcctatcgcccgggggcccagcggtgagtctgagtgtccggcccccaccctaagcctgtcagattccaccctccaccgtgtggcacrgcccctagggccactggtcttagggtggctccccagctggccactgctgaggaccaaacctggggggacaggaggacacccccacatccatggccctggt

SEQ ID NO: 8440 - DNA, 201 bp, Homo sapiens
cagcagaatccggagttggcttcggagccaggagctgggacctgctgactctggaacgtctcctctggctgcggagcccccgccccacgtggggccgtgcrtgaatcctaccagcccctgtctccgcaggggtcccgctccgtggggcgactgtcttcccatctctgaggaccatccctgtggtacgaggtgagtggagcc

SEQ ID NO: 8441 - DNA, 201 bp, Homo sapiens
gagtgaccccttgccatgcagggcttcgagctgaagctaagccatgggaaggtggaggtgatcgggacggacgagagccaggaggtgccatacaccatccrgcagatgggcatctacctggtggtggacaccgacattggcctggtgctgctgtgggacaagaagaccagcatcttcatcaacctcagccccgagttcaag

SEQ ID NO: 8442 - DNA, 201 bp, Homo sapiens
cctggggggtgttaaccccaagggctgccgaggaagccccaggcactgtggatatccagatgggcccagccggccacttggggatgggcattcgccctccytgagctccactggaactcggccccggtcaatgtgccagcatgggcccggtccccaagagcccgcggggtgggtgggggggtccctggaacctgaagcccc

SEQ ID NO: 8443 - DNA, 201 bp, Homo sapiens
cgagcccttccttcctccctgcagctctgttctgcgactactacaaccccgaaggccagtgcgagtggcactaccagccctgcggggtgccctgcctgcgyacctgccggaacccccgtggagactgcctgcgggacgtccggggcctggaaggtgggctggggccggtcgggaggggtggcctgggctccgccgcctgtg

SEQ ID NO: 8444 - DNA, 201 bp, Homo sapiens
ctacaaccccgaaggccagtgcgagtggcactaccagccctgcggggtgccctgcctgcgcacctgccggaacccccgtggagactgcctgcgggacgtcyggggcctggaaggtgggctggggccggtcgggaggggtggcctgggctccgccgcctgtggccttctcctggcccctcgaggagcctctgtggccccagc

SEQ ID NO: 8445 - DNA, 201 bp, Homo sapiens
cctgaggctgactgaggcccctgtcctgggccgctgaggctggctgaggatcctgtcctgggccccctgaggctggctgaggcccctctcctgggcccctraggctggttgaggatcctgtcctgagccccctgaggctggctgatgcccctgtcccgggcccctgaggctggctgaggcccctgtcctgggcccctgagg

SEQ ID NO: 8446 - DNA, 201 bp, Homo sapiens
gtctctgcacgatgagaccctgcacccaacacacagtctccccaagatgagaccctgcacccaacacacagtctctcccagatgagactctgcacccaacrcagtctccccaagatgagaccttgcactcaacacatagtctcccccgatgagaccctgcacccaacacacagtctcccacaatgagaccctgcacccaat

SEQ ID NO: 8447 - DNA, 201 bp, Homo sapiens
tgtgacagcagtgccttcactgtactggctgagctgcgcaggtgcgggctgacggacagcgagacctgcctgaagagcgtgacactgagcctggatggggygcagacggtgagtggagcctggcagggcaaaccccgggaagagggaaggggcctgtctcttctgcaagtcacctctgcccaagcccttcatccctggcat

SEQ ID NO: 8448 - DNA, 201 bp, Homo sapiens
ttaataaccttggttttcactgaagaatgaaaggcatggtcctcgcagaaaattcagaaaatcaggcgagcacaaggccaccttgtaggagccgcagctgsagggaaaggcctcccaggcacctgcaggcacatttcacagcctccgcggggctgaggtgccgcaagcctgccccgcgctcacacatctgtctggctgccc

SEQ ID NO: 8449 - DNA, 201 bp, Homo sapiens
gggctgggtgggacatgcaggaaacgagagaagcctcggttctggatgttgtaccctgcgtttgggggagcttttcctaggggagggcgccacaccacccrggctgagtgtgtagcaggatgaagggcccaatatcagactgcccagagaagctggcaccccaaaccccacaccagaggccaagctgggtgggatgagtgt

SEQ ID NO: 8450 - DNA, 201 bp, Homo sapiens
gcctcggttctggatgttgtaccctgcgtttgggggagcttttcctaggggagggcgccacaccacccgggctgagtgtgtagcaggatgaagggcccaayatcagactgcccagagaagctggcaccccaaaccccacaccagaggccaagctgggtgggatgagtgtgctgcctgatcttaatcctaaccctatccctc

SEQ ID NO: 8451 - DNA, 201 bp, Homo sapiens
ggaacccagtctgtctgtccagctccattccccacatccccacccacccattcactcattcacacattcaccactcacccacacactcacccattcacctrctcactcacccgttcacccattcactcacccactcactcacccattcacccatttacccactcacccattcactcactcacccactcatccacccattca

SEQ ID NO: 8452 - DNA, 201 bp, Homo sapiens
agaggcagggcaggcaagggcagccagggcagggggcttcaggcaaactctcagattgcatttctccaaatcgggccagacaggcctaatctcagcacctragagattgtcttgagccgctgatgcagactcaggttctgaggcccatgggcatgtgagagctggcagcccctggggacttcttcctggtgacagccggga

SEQ ID NO: 8453 - DNA, 201 bp, Homo sapiens
cagtggctgctctgggactcgcctcgcctggagactgccctgaagcctgggagcctgacgtggagcaggcaggtggccggagaggctgcacccagcacccygcccatccctcccacagggtctttgagccgtgccacactgtgatccccccactgctgttctatgagggctgcgtctttgaccggtgccacatgacggacc

SEQ ID NO: 8454 - DNA, 201 bp, Homo sapiens
tccccccactgctgttctatgagggctgcgtctttgaccggtgccacatgacggacctggatgtggtgtgctccagcctggagctgtacgcggcactctgygcgtcccacgacatctgcatcgattggagaggccggaccggccacatgtgccgtgagtgccaccactgtcctcagggtcccaagtcgcttgtgaggggca

SEQ ID NO: 8455 - DNA, 201 bp, Homo sapiens
gtaagagccacggagctcagaccccctcagccatagggacggagcttcccactgaccctgaggcccaggtagactttggagcaactgccaactccggccgrggccagggactcgagtctctgcagacacagcccactatcaagtgtggctgaggcccgaggtcggccccaggtcccggaaatatggacatctacaccctgg

SEQ ID NO: 8456 - DNA, 201 bp, Homo sapiens
ctacagggaacttgaatgtctttgcaattagtcttcagctgcaaagtcttgagaaggtcactggcgctagtggaggcagcccggccgtcaggagagggccrtgctgtagcccggcgtctctgatcaccctgggcttcccaggcacgtgctttccagacactgggtgtgtggggccgaaggctgaggctgtgctgaggacag

SEQ ID NO: 8457 - DNA, 201 bp, Homo sapiens
cggctacccggctgtgaaggtggctgaccaagatggctgctgccatcactaccagtgccagtgtgagtggagcgccgagcgggacccagggcagccggggyagccactccccacccaggtggaaatgggcggggcagaggagggggcttggctgaagcagaaaagaattgggtgggacagcaggaaggacttcccagcatc

SEQ ID NO: 8458 - DNA, 201 bp, Homo sapiens
ggcagaggagggggcttggctgaagcagaaaagaattgggtgggacagcaggaaggacttcccagcatcaaggcggggccgcatggggccgagcctccccscttaggggtgctgagtgaatccctgtgagcctcggagcagcctggctggagaaggtggaggagtctgtccctgcctcgctccagccttgtcaagcgcccg

SEQ ID NO: 8459 - DNA, 201 bp, Homo sapiens
gcggtgcggaggacgggctctcctgcccgaggtccatcatcctggagtaccaccaggaccgcgtggtgctgacccgcaagccagtccacggggtgatgacraacgaggtgggggcgcgcccggtgtgccgcggagggggtgggggacgcggctttcccggcaagagcctgagcagcggctgaccgcccgcccgcctgcctt

SEQ ID NO: 8460 - DNA, 201 bp, Homo sapiens
cccggtgtgccgcggagggggtgggggacgcggctttcccggcaagagcctgagcagcggctgaccgcccgcccgcctgccttctgacttcccgtcgaccrcgccctgcgtccagatcatcttcaacaacaaggtggtcagccccggcttccggaaaaacggcatcgtggtctcgcgcatcggcgtcaagatgtacgcgac

SEQ ID NO: 8461 - DNA, 201 bp, Homo sapiens
cccaatatgggaccctgcctctcgcccctattgtggtggctgacccccagtaacctcagatctctctccttccagggtgtctggggccccacggagagccrgtgaaggtgagtggaaggcatggcccaagagggcactggggtccaagagcccgaggagggaggctcttgaaacaccggccccagaaatggtcaggtgggg

SEQ ID NO: 8462 - DNA, 201 bp, Homo sapiens
tgcctctcgcccctattgtggtggctgacccccagtaacctcagatctctctccttccagggtgtctggggccccacggagagccggtgaaggtgagtggmaggcatggcccaagagggcactggggtccaagagcccgaggagggaggctcttgaaacaccggccccagaaatggtcaggtggggctcaggggtcggggt

SEQ ID NO: 8463 - DNA, 201 bp, Homo sapiens
ctctgtgggtgggtgctggccccgaggctggctgtgctcttcccttccttgggacgccccttctgcccagccaagactgtggaggtgtgaggtggggggcrcaggccagtcaccccacagcctgcccaccttgcagagctttgtgcccatccctgggccctaccctgcacttttgaagccctactcctgctgggtcctcag

SEQ ID NO: 8464 - DNA, 201 bp, Homo sapiens
gagctttgtgcccatccctgggccctaccctgcacttttgaagccctactcctgctgggtcctcagtgcaggccacacggcctccacacctggctgccccrgcactgcatgagccgggctggctgctgcacccctgggtggagccgctgcggacgctggacctcagtccccttccttgcaggtgggccacaccgtcggcat

SEQ ID NO: 8465 - DNA, 201 bp, Homo sapiens
gccccagcactgcatgagccgggctggctgctgcacccctgggtggagccgctgcggacgctggacctcagtccccttccttgcaggtgggccacaccgtyggcatggactgccaggagtgcacgtgtgaggcggccacgtggacgctgacctgccgacccaagctctgcccgctgccccctgcctgccccctgcccggct

SEQ ID NO: 8466 - DNA, 201 bp, Homo sapiens
gacccccgagcgggctgtctaggcggtccgcaatcctagagaccccagggggtgggccttcgggtgggggcgggggacagactcctaattgcctcactccygcccccgcagcctgcaacaccagccgctgccccgcgcccgtgggctgtcctgagggcgcccgcgcgatcccgacctaccaggagggggcctgctgcccag

SEQ ID NO: 8467 - DNA, 201 bp, Homo sapiens
tcctagagaccccagggggtgggccttcgggtgggggcgggggacagactcctaattgcctcactcctgcccccgcagcctgcaacaccagccgctgcccsgcgcccgtgggctgtcctgagggcgcccgcgcgatcccgacctaccaggagggggcctgctgcccagtccaaaactgcagtgagtggcctggaccaggcc

SEQ ID NO: 8468 - DNA, 201 bp, Homo sapiens
cctagagaccccagggggtgggccttcgggtgggggcgggggacagactcctaattgcctcactcctgcccccgcagcctgcaacaccagccgctgccccrcgcccgtgggctgtcctgagggcgcccgcgcgatcccgacctaccaggagggggcctgctgcccagtccaaaactgcagtgagtggcctggaccaggccc

SEQ ID NO: 8469 - DNA, 201 bp, Homo sapiens
ctagagaccccagggggtgggccttcgggtgggggcgggggacagactcctaattgcctcactcctgcccccgcagcctgcaacaccagccgctgccccgmgcccgtgggctgtcctgagggcgcccgcgcgatcccgacctaccaggagggggcctgctgcccagtccaaaactgcagtgagtggcctggaccaggccct

SEQ ID NO: 8470 - DNA, 201 bp, Homo sapiens
agtgtggctgaggcccgaggtcggccccaggtcccggaaatatggacatctacaccctggcctgcctggctccggggggctccgggggactttgcctctcytggcaccacagcacagccaggcctggatcccacggctctgtcctgagccggctgagtatgtggccctgcagagtgtgtggccttgttgggcaccccatcc

SEQ ID NO: 8471 - DNA, 201 bp, Homo sapiens
tgagtgtctgctgccctggctctccccagcccggcgccgtggtctcctcgagcctgtgcgaaacctgcaggtgtgagctgccgggtggccccccatcggaygcgtttgtggtcagctgtgagacccagatctgcaacacacactgccctgtggtgagcgctcccaccctgccccgaccctgccctggctcttggggggcag

SEQ ID NO: 8472 - DNA, 201 bp, Homo sapiens
aggtcgcctgtgtcaccaacaccagcaagagccccgcccacctcttctacgtgagtagtggctgccacaaagaggaagggcagggtctgggagcactgggkcatgtggggacctgtcgttgccaggcatgcgtctggcagaggctggggactctctggaagcccacgggctggggtgcagacagagggacagacggaggga

SEQ ID NO: 8473 - DNA, 201 bp, Homo sapiens
gatgggctcgtggtggtcaccacgaagaaggcgtgccccccgctcagctgttctctggtgaggtccaggatccccgctccagccaaggggggcttcacccytagatgggtttggggggctgtgatcatccctgcagcgccagcagacaccccctcctgcttggggctgtccactcctgagcctggccccatgtccccatcc

SEQ ID NO: 8474 - DNA, 201 bp, Homo sapiens
cccccgctcagctgttctctggtgaggtccaggatccccgctccagccaaggggggcttcacccctagatgggtttggggggctgtgatcatccctgcagygccagcagacaccccctcctgcttggggctgtccactcctgagcctggccccatgtccccatccctcacttctgtgggggccgccgagcgcctcggcact

SEQ ID NO: 8475 - DNA, 201 bp, Homo sapiens
tctgtgggggccgccgagcgcctcggcactgagggcgcccctctgtcggcacaggacgaggcccgcatgagcaaggacggctgctgccgcttctgcccgcygcccccgcccccgtaccagaaccgtgagtgcccagcctgctgggcggggcgggctccaccctcagaggtccaggagcagctgggctggtcctaaaccctg

SEQ ID NO: 8476 - DNA, 201 bp, Homo sapiens
gagggcgcccctctgtcggcacaggacgaggcccgcatgagcaaggacggctgctgccgcttctgcccgccgcccccgcccccgtaccagaaccgtgagtrcccagcctgctgggcggggcgggctccaccctcagaggtccaggagcagctgggctggtcctaaaccctgtgttcctctccagagtcgacctgtgctgtg

SEQ ID NO: 8477 - DNA, 201 bp, Homo sapiens
caaggacggctgctgccgcttctgcccgccgcccccgcccccgtaccagaaccgtgagtgcccagcctgctgggcggggcgggctccaccctcagaggtcyaggagcagctgggctggtcctaaaccctgtgttcctctccagagtcgacctgtgctgtgtaccataggagcctgatcatccagcagcagggctgcagctc

SEQ ID NO: 8478 - DNA, 201 bp, Homo sapiens
tgccgggggaactgtggggacagctcttccatgtacgtgcctgggcagcaggcagggagacgcgattggctgtggggtgcagtcagggcccccagggctcyaggtgccagatagacgaggggcaggaccatgaggggccaggcaaagggctctgagggtgaggcgggaaaggggtcctgagatggcaagggtggggctggg

SEQ ID NO: 8479 - DNA, 201 bp, Homo sapiens
tgggcagcaggcagggagacgcgattggctgtggggtgcagtcagggcccccagggctctaggtgccagatagacgaggggcaggaccatgaggggccagrcaaagggctctgagggtgaggcgggaaaggggtcctgagatggcaagggtggggctggggtaactacatccccagagcctgtgtcggcatcacgctctcc

SEQ ID NO: 8480 - DNA, 201 bp, Homo sapiens
gggactgttggcgcctggggaactggcaaaggagagctggttgtcagacactggcagcatgcctccaggagcagggaacacgatgaggccgcccagagctyggcacggcgccggcttacggcaggaggctggggtggcgcagcagctggtgctgagcagcccctgcccacaggtactcgctcgagggcaacacggtggagc

SEQ ID NO: 8481 - DNA, 201 bp, Homo sapiens; identical to SEQ ID NO: 1227

SEQ ID NO: 8482 - DNA, 201 bp, Homo sapiens; identical to SEQ ID NO: 1237

SEQ ID NO: 8483 - DNA, 201 bp, Homo sapiens
gcatccagcctgctgttctggggacgtgagcatcacctgagggtctcaggaatgacgcttggacatggtgatcagctgcctggtggctgcaggaggaagamcctcactcctacctcagccctcagcctgcgctcccctcctcagtacacggccaatctgttgcataaatacacttgagcattttgcaatttgtggactgtg

SEQ ID NO: 8484 - DNA, 201 bp, Homo sapiens
ggaatgacgcttggacatggtgatcagctgcctggtggctgcaggaggaagaacctcactcctacctcagccctcagcctgcgctcccctcctcagtacayggccaatctgttgcataaatacacttgagcattttgcaatttgtggactgtgcattttttgagattgttcataaaatccaggaatagggtgggggcaaac

SEQ ID NO: 8485 - DNA, 201 bp, Homo sapiens
tgttggcgcctggggaactggcaaaggagagctggttgtcagacactggcagcatgcctccaggagcagggaacacgatgaggccgcccagagctcggcayggcgccggcttacggcaggaggctggggtggcgcagcagctggtgctgagcagcccctgcccacaggtactcgctcgagggcaacacggtggagcacagg

SEQ ID NO: 8486 - DNA, 201 bp, Homo sapiens
taccaggtaagagccacggagctcagaccccctcagccatagggacggagcttcccactgaccctgaggcccaggtagactttggagcaactgccaactcyggccggggccagggactcgagtctctgcagacacagcccactatcaagtgtggctgaggcccgaggtcggccccaggtcccggaaatatggacatctaca

SEQ ID NO: 8487 - DNA, 201 bp, Homo sapiens
tgggccctaccctgcacttttgaagccctactcctgctgggtcctcagtgcaggccacacggcctccacacctggctgccccagcactgcatgagccgggstggctgctgcacccctgggtggagccgctgcggacgctggacctcagtccccttccttgcaggtgggccacaccgtcggcatggactgccaggagtgcac

SEQ ID NO: 8488 - DNA, 201 bp, Homo sapiens
ccctgggccctaccctgcacttttgaagccctactcctgctgggtcctcagtgcaggccacacggcctccacacctggctgccccagcactgcatgagccsggctggctgctgcacccctgggtggagccgctgcggacgctggacctcagtccccttccttgcaggtgggccacaccgtcggcatggactgccaggagtg

SEQ ID NO: 8489 - DNA, 201 bp, Homo sapiens
ccttgggacgccccttctgcccagccaagactgtggaggtgtgaggtggggggcgcaggccagtcaccccacagcctgcccaccttgcagagctttgtgcycatccctgggccctaccctgcacttttgaagccctactcctgctgggtcctcagtgcaggccacacggcctccacacctggctgccccagcactgcatga

SEQ ID NO: 8490 - DNA, 201 bp, Homo sapiens
accagccagcctgccaccggcctcacccgacgcccaccacggtcgggcccaccacagttgggtctaccacggtcgggcccaccacagttgggtctaccacsgtcgggcccaccacaccgcctgctccgtgcctgccatcacccatctgccagctgattctgagcaagtgagacttgggtgcaagggagggagggtcagtgt

SEQ ID NO: 8491 - DNA, 201 bp, Homo sapiens
cccaaacctgcttctgcaacgtggctgaccggctctaccctgcaggttcgtgagtgtttctggtgcaattgtttctgagctcaccctggtcagttttttayccaggaacgccaagctgtgatgatgataggagtctctgctctttgtggcacaggctcattgtcacagagtggctgctggcattctctgaaattttttccc

SEQ ID NO: 8492 - DNA, 201 bp, Homo sapiens
cacccaaacctgcttctgcaacgtggctgaccggctctaccctgcaggttcgtgagtgtttctggtgcaattgtttctgagctcaccctggtcagtttttyatccaggaacgccaagctgtgatgatgataggagtctctgctctttgtggcacaggctcattgtcacagagtggctgctggcattctctgaaattttttc

SEQ ID NO: 8493 - DNA, 201 bp, Homo sapiens
cggtgacctctgtgaccccatatgggacttctcctaccaatgctctgtatccttccctgtctacttccatggtatccgcctccgtggcatccacctctgtrgcatccagctctgtggcatccagctctgtggcttactccacccaaacctgcttctgcaacgtggctgaccggctctaccctgcaggttcgtgagtgtttc

SEQ ID NO: 8494 - DNA, 201 bp, Homo sapiens; identical to SEQ ID NO: 1262

SEQ ID NO: 8495 - DNA, 201 bp, Homo sapiens
cggcctccacacctggctgccccagcactgcatgagccgggctggctgctgcacccctgggtggagccgctgcggacgctggacctcagtccccttccttscaggtgggccacaccgtcggcatggactgccaggagtgcacgtgtgaggcggccacgtggacgctgacctgccgacccaagctctgcccgctgccccctg

SEQ ID NO: 8496 - DNA, 201 bp, Homo sapiens
acgcttggacatggtgatcagctgcctggtggctgcaggaggaagaacctcactcctacctcagccctcagcctgcgctcccctcctcagtacacggccartctgttgcataaatacacttgagcattttgcaatttgtggactgtgcattttttgagattgttcataaaatccaggaatagggtgggggcaaacccgggc

SEQ ID NO: 8497 - DNA, 201 bp, Homo sapiens
gcttccgcaacagcctcatctggagacccccgagcgggctgtctaggcggtccgcaatcctagagaccccagggggtgggccttcgggtgggggcgggggrcagactcctaattgcctcactcctgcccccgcagcctgcaacaccagccgctgccccgcgcccgtgggctgtcctgagggcgcccgcgcgatcccgacct

SEQ ID NO: 8498 - DNA, 201 bp, Homo sapiens
cagaggctggggactctctggaagcccacgggctggggtgcagacagagggacagacggagggagggtcactcaccccggggcctggcctccctccagccyggcgagacctggtcagacgcagggaaccactgtgtgacccaccagtgtgagaagcaccaggatgggctcgtggtggtcaccacgaagaaggcgtgccccc

SEQ ID NO: 8499 - DNA, 201 bp, Homo sapiens
ccacagttgggtctaccacggtcgggcccaccacagttgggtctaccaccgtcgggcccaccacaccgcctgctccgtgcctgccatcacccatctgccasctgattctgagcaagtgagacttgggtgcaagggagggagggtcagtgtggccgccccacctcccacccttccaagggctggaggggaagaagcgcattt

SEQ ID NO: 8500 - DNA, 201 bp, Homo sapiens
ggctgtccactcctgagcctggccccatgtccccatccctcacttctgtgggggccgccgagcgcctcggcactgagggcgcccctctgtcggcacaggaygaggcccgcatgagcaaggacggctgctgccgcttctgcccgccgcccccgcccccgtaccagaaccgtgagtgcccagcctgctgggcggggcgggctc

SEQ ID NO: 8501 - DNA, 201 bp, Homo sapiens; identical to SEQ ID NO: 1225

SEQ ID NO: 8502 - DNA, 201 bp, Homo sapiens
aaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggtt

SEQ ID NO: 8503 - DNA, 201 bp, Homo sapiens
caaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaatt

SEQ ID NO: 8504 - DNA, 201 bp, Homo sapiens
tgggagatgagttaagaggttttattcttatacatgcggaagaattatgccttcttgagccatgctcaggagatgtcagccttttccattgtctccccgcycccaccgccagccctgcttaaattatcccctctttttaaacagaatatcctaatcttgcaagtggcatatcatgttccttcttttttaagagagaaggag

SEQ ID NO: 8505 - DNA, 201 bp, Homo sapiens
attatgccttcttgagccatgctcaggagatgtcagccttttccattgtctccccgcccccaccgccagccctgcttaaattatcccctctttttaaacaraatatcctaatcttgcaagtggcatatcatgttccttcttttttaagagagaaggagaaattcctgcagatcatcagggactgaggctaactgaaacttt

SEQ ID NO: 8506 - DNA, 201 bp, Homo sapiens
agaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctg

SEQ ID NO: 8507 - DNA, 201 bp, Homo sapiens
tacaagggccggatgcggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaa

SEQ ID NO: 8508 - DNA, 201 bp, Homo sapiens
gggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaa

SEQ ID NO: 8509 - DNA, 201 bp, Homo sapiens
gaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttg

SEQ ID NO: 8510 - DNA, 201 bp, Homo sapiens
gttgacctggaatgacctagaccagcagtcacaagctcctgcccatggacaaaatacagccggtacctctttggctatggcctgcaggctcagaatagttyttacattttcaatcatctgcaaaaaagaataaagaggagaatattatttcttgaaggaggaaaatgatatggaattctgatttcagtgtcataaagtttt

SEQ ID NO: 8511 - DNA, 201 bp, Homo sapiens
aaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatactta

SEQ ID NO: 8512 - DNA, 201 bp, Homo sapiens
ttgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaac

SEQ ID NO: 8513 - DNA, 201 bp, Homo sapiens
tcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatg

SEQ ID NO: 8514 - DNA, 201 bp, Homo sapiens
cctttgtttttgttgtcatcgttttatgattaacttatatctggtcctttagacatttagattttttctgttttatctctctctctctatatgtatatctrtatatatatttatctatatctatatagagatatatatatatatatataataatgaatgaaatggactgtttgcaacctcagatgtatttctaggacttag

SEQ ID NO: 8515 - DNA, 201 bp, Homo sapiens
tttatgattaacttatatctggtcctttagacatttagattttttctgttttatctctctctctctatatgtatatctatatatatatttatctatatctrtatagagatatatatatatatatataataatgaatgaaatggactgtttgcaacctcagatgtatttctaggacttagagtgattagcttgaggcgatgg

SEQ ID NO: 8516 - DNA, 201 bp, Homo sapiens
gcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatc

SEQ ID NO: 8517 - DNA, 201 bp, Homo sapiens
atgaaaggaccagaatggcagttctgagctagaatgtgatgagtaagtaccaccatagttagcggctagggaagggaggttgttctacagagaaacatgcycatcatttcttctgttacctggtattcactctggcaatttctttttggactcattctaaaatcaggattaaggatatccactgagaagcttgcatttatt

SEQ ID NO: 8518 - DNA, 201 bp, Homo sapiens
ccatgagtaacgaagtcctctgtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactcca

SEQ ID NO: 8519 - DNA, 201 bp, Homo sapiens
gttccacatcctccctgtgggactaggggccagggcaatgggaatcagtgcagaaataaagctcatgctgtttgctctgccatgagtaacgaagtcctctrtatctgatcctgggtctcctgttttctgctagcttcctcaaaacttggtagctaactcattaacttacaaggaagaggttgaacgtgtagacccttcaca

SEQ ID NO: 8520 - DNA, 201 bp, Homo sapiens
tatgagcacggcatctaccgggctgttccacatcctccctgtgggactaggggccagggcaatgggaatcagtgcagaaataaagctcatgctgtttgctstgccatgagtaacgaagtcctctgtatctgatcctgggtctcctgttttctgctagcttcctcaaaacttggtagctaactcattaacttacaaggaaga

SEQ ID NO: 8521 - DNA, 201 bp, Homo sapiens
cttgataaaggttggggtttgtaagcttggggctcctcagccatgactgaaacgtactatgagcacggcatctaccgggctgttccacatcctccctgtgkgactaggggccagggcaatgggaatcagtgcagaaataaagctcatgctgtttgctctgccatgagtaacgaagtcctctgtatctgatcctgggtctcc

SEQ ID NO: 8522 - DNA, 201 bp, Homo sapiens
taaagacagtgcctccttccaggacaacggtttggcagatttgcttgataaaggttggggtttgtaagcttggggctcctcagccatgactgaaacgtacyatgagcacggcatctaccgggctgttccacatcctccctgtgggactaggggccagggcaatgggaatcagtgcagaaataaagctcatgctgtttgctc

SEQ ID NO: 8523 - DNA, 201 bp, Homo sapiens
gatggctttctttccagtataataaagacagtgcctccttccaggacaacggtttggcagatttgcttgataaaggttggggtttgtaagcttggggctcytcagccatgactgaaacgtactatgagcacggcatctaccgggctgttccacatcctccctgtgggactaggggccagggcaatgggaatcagtgcagaa

SEQ ID NO: 8524 - DNA, 201 bp, Homo sapiens
aggagcagaggacaggatggctttctttccagtataataaagacagtgcctccttccaggacaacggtttggcagatttgcttgataaaggttggggtttstaagcttggggctcctcagccatgactgaaacgtactatgagcacggcatctaccgggctgttccacatcctccctgtgggactaggggccagggcaatg

SEQ ID NO: 8525 - DNA, 201 bp, Homo sapiens
ggcaaagcgatctcagggtaaacactgcacaccagtaagtattcttggggcaaatgggaaaagggttaaaatgaccagatctccagagatctcactcactrtggtgaagacagcgccaagccatgagggctccgccccagtgattcaaatacctcccattacggacatgtttcaacatgagatttgagcggggacaaatat

SEQ ID NO: 8526 - DNA, 201 bp, Homo sapiens
atttcatggcaaagcgatctcagggtaaacactgcacaccagtaagtattcttggggcaaatgggaaaagggttaaaatgaccagatctccagagatctcmctcactgtggtgaagacagcgccaagccatgagggctccgccccagtgattcaaatacctcccattacggacatgtttcaacatgagatttgagcgggga

SEQ ID NO: 8527 - DNA, 201 bp, Homo sapiens
tttgtcaaatggggtcatagagggtgagaatcagagtttatgcagggcatagcactagtgtaatgctgggcagagagtgagcatccagcaagtggttttgrcaatgataataattataacccaagcgacacatacaatttaatcaggcactgtgtgtccacagcgatgtcaaggaacaatgcacaaagcagagtttttcca

SEQ ID NO: 8528 - DNA, 201 bp, Homo sapiens
gcatcagccttagcccagacccccaaagttcctgggcttcattctgctttgcattcatctcaaagttaagccttctggctggcaggggtttctgagacagwctgacagtattagcgtgctgcagtttcatgatggcaagaaggaggttaccaaagccgttttcatacaccttaactcatgagtggtagtgagtggccccag

SEQ ID NO: 8529 - DNA, 201 bp, Homo sapiens
ggaggtatgtgctgaggatctctttggcttctgcatctcaaaggatgagtgatttagccaggtggagaggttggggcggtatcctgaatgaaagaatagcrcagacaaaagtagtgagttgaaaacagaacagcatggcaggctcccagtaatcccatgagtcacgtgttctgcccacatggaatggatggtggagaaggg

SEQ ID NO: 8530 - DNA, 201 bp, Homo sapiens
aggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttg

SEQ ID NO: 8531 - DNA, 201 bp, Homo sapiens
tttggctcgttttcagtttttattaatttcctgtgcttctggttcatgaatcccaagtcatgatgtgaatcagttcagttcagcaagcactgagctcccaygatataacaggtttttttcttttccgagctgtggcccatgcagagtttactgagacttggctcttgcctttatgctttaaggatcctaaagagaagatgt

SEQ ID NO: 8532 - DNA, 201 bp, Homo sapiens
agttttccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataa

SEQ ID NO: 8533 - DNA, 201 bp, Homo sapiens
atgctaatagtaatgatactagtaataaaatcaggataatgctgtttttaattcaccacactgtatgccatttgcttaaaatcagaaaggactcatcggtraggagtagggtggtagtatcattttggtctgcctttcacccccacaagacaacatccttaacagcagctatgttgaaggtttaggagtgcttgtcattag

SEQ ID NO: 8534 - DNA, 201 bp, Homo sapiens
ccaagcaccttggataggcaatgggaaatgttcacaacgttcccatttttacctataacagcagtagcaataatgctaatagtaatgatactagtaataaratcaggataatgctgtttttaattcaccacactgtatgccatttgcttaaaatcagaaaggactcatcggtaaggagtagggtggtagtatcattttggt

SEQ ID NO: 8535 - DNA, 201 bp, Homo sapiens
cctcattacctatagaataactccaaactttctgatgattaagtgagatatcatgtaaagtaccaagcaccttggataggcaatgggaaatgttcacaacrttcccatttttacctataacagcagtagcaataatgctaatagtaatgatactagtaataaaatcaggataatgctgtttttaattcaccacactgtatg

SEQ ID NO: 8536 - DNA, 201 bp, Homo sapiens
agagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttatttta

SEQ ID NO: 8537 - DNA, 201 bp, Homo sapiens
tgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaattt

SEQ ID NO: 8538 - DNA, 201 bp, Homo sapiens
ttgtatgtgggcccatttgccatgtgtgtgtgtgtgtctgtctatctatctatctatgtatatatatatatatatatatatatatatatatatatatatatagttataatgtggtgggttctcgaatcacagttgtaattcacatttttctccaccaattctgataacttgcattaagaaattgactgtgtaagttaaatt

SEQ ID NO: 8539 - DNA, 201 bp, Homo sapiens
aaaaaaagtctgattgcaactacgtgtttgggaatcagggagactatggaagaacaatctcagatctcagcttgaggctccacttgcaatatcacaatttytaaaacatgttgtatgtgggcccatttgccatgtgtgtgtgtgtgtctgtctatctatctatctatgtatatatatatatatatatatatatatatatat

SEQ ID NO: 8540 - DNA, 201 bp, Homo sapiens
gaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaag

SEQ ID NO: 8541 - DNA, 201 bp, Homo sapiens
gagacctcccagcaggggttgccagagaacttacacaggagcgtttctgctggaatcagctcgatgcctcttgaggacagagactcccagaggaaggagcrggcagccatccttgctgtgctgcagcctccacaggtgacacctcctggtgtgggagggacccaggtgaacagggtctggagtagacccccagcaaactac

SEQ ID NO: 8542 - DNA, 201 bp, Homo sapiens
gccactatgcccagctaatttttgtagagatggagtttcaccatgttggccaggctggttttgaactcctgggctcaagtgatccacccaccttggcttcscaaagtgctgggattacaggcatgagccaccatgttcgaccccatttttataaatgtaaaattaacttaggtttaaactattaatacacaaggttgagaa

SEQ ID NO: 8543 - DNA, 201 bp, Homo sapiens
agagagactgtattccattttatttttatttatatttatttttgagacagagtcttgctctgtcacccaggttggagtgcagtggcacaatctcggctgamtgcaacctctgcctcccgggttcaagcaattctcctgcctcagtctgccgactagctgggactacaggcacacgccactatgcccagctaatttttgtag

SEQ ID NO: 8544 - DNA, 201 bp, Homo sapiens
gtgccaaaaataagaatctttaagaactcataaagtaatttagcaccacgttaataaaagaagcaccattttgaattagttctgtaagtatgtgtttgagktagaaatagagttttaaaaaactgtctgttcatatagttcatctgcttaataagtaaacagctctttcaaatcaccaagctcaaataaaacaaacaaata

SEQ ID NO: 8545 - DNA, 201 bp, Homo sapiens
ccgggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctc

SEQ ID NO: 8546 - DNA, 201 bp, Homo sapiens
gtactttaaaatcgagtgtggctgtgtttgtcagtcgtggtttgtgttctttgatttgttctgcatgttcttcttttggagaggatgtgtcactttgccartcttggtccttgctgttgtctggtggagggaaacaagcctgccaggccggctcatctgacccctggtggcagggagtggaggtgcactcaggatgctctt

SEQ ID NO: 8547 - DNA, 201 bp, Homo sapiens
ttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtttcttcactt

SEQ ID NO: 8548 - DNA, 201 bp, Homo sapiens
gcctgggaataggatggcaggtcgtgggaccagcattttaattacctaaagggaacttattgattttagtccagaacacggtggggaggagttcatattcwtttttttttttgagtctggattttagaataaattcactgtgtacatagctattccatctttaaaaacctttgtgaatgttaatatacagcctttataaat

SEQ ID NO: 8549 - DNA, 201 bp, Homo sapiens
cgatctcggctcattgcaagctccgcctcccgggttcatgccattcttctgcctcagcctcccgagtagctgggactacaggcgcctgccactacacctgkctaatttttttgtagttttagtagggatggggtttcaccgtgttagccaggatggtctagatctcctgacctggtgatccgcctgtcttggcctcccaaa

SEQ ID NO: 8550 - DNA, 201 bp, Homo sapiens
tcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctgc

SEQ ID NO: 8551 - DNA, 201 bp, Homo sapiens
ttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcctg

SEQ ID NO: 8552 - DNA, 201 bp, Homo sapiens
cttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcct

SEQ ID NO: 8553 - DNA, 201 bp, Homo sapiens
gcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctcc

SEQ ID NO: 8554 - DNA, 201 bp, Homo sapiens
tgcttcttatgtgattcttactggtctattatttatcaagaaattaaaaaggaatgaatatctgtagctgtttttctttttctttcttttcttttcttttctttttttttaagatggagtctcgctctgtcaccgggctggagtgcagtggtgctatttcggctaactgcaatctctgcctcccgggttcaagcaattctc

SEQ ID NO: 8555 - DNA, 201 bp, Homo sapiens
catgttgcctaggctggtctcgatctcctgggctctagcaatcctcccacctcggcctcccaaagtgttgggattacaggcgtgagctaccgtgcccggcsttacgtttcagcatctttcaatccatctaatacgcagtgccagggaaggtttgtgaaaacatttgaatcacagagtcacaaacagtgagaatagctgcag

SEQ ID NO: 8556 - DNA, 201 bp, Homo sapiens
cgatggtagtttctgtttttggagtctctgtaggtctcagactcacagtctgtacttcttgttttgggggctaattaagtggacagtttcagtgttggtasctcatttaagccataaacatgcagaccatgtggaatcccattagtcaaaccttagcagagtgccttgatgagtacctccttttctttctgaattctatta

SEQ ID NO: 8557 - DNA, 201 bp, Homo sapiens
tgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatat

SEQ ID NO: 8558 - DNA, 201 bp, Homo sapiens
ggggaaacctgttggtcccctcataaaacagttaacaggaagcccaaggcatctttcagtgccatttttggctgatgtttggaatggttccatcaatcacygctgttcatgtatagctggtttttatgtcagttaaaccatcttccatcaagttggtgaagcagagtcagggaacaagatgaatagcaaaacgtcttctgt

SEQ ID NO: 8559 - DNA, 201 bp, Homo sapiens
tggactctgtgggtagagacatggatatttttccttttataagaaaggtcttgtctttcctcagaaggcattgtgagcaaaataagggaagaaaaagagamgtagataagaaaaacaaatcacaatattgaagcaggacccgagtactatagccttcctcatattttggtatctggaaccgaggttgctaattaatgaccc

SEQ ID NO: 8560 - DNA, 201 bp, Homo sapiens
agacatggatatttttccttttataagaaaggtcttgtctttcctcagaaggcattgtgagcaaaataagggaagaaaaagagacgtagataagaaaaacraatcacaatattgaagcaggacccgagtactatagccttcctcatattttggtatctggaaccgaggttgctaattaatgacccaagagctaagccttgt

SEQ ID NO: 8561 - DNA, 201 bp, Homo sapiens
tctcatgggcttgccttattttttcagggcatgctctgtctccatcccttggctctgctttccttacattggtcttcttgggcatccgtcttccattccayagtgtagcaagccagaagctgggggaaacatggtgcgtgcctgtaatctcagctactcgagaggctgaggcaggagaatcacttgaacccaggagatgga

SEQ ID NO: 8562 - DNA, 201 bp, Homo sapiens
tgctctcccgagccttctctcctctctggaacccatggctaataggggacaggagagagcggaagcagaaagaataagagatatgaaagccagccgggcayagtggctcacgcctgtaatcctagcactttgggaggccgaggcaggcagatcacttgaggtcaggagttcgagaccagcctggccaacatggtgaaaccc

SEQ ID NO: 8563 - DNA, 201 bp, Homo sapiens
gcggtgggctgggcaggaaaaccataaccacctgcaaatgtcatgtggtttatatcacaccttcacttaacaccctccccctaacaacctctacctggcartcttcatttaactccaaactcaggacctcaatcctctgtttggcctgtgttccacgggacaggcatggggcacagatgtctgttatatataagggacaaa

SEQ ID NO: 8564 - DNA, 201 bp, Homo sapiens
gggacagcgtgtagggtttgcatgatttgtggggccgtttcatgtttgcacggtttggcttggcttgggactctgccagtggtcactgcagtttaacaaaytccccccgggtgtgaaggaaagcgagataaatgcaggaaaaaggatacattttgaaatctggaaattttacataacaggcatcagatttgaagaatgtcc

SEQ ID NO: 8565 - DNA, 201 bp, Homo sapiens
tctccgaactctcattaatttttcacaggcttgtgatggatagtttttatttattcacgtctgagattccgttgtgtgaaaaggactcattttataacatwacatattcatggcttgggatggatgggataaggaacttattattaatgtgtcactgtgggaaacttactctagttcatttgcgaaccttgttaaattcgg

SEQ ID NO: 8566 - DNA, 201 bp, Homo sapiens
tgtgctttaagactgtaaaattttagcccattaaaaataaaatctgttgctttccacccacacctggcaatttggtgagggacgggggctaggatatttamtgtctgaaagttttagggaggcttttatgaactgggccatctctccttgtccccatttttctttgcatctccgaactctcattaatttttcacaggcttg

SEQ ID NO: 8567 - DNA, 201 bp, Homo sapiens
attggtcctgctgtcctgggacccaggtgtgagtgcatagggaaaagggaggagaaatttaatcctgtaactatctccttatggaaaacaggaaaccacaratgaatcaaatgaatccgtttcccctctttctgatcctctgcaaaagtcatcaaaatcactctgttctcaccaggcaactggagtttcgtcagctgagtc

SEQ ID NO: 8568 - DNA, 201 bp, Homo sapiens
accgggtctggagtgcaacagaggcccctgaccttgtctctagctctctgtctgcatcttcagcgtggcttcactggtttctaagtctctggtgtcttttktcttttgcagccggcttgcaattgcctccttctaactctcaaaaggatgcatgggatgggttcagtgtagtcactgttgtgccttttggacaaggctttc

SEQ ID NO: 8569 - DNA, 201 bp, Homo sapiens
aaatgtcatgtggtttatatcacaccttcacttaacaccctccccctaacaacctctacctggcaatcttcatttaactccaaactcaggacctcaatccyctgtttggcctgtgttccacgggacaggcatggggcacagatgtctgttatatataagggacaaatctctgggttggtcactcctggattccccagcccg

SEQ ID NO: 8570 - DNA, 201 bp, Homo sapiens
cacctccctacagtccagtggtggcggtgggctgggcaggaaaaccataaccacctgcaaatgtcatgtggtttatatcacaccttcacttaacaccctcsccctaacaacctctacctggcaatcttcatttaactccaaactcaggacctcaatcctctgtttggcctgtgttccacgggacaggcatggggcacagat

SEQ ID NO: 8571 - DNA, 201 bp, Homo sapiens
gtaatgctgaatgattgtgaatgattgtgaatgtttgtttattcggggtactccctcaaatttcttatccagtggtgtctagaacatgttgggattttgtktgatagtttcttgagttggaaattgcgtttctttggcctcccatgtgggtatcaatgagttttacatggtttaaaggccagttatgtgatggatacttct

SEQ ID NO: 8572 - DNA, 201 bp, Homo sapiens
tgcaaagacaggcgctgctctctggcagggacagcgtgtagggtttgcatgatttgtggggccgtttcatgtttgcacggtttggcttggcttgggactckgccagtggtcactgcagtttaacaaactccccccgggtgtgaaggaaagcgagataaatgcaggaaaaaggatacattttgaaatctggaaattttacat

SEQ ID NO: 8573 - DNA, 201 bp, Homo sapiens
tgggaatctcaagttcccaggagccaaccacaagagcttcacagctcagaattttcaagatgtggatgtaggcagggagcctatgtagtaattcaagtaarcatctcttcttcttgttttccttataggatgatagaaggtcagtgcttgttcaccccagtgaggtggagcctctgaggtgggaggttttctctcatcctt

SEQ ID NO: 8574 - DNA, 201 bp, Homo sapiens
cattgttacatcctacaagcgtgcttacctgcatcaccttgctgggctgtttcagcattggaatatcactgggaatctcaagttcccaggagccaaccacragagcttcacagctcagaattttcaagatgtggatgtaggcagggagcctatgtagtaattcaagtaaacatctcttcttcttgttttccttataggatg

SEQ ID NO: 8575 - DNA, 201 bp, Homo sapiens
cagggacagcgtgtagggtttgcatgatttgtggggccgtttcatgtttgcacggtttggcttggcttgggactctgccagtggtcactgcagtttaacaractccccccgggtgtgaaggaaagcgagataaatgcaggaaaaaggatacattttgaaatctggaaattttacataacaggcatcagatttgaagaatgt

SEQ ID NO: 8576 - DNA, 201 bp, Homo sapiens
atgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatga

SEQ ID NO: 8577 - DNA, 201 bp, Homo sapiens
tttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgatgggtgcttgcctggaagtgcgagcaattgatcagctgatgaggggtatttattatctgtc

SEQ ID NO: 8578 - DNA, 201 bp, Homo sapiens
aacttcctcttctgaagccagttccccccgaccatcagtcatgagtccgttcttttaaccttgttcaggtggcgtggggcggtgtgtttggtggggagtgmtgggtgcttgcctggaagtgcgagcaattgatcagctgatgaggggtatttattatctgtccctgactcccgagagaggaaataaatccttggaccccag

SEQ ID NO: 8579 - DNA, 201 bp, Homo sapiens
gggggcctggaaggggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggaggga

SEQ ID NO: 8580 - DNA, 201 bp, Homo sapiens
tctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaaca

SEQ ID NO: 8581 - DNA, 201 bp, Homo sapiens
gctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcaga

SEQ ID NO: 8582 - DNA, 201 bp, Homo sapiens
accccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaag

SEQ ID NO: 8583 - DNA, 201 bp, Homo sapiens
tgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaa

SEQ ID NO: 8584 - DNA, 201 bp, Homo sapiens
tgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgag

SEQ ID NO: 8585 - DNA, 201 bp, Homo sapiens
gtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtccc

SEQ ID NO: 8586 - DNA, 201 bp, Homo sapiens
taggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccc

SEQ ID NO: 8587 - DNA, 201 bp, Homo sapiens
tgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaag

SEQ ID NO: 8588 - DNA, 201 bp, Homo sapiens
catcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgttt

SEQ ID NO: 8589 - DNA, 201 bp, Homo sapiens
taaaacgtggatgttccaatttatgtatagccgcataatacattaccccaaaacttagaggcttaaaacaacaaccattttgttttatcttgtgatttctstaagttagggctcagtggagtgactcttctgccccttgtggtgttgactggggtcagtcagtggtgctatgctggaggatgaattggactggcacttcag

SEQ ID NO: 8590 - DNA, 201 bp, Homo sapiens
tggatgttccaatttatgtatagccgcataatacattaccccaaaacttagaggcttaaaacaacaaccattttgttttatcttgtgatttctctaagttrgggctcagtggagtgactcttctgccccttgtggtgttgactggggtcagtcagtggtgctatgctggaggatgaattggactggcacttcagctggtcc

SEQ ID NO: 8591 - DNA, 201 bp, Homo sapiens
atgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagta

SEQ ID NO: 8592 - DNA, 201 bp, Homo sapiens
gtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattg

SEQ ID NO: 8593 - DNA, 201 bp, Homo sapiens
gcactttttctgtttttgatgggatttatcacttgaaaatgcatattatagtaatttctgaattcatcctgattctcctactggtttctaaactcttcagkttagaattcctgttggatatccctctggcccgaaattcctgaatgagttaagcaggacacctagaactatgcagaggtaataccttccttgacctgtccc

SEQ ID NO: 8594 - DNA, 201 bp, Homo sapiens
tgatgggatttatcacttgaaaatgcatattatagtaatttctgaattcatcctgattctcctactggtttctaaactcttcaggttagaattcctgttgratatccctctggcccgaaattcctgaatgagttaagcaggacacctagaactatgcagaggtaataccttccttgacctgtcccttttctgggtcagttt

SEQ ID NO: 8595 - DNA, 201 bp, Homo sapiens
cttgaaaatgcatattatagtaatttctgaattcatcctgattctcctactggtttctaaactcttcaggttagaattcctgttggatatccctctggccygaaattcctgaatgagttaagcaggacacctagaactatgcagaggtaataccttccttgacctgtcccttttctgggtcagtttgcccttcatgatttc

SEQ ID NO: 8596 - DNA, 201 bp, Homo sapiens
tctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagtt

SEQ ID NO: 8597 - DNA, 201 bp, Homo sapiens
aagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctc

SEQ ID NO: 8598 - DNA, 201 bp, Homo sapiens
agatctcactcactgtggtgaagacagcgccaagccatgagggctccgccccagtgattcaaatacctcccattacggacatgtttcaacatgagatttgrgcggggacaaatatccaaactatatcaggatcccagcagactgggtgggtggaggttcagggatatctgggaaggactaagaatagctttttcttttagt

SEQ ID NO: 8599 - DNA, 201 bp, Homo sapiens
tctcactcactgtggtgaagacagcgccaagccatgagggctccgccccagtgattcaaatacctcccattacggacatgtttcaacatgagatttgagcrgggacaaatatccaaactatatcaggatcccagcagactgggtgggtggaggttcagggatatctgggaaggactaagaatagctttttcttttagtaga

SEQ ID NO: 8600 - DNA, 201 bp, Homo sapiens
tgcaagagtcagcaaagtttctctgtgatgggatatttaataaatattttggggccttgtagtgtttgttgccaactactcaactctgccctcatagtgcraaaacaggcataaacgatatgtaaaggagcaggcatggctgcgagaaactttatttatggatactggaatttgaatttcatatacattttcatgtgtcac

SEQ ID NO: 8601 - DNA, 201 bp, Homo sapiens
ttctctgtgatgggatatttaataaatattttggggccttgtagtgtttgttgccaactactcaactctgccctcatagtgcaaaaacaggcataaacgayatgtaaaggagcaggcatggctgcgagaaactttatttatggatactggaatttgaatttcatatacattttcatgtgtcacaaaatattattctttccc

SEQ ID NO: 8602 - DNA, 201 bp, Homo sapiens
acagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccgaatggggctgccactggcagacgagcactgtcccatcttggc

SEQ ID NO: 8603 - DNA, 201 bp, Homo sapiens
attcagagcttaaatatgtcatcgaggtcccctctttatttattcccttagttttgatgatcttttatgggttatattcttcaaagggaaaattctctccraatggggctgccactggcagacgagcactgtcccatcttggcttgttcccccagtgacaagaagctgttttccccactacccttggcccaaaagccacag

SEQ ID NO: 8604 - DNA, 201 bp, Homo sapiens
tcgaggtcccctctttatttattcccttagttttgatgatcttttatgggttatattcttcaaagggaaaattctctccgaatggggctgccactggcagrcgagcactgtcccatcttggcttgttcccccagtgacaagaagctgttttccccactacccttggcccaaaagccacagggagaaccaggattggcctag

SEQ ID NO: 8605 - DNA, 201 bp, Homo sapiens
tttaggcagacacctatccctgaatcagtcatgtccccggatgatgcggttctctgcagcctgggcagtcaaggctggagataattctctgcttctccacrgagtctgagaggccccgttccctaatggaaaaatgaggtccaattttgcaaaaggaggcacctggggaaacattctggacacacaaatctatagcttcta

SEQ ID NO: 8606 - DNA, 201 bp, Homo sapiens
catgtccccggatgatgcggttctctgcagcctgggcagtcaaggctggagataattctctgcttctccacagagtctgagaggccccgttccctaatggwaaaatgaggtccaattttgcaaaaggaggcacctggggaaacattctggacacacaaatctatagcttctaccgtcaatctgctatgatccttttatggt

SEQ ID NO: 8607 - DNA, 201 bp, Homo sapiens
aattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaa

SEQ ID NO: 8608 - DNA, 201 bp, Homo sapiens
taattaattagcaaaaacttatctttggaatgcttcaagaaacagttctatgttgttctcataacttaattttacacaactgtcttttgtttgtatcttamagaaaacaaaataccaccctccgccagaaaagtgcagaataaaaattttccactagcaaaagaaggaaaaaataaaagatcttgaatagtctcatcaatt

SEQ ID NO: 8609 - DNA, 201 bp, Homo sapiens
gaatttgttaattaattagcaaaaacttatctttggaatgcttcaagaaacagttctatgttgttctcataacttaattttacacaactgtcttttgtttktatcttacagaaaacaaaataccaccctccgccagaaaagtgcagaataaaaattttccactagcaaaagaaggaaaaaataaaagatcttgaatagtct

SEQ ID NO: 8610 - DNA, 201 bp, Homo sapiens
tttgaaatctggaaattttacataacaggcatcagatttgaagaatgtccaaaatattacgagtcatagcacaacctttgctaacaccatggaaatttttraacatggaatttgttaatgctgacttggcccaccatggggttaaaaaaagtgaatttctttttgataaccaaggtgatgatcttatgaagttgatgatgg

SEQ ID NO: 8611 - DNA, 201 bp, Homo sapiens
aaaaggatacattttgaaatctggaaattttacataacaggcatcagatttgaagaatgtccaaaatattacgagtcatagcacaacctttgctaacaccrtggaaatttttaaacatggaatttgttaatgctgacttggcccaccatggggttaaaaaaagtgaatttctttttgataaccaaggtgatgatcttatga

SEQ ID NO: 8612 - DNA, 201 bp, Homo sapiens
tgaaggaaagcgagataaatgcaggaaaaaggatacattttgaaatctggaaattttacataacaggcatcagatttgaagaatgtccaaaatattacgartcatagcacaacctttgctaacaccatggaaatttttaaacatggaatttgttaatgctgacttggcccaccatggggttaaaaaaagtgaatttctttt

SEQ ID NO: 8613 - DNA, 201 bp, Homo sapiens
cctcaaatccttctggaagtaggttggttatgaattatgaataattaaagaaataaactctggctctgcagctgaaattgggatcgcatggagaaaatagmaagtccagtgtttgtagctgtgatctctcagttgcttgcatgaattgtgctttaagactgtaaaattttagcccattaaaaataaaatctgttgctttcc

SEQ ID NO: 8614 - DNA, 201 bp, Homo sapiens
gtgagcatccagcaagtggttttgacaatgataataattataacccaagcgacacatacaatttaatcaggcactgtgtgtccacagcgatgtcaaggaamaatgcacaaagcagagtttttccagtctcctgatgtttgagccctgcgcgagccccactcttctcccttttctcataactgctgtgagcaacctcaaatc

SEQ ID NO: 8615 - DNA, 201 bp, Homo sapiens
ttctcccttaatgcctcatgaatgcccaagcagcacttcatggaagtacactgagtctctactgcttgcagggattaaacataacattctcaacagtggtragagagcctttcccttctctttggctcgttttcagtttttattaatttcctgtgcttctggttcatgaatcccaagtcatgatgtgaatcagttcagttc

SEQ ID NO: 8616 - DNA, 201 bp, Homo sapiens
ttctccgcctgctgtgccttcctatagtgtagctccaattgccttcatccttagaagacctttaatgatatcctatgccaaacttcctagcctccacctgkaccctgaattggccctagcctagttttccaaactttatccccaggtggttgaactttctaagtttccccaagctgatcagtgttttggggtggtatggaa

SEQ ID NO: 8617 - DNA, 201 bp, Homo sapiens
tcttgcttccgtcacctcgtgctttgaaacataaccacaatgtgctgaggtttcacattgttacatcctacaagcgtgcttacctgcatcaccttgctggsctgtttcagcattggaatatcactgggaatctcaagttcccaggagccaaccacaagagcttcacagctcagaattttcaagatgtggatgtaggcaggg

SEQ ID NO: 8618 - DNA, 201 bp, Homo sapiens
ctgaaataagtggacacatactccaccatccccaggtagtgtacagtgtgtgccctttcaggctagtatgtacagctttaaatcattcctttacagagctrtgtaatattccacaacccagaggagcagcttgaagccagctaaagtatgtatatccaagtggaattaagagcttcatgcgtagtttcttgattttgatta

SEQ ID NO: 8619 - DNA, 201 bp, Homo sapiens
tcttggttttagatttttttaattataaaagaacattattatacattatttgaataattttttaaaattatagagctgtctaaaggaggcattaaaaaaascctttctattccttcatctaattctatccctctgaggcaaccatgattagtattttgtacttcttgtacatcctccttcatgttaatatagatgtacaca

SEQ ID NO: 8620 - DNA, 201 bp, Homo sapiens
tctctgttagatacagtgtatctctgttagatacagagcattctgttagatacagagaatctctggtagatacaaagtattctgctattctgatcttcctkttagaagatcagatttacagaagtctacatttgctctcaagggaccttcagtctgtttggagcaatctctttattaatttatttattcagtaaattttat

SEQ ID NO: 8621 - DNA, 201 bp, Homo sapiens
taatgaccctctcctggcctcaattaactgaggccaggagagggtcattagcaaactgtcctttgctaaatgggactaatgggaagaatagtgtctgccawataaggtggttgaaggattggatgagactgacatttcatttgcatttagtgaatacttgttgaatgactgaatgaatggttgatgtacagaaacatgaac

SEQ ID NO: 8622 - DNA, 201 bp, Homo sapiens
ttggtgagaaaggaaatttttgctccaataaactgggtagctcagtccaggagagaaatgtactggactcagacttggaggacagagctttgtgaccctcstaggcaatgtaatgaccctctcctggcctcaattaactgaggccaggagagggtcattagcaaactgtcctttgctaaatgggactaatgggaagaatag

SEQ ID NO: 8623 - DNA, 201 bp, Homo sapiens
agaaactatattgccgagaaagagaaatgtaaattccgctggataaattagcgtttgcggttacttctctctttgttgcttaagcagaggagaaacagaartcatagcaaagagagaggtagctgcaaaagctaatttatccaaaagaatttacatttttctctcttggcactatagggggcatgtttactctcctgatgt

SEQ ID NO: 8624 - DNA, 201 bp, Homo sapiens
tcctgggctctagcaatcctcccacctcggcctcccaaagtgttgggattacaggcgtgagctaccgtgcccggccttacgtttcagcatctttcaatccrtctaatacgcagtgccagggaaggtttgtgaaaacatttgaatcacagagtcacaaacagtgagaatagctgcagttatgtttgtgatgctctaatgaac

SEQ ID NO: 8625 - DNA, 201 bp, Homo sapiens
ggtgtggaaatactctacctgggtgaggctctcgtggctttttgtgccaagtgtccgtaaacttcaacttaattgttttaaatcctttgtggtgattatgyggaaggtcaaatctaacaggaagctccatgtccacttgatgtgtacttacttctatttttgcaccttgtgttgtttgttatcctgaattatgccagggct

SEQ ID NO: 8626 - DNA, 201 bp, Homo sapiens
gacagatatgtcattgaagtttcatccttcttcatttcagagtctgctggaagacccttcatttaccactctctccttcctggaggtgtggaaatactctrcctgggtgaggctctcgtggctttttgtgccaagtgtccgtaaacttcaacttaattgttttaaatcctttgtggtgattatgcggaaggtcaaatctaa

SEQ ID NO: 8627 - DNA, 201 bp, Homo sapiens
gaattgggtaaggatccagctgattttctccagatgagtagttcattgtcccaacaccagttattgcaataagttattccttccccaggaaatatacctgrgctaattaagaaaactgtgcttcaatgtaattattccaccttaatgcatgaaatattaggttaacatggaaaaaacatggcatcccatgttttagtattt

SEQ ID NO: 8628 - DNA, 201 bp, Homo sapiens
tatgtatgtatatgtgcatacacatacattgttttgtatatatttgtcagatggaggtgtgtgtaaacaaataacagaaatgagttaaaattgacaagttrgcttggtaaacatcttgatttataatttattaaaaactacgtgggtatgtatatacatacagacacacacacttcttcaccacctgaacaaaaatccctt

SEQ ID NO: 8629 - DNA, 201 bp, Homo sapiens
cagtgtgtaaaatcatggcggtgccaagagggggtgtgatgggtgtggccgcccccctgccagcaggaggaatctgttttcactgacattgtttggaatcrccaagcatggtgatgataaaaagcagttaaactttggtcacttttattaatacttttaagtccttagcgaacaatgcacccgttattacttgcacctagt

SEQ ID NO: 8630 - DNA, 201 bp, Homo sapiens
gcatggaaaaggctttgcttttaaatgcccgtgttgatttcttaatattttcaacttcctcttctgaagccagttccccccgaccatcagtcatgagtccrttcttttaaccttgttcaggtggcgtggggcggtgtgtttggtggggagtgatgggtgcttgcctggaagtgcgagcaattgatcagctgatgaggggta

SEQ ID NO: 8631 - DNA, 201 bp, Homo sapiens
gcatttgtacaggagaactacttaatggcacagtttgttattacatggaattaaatacaacctatttaaatcatgtaccgtgaaaccaaagagctgtgtayggaaaaagcctcatataacccagtttgccaggtcctaactcccttcatacatatactaacatgcaaaagacctcctaccttttttttccccttctgtttc

SEQ ID NO: 8632 - DNA, 201 bp, Homo sapiens
aattgcaggttaagccctcattttgatctctgggatgagagcaagcaccgtttcattgacatgtcatcagctatgatctgagggagcacacagaggtgccytttggggaaagaggggcatcttgcacttgtctcccacattgaaagggtttattgcacagtgagtgtgtgcaagtgaacaaatagcagatgggttagaatg

SEQ ID NO: 8633 - DNA, 201 bp, Homo sapiens
ggaaaggattaagtgcagtgatcaatcagcagcaaagtcctggaagaaacccatttgttagtctctgggcctccccaggccttatcagggcttagccttckagcagtagcaacacttgcacctgcagttactaattcctgtggaatgaagtaggcgggcccgaaatgtacagcccttatccagtgaattctcataggagca

SEQ ID NO: 8634 - DNA, 201 bp, Homo sapiens
gtaaggtttagtcaagaagttggaaattaatggggaaggaaggttttgggttatgtgtggatttcatttatccatgctatctcttccctccattagcatgkttaattaagagttgtcaatacatctttgttggagtatttgattattttttcaacagggaagattagaatgaagtcttcagatctggcaagtgtcatggga

SEQ ID NO: 8635 - DNA, 201 bp, Homo sapiens
gttagtgcatattcttggctcaagcaggataagacactagtaaccatgaacctgtatatcaaaaagcgtgactagagtttcatagttaaacatgtgctgawatccacagtggacaccagagagggtcatggaatctgggaatggatgacttgtcccatgatgataatatctgtgttcctacggctgggcccggtggctcac

SEQ ID NO: 8636 - DNA, 201 bp, Homo sapiens
tcaaaaaaaaaaaaagagaaagaaaacagattaatacaatgatctgtgagatattgggactgttcttattcccatttcacagatgagccactaactggctyctggcaggacagtgaataaggggcacaacagagacacaaacacatggctaaccaatggtctcatccgtcagccacactgcctgtctcagcatgggccctg

SEQ ID NO: 8637 - DNA, 201 bp, Homo sapiens
ggccaggagtttgagaccagcctggccaacatggtaaaaccctgtctccactaaaaatacaaaagaaattagctgggcatggtggcaggtgcctgtaatcycacctacttgggaggctgaggcaggagaatcacttgaacctgggaggtggaggttgcagtgagccgagattgcaccactgcactccagcctgggtgacaa

SEQ ID NO: 8638 - DNA, 201 bp, Homo sapiens
tgaatgttaatatacagcctttataaatttgaggtataatgttcaaaatgctctaatccctaaattttccagtctaggttattatacttttatgactattmattttgatgtaggccttttaaaatcaattcctccctgttattacaatgctgctttatggtatttgtgatatatcatgtgaatatacttgagggtcatgag

SEQ ID NO: 8639 - DNA, 201 bp, Homo sapiens
aggataaaatcctatgcagtttacagaaatgtaaactaagtgcttcgttaaatgaatcctagatcccgtgccttctgactgggtgagacctcccagcaggsgttgccagagaacttacacaggagcgtttctgctggaatcagctcgatgcctcttgaggacagagactcccagaggaaggagcgggcagccatccttgct

SEQ ID NO: 8640 - DNA, 201 bp, Homo sapiens
atggctaaccaatggtctcatccgtcagccacactgcctgtctcagcatgggccctgtgtggaccattccatctcaatttgtttctgattcttgtcaattmaataagaacagctgaaaagtaaaataataaatatatacataaaaacaatggggggagtaataatgataatagatacaattttttggtctttataatcccc

SEQ ID NO: 8641 - DNA, 201 bp, Homo sapiens
ccagcatgtgatcatacatctacctaacctctcccattggttgaatttaatatactagtgaattttccattgcaaagatgaggttacgaatcatagtgttsatactcagaaggactttataaatattttgcctttttgaagtatatacaagaaatgaaaaaaaaaacaggaataaataaaaagaataaaaagagccaggac

SEQ ID NO: 8642 - DNA, 201 bp, Homo sapiens
aaacactagttctgcaatttcccaacacctgccccctgccccttataaaagctcatggttccatgtgactttccactcctgcgtctctggccttggggcargtcagtccgtggatcacctcactgtcctagggatgctcttctggtccacactgtgcctaccttggatatggagttccacttgttcccttacctttcaccc

SEQ ID NO: 8643 - DNA, 201 bp, Homo sapiens
agcctcttgtcgaggagtgcactgggaggggaggctggacttctgggctctgctctgcctctaatctgctgcccagcatcagccttagcccagacccccaragttcctgggcttcattctgctttgcattcatctcaaagttaagccttctggctggcaggggtttctgagacagactgacagtattagcgtgctgcagtt

SEQ ID NO: 8644 - DNA, 201 bp, Homo sapiens
tcccattgcacttctcttcaagtttgcccagatagtaagttctactagacatgtcaattttttctgaggtctaatcttgatttttttttcctgcacaatayggaattcagtgtttttatttaatcattcagtaagtcttgactgcctgctatggaggttaagccctttactaagttccaaggatgtacctgtgaataaggc

SEQ ID NO: 8645 - DNA, 201 bp, Homo sapiens
ttttttttggcaagattaagtgagatcttccatttgacatgcctggctaattggcagtgcccaacagatagaaactattggtattgtaaggactgcttatygggtacatatgctgtgccatgggaggtggaggtgctgtcatgctgaacccctattaacctcaataggaaaggcaccaggttcaagagctgaagaagacac

SEQ ID NO: 8646 - DNA, 201 bp, Homo sapiens
tccttctcctcctcctcctctccttttcttttcttttcctttccttcttcttcctttcttcctttatttctttcttcctgtattattttcttgtatagctyaggtctcactgctttgctgccattcttgtggagaataataggtaacagaggtgtgcacctggcctcatttattgtcacactggataggtaatagacgccg

SEQ ID NO: 8647 - DNA, 201 bp, Homo sapiens
ttttggctgaagatgatcactttagctgaaaccagttcaggttcaaactcagacattggtgctattttcatatatctgaaatgttctgaaaagattactgrcgatcaacatgctgaactgacatttcacagatatgcagatttattcatctctgttcaaggtatgccttttccaatcataatagccatgtagaggacatta

SEQ ID NO: 8648 - DNA, 201 bp, Homo sapiens
cagagcttacaagttattcaacagccagatttctattctgatatgcccttttagttttcaaagcatcgaaaaagggtaatctttagaaccgaagtatttgsaaaactcctagacttgaataaggtatttttgaatttgaagagctaagaacccatcaaatcaaaatgctaataattcttccaagtcaaaaggtaactctca

SEQ ID NO: 8649 - DNA, 201 bp, Homo sapiens
gctgctttatggtatttgtgatatatcatgtgaatatacttgagggtcatgagaagttcatatgtgtgtgtgtagtgtgggccccagactttcgccacacygctggctaaagtggccatgtttttgtacgtctctgcagagcttacaagttattcaacagccagatttctattctgatatgcccttttagttttcaaagca

SEQ ID NO: 8650 - DNA, 201 bp, Homo sapiens
tgccttggcctcctaaactgccgggattacaggtgtgagccaccacacccagcccctctccctattttaatgcgaggtaattaacaaccttaatttcaccrgtaacctgaattctcctttgccacgcagtctaccatattcacgggtttcagggattaggacctggacatctttggttgggaaatgggcatcattttgtct

SEQ ID NO: 8651 - DNA, 201 bp, Homo sapiens
agaagcaccattttgaattagttctgtaagtatgtgtttgaggtagaaatagagttttaaaaaactgtctgttcatatagttcatctgcttaataagtaarcagctctttcaaatcaccaagctcaaataaaacaaacaaataatgggacaattggcaaaactctaaaaagtgatacaaaagaccaagggatatttgaaaa

SEQ ID NO: 8652 - DNA, 201 bp, Homo sapiens
aaaaaaaaaaaaagagaaagaaaacagattaatacaatgatctgtgagatattgggactgttcttattcccatttcacagatgagccactaactggctcckggcaggacagtgaataaggggcacaacagagacacaaacacatggctaaccaatggtctcatccgtcagccacactgcctgtctcagcatgggccctgtg

SEQ ID NO: 8653 - DNA, 201 bp, Homo sapiens
gaacacagccgtgtttggcccagcggttatagtttgccaacccctgcttagagtctagctttattcagagcttaaatatgtcatcgaggtcccctctttayttattcccttagttttgatgatcttttatgggttatattcttcaaagggaaaattctctccgaatggggctgccactggcagacgagcactgtcccatct

SEQ ID NO: 8654 - DNA, 201 bp, Homo sapiens
caggcatggctgcgagaaactttatttatggatactggaatttgaatttcatatacattttcatgtgtcacaaaatattattctttcccccccgcccccarccatttaaaaatgtgaagcatttttagcctgtgtgctgtataagaacacagccgtgtttggcccagcggttatagtttgccaacccctgcttagagtcta

SEQ ID NO: 8655 - DNA, 201 bp, Homo sapiens
gatttaatgccaacatgttcttttttggtattaacatattgcattggtgtgaaaactaaaatgccttcagcgatgatcttttcctttggaaaactagattmccactcggatgctacgaggggtaatctgtgctaagtttatggtgtgtctgccagggctctgctttaaaaaacaaaacaaacccttttggaggccttgaca

SEQ ID NO: 8656 - DNA, 201 bp, Homo sapiens
tcttttttttgagactggagtcttgctctgttgcccaggcaggaatgcagtggggtgatctcagctcattgcaagctccgtctcctgggttcacaccattytcctgcctcagcctcccaagtagctgggactacaggcacccgccaccaagcccagctaattttttgtaattttagtagagatggggtttcaccatgttag

SEQ ID NO: 8657 - DNA, 201 bp, Homo sapiens
cctaggaacagcctagaaggtgaatgatgcagcccagttgtttttattctgagtttggcaaaaatgatagagaagaaaatgtacttttatgtgttcgttcracagttaaagagtattccagattcctccctccaaaaaaaaaaaaaaaaaaaaaaaagggcatattccctagccaaggcccacatggcttttctttacttt

SEQ ID NO: 8658 - DNA, 201 bp, Homo sapiens
cccatgtctactaaaaatacaaaaaattagccgggagtggtggtgttcgcctgtagtcccagttactcaggaggctgagccaggagaatcgcttgaacctsggaggtggaggttgtagtgagccgagatcgtgccgttgcactccagcctgagtgacaagagcaacactccatctcaaaaaaaaaaaaaaaaaaaaaagga

SEQ ID NO: 8659 - DNA, 201 bp, Homo sapiens
ttattatgcattgaccaccattcactttctgttggactgcttttggaaaaagaaccacaagtctctatttttaaaatagaggtacaatgataaaacaaaasaaaacaaaacaaaaaaacaacaaaaaaaaaacccacacaggtctcatcagccaagggatttaaaaatcaaatttaacttcaaaaaactgaagttgatata

SEQ ID NO: 8660 - DNA, 201 bp, Homo sapiens
gcatggtctcagatccacttctaaggtcagtgtgaaagggaaggcaaattcactttgagcaggggaggcatgatctggaagataaagcagctaggagtatrgactagggggctgatggaggggaacacctatcacaatatgtgttctcacaccaatgatatatattttccacacatttagattctccatgccactccttat

SEQ ID NO: 8661 - DNA, 201 bp, Homo sapiens
gttattatacttttatgactattcattttgatgtaggccttttaaaatcaattcctccctgttattacaatgctgctttatggtatttgtgatatatcatrtgaatatacttgagggtcatgagaagttcatatgtgtgtgtgtagtgtgggccccagactttcgccacactgctggctaaagtggccatgtttttgtacg

SEQ ID NO: 8662 - DNA, 201 bp, Homo sapiens
agaaaatctggtgtagtggcttagctagcataacttttgagaggtctctgtgtgatggtcttttttaatgtctttcgtgaagaattcttcttttttttttytgagacaatgagttgttctgtcactcaggctagagtgcagtggcgtgatcatggctcactgcagtcttaacctcccaggctcaagcgatcctcctgcctg

SEQ ID NO: 8663 - DNA, 201 bp, Homo sapiens
aatgctgctttatggtatttgtgatatatcatgtgaatatacttgagggtcatgagaagttcatatgtgtgtgtgtagtgtgggccccagactttcgccayactgctggctaaagtggccatgtttttgtacgtctctgcagagcttacaagttattcaacagccagatttctattctgatatgcccttttagttttcaaa

SEQ ID NO: 8664 - DNA, 201 bp, Homo sapiens
aagtttgcccagatagtaagttctactagacatgtcaattttttctgaggtctaatcttgatttttttttcctgcacaatatggaattcagtgtttttatktaatcattcagtaagtcttgactgcctgctatggaggttaagccctttactaagttccaaggatgtacctgtgaataaggcaagttcctttttatcattg

SEQ ID NO: 8665 - DNA, 201 bp, Homo sapiens
gacaatggcctttatttttccttctacttaagggctctcacgttctagaatacatcttaccagcgattaattatgccttgagattgccaggagacgtagaygagcttttattgttttagccactgaatatacctctagataacacaatacatatttacagtgacaagctttgtattatttataggattatagcaaatcatc

SEQ ID NO: 8666 - DNA, 201 bp, Homo sapiens
gggtgtatttcgctgtatatgtgtaccatgtcagcttaccctagaatttgaaacattttcctttgatgattaaattttttttttttttttttgagatggaktcttgctcttttgcccaggctggagtgcactatcgcgatctcggctcattgcaagctccgcctcccgggttcatgccattcttctgcctcagcctcccga

SEQ ID NO: 8667 - DNA, 201 bp, Homo sapiens
aagcgattctcctgcctcagcctcctgagtacctgggaccacaggcacatgccaccatgccagctaatttttagtagagatggggtttcaccatgttggcsaggctggtctcaaactcctgacctcaagtgatctgcctgccttggcctcctaaactgccgggattacaggtgtgagccaccacacccagcccctctccct

SEQ ID NO: 8668 - DNA, 201 bp, Homo sapiens
catctaaatagtgcattgtctgttttcactcaggactttaaaaatagttctagtactaattgtatttttattctaatactgctattccttttactggtacytctgcatcttaaaaaaacaaaacaaaacaacgaaaacttggcatgttggctcacttggtgaatgaaagcatatactgttcagttgtttattcttcagcaa

SEQ ID NO: 8669 - DNA, 201 bp, Homo sapiens
tgggtccacatcagctccacattgcagactgaccccctggaccctcacgtctcaggatccctatctccctgtcagtgctttgtcacccaaagtcaccgcarctcctcttgagtgctttcaagatcagaccgaggggtcctagttcaagctaattcctacctgtgcgatcactagccaagtactgaacctctctgaacttca

SEQ ID NO: 8670 - DNA, 201 bp, Homo sapiens
tacgtctctgcagagcttacaagttattcaacagccagatttctattctgatatgcccttttagttttcaaagcatcgaaaaagggtaatctttagaaccraagtatttgcaaaactcctagacttgaataaggtatttttgaatttgaagagctaagaacccatcaaatcaaaatgctaataattcttccaagtcaaaag

SEQ ID NO: 8671 - DNA, 201 bp, Homo sapiens
tttttatcattgtctttgcagtctattaggggctacacaatttaaacagagaatatatataaaatggtagaaagtacaagtaagtataccttatttttttwaaaaaaatgaatgtggtatttcacccacagcctcaagaatcactttccttaaaattgccagagtaggaaaacttacaattgaagaatttcaggtatttat

SEQ ID NO: 8672 - DNA, 201 bp, Homo sapiens
cattgatacctgccttgcgttctgttacctggaagcacaggtcaaggtagtcttcttgttccactgatttgatgggggtcaggatgctttcagaaaggaartgagaagagtggcttagaacagggaaaatgtggccgggcgcagtggctcacgcctgtaatctcagcactttgggaggcctaggtgcgcagattacgaggt

SEQ ID NO: 8673 - DNA, 201 bp, Homo sapiens
tgttcaaaatgctctaatccctaaattttccagtctaggttattatacttttatgactattcattttgatgtaggccttttaaaatcaattcctccctgtwattacaatgctgctttatggtatttgtgatatatcatgtgaatatacttgagggtcatgagaagttcatatgtgtgtgtgtagtgtgggccccagacttt

SEQ ID NO: 8674 - DNA, 201 bp, Homo sapiens
tatttatgggaaaaatagtattagggcaattgcggtcaaacacattcgtctgttcgttcaattacagcagtaaggatggaagtctaaagagagtttctacrtgatcttatttatcctgcatttataaatacacaaattcttgtacaattaactcagtttttcactcctttcttgcttgcaacttgtcaggtcgttccctcc

SEQ ID NO: 8675 - DNA, 201 bp, Homo sapiens
atatgtcatcgaggtcccctctttatttattcccttagttttgatgatcttttatgggttatattcttcaaagggaaaattctctccgaatggggctgccrctggcagacgagcactgtcccatcttggcttgttcccccagtgacaagaagctgttttccccactacccttggcccaaaagccacagggagaaccaggat

SEQ ID NO: 8676 - DNA, 201 bp, Homo sapiens
aaaaaaaaaaaaaaaggacagggaaaatgtccaggaaggatgtggcttagctgaagatcagcttcagcttgatcccacgggaagctctggagggtgaattstacagcagagttggtcctgactgagaccagggcctggctgacctatggcagtcagcgatgagccagtgtctgctggggaagagggcggcgtggacatagc

SEQ ID NO: 8677 - DNA, 201 bp, Homo sapiens
aatacaaaaaattagccgggagtggtggtgttcgcctgtagtcccagttactcaggaggctgagccaggagaatcgcttgaacctgggaggtggaggttgyagtgagccgagatcgtgccgttgcactccagcctgagtgacaagagcaacactccatctcaaaaaaaaaaaaaaaaaaaaaaggacagggaaaatgtcca

SEQ ID NO: 8678 - DNA, 201 bp, Homo sapiens
atgtggccgggcgcagtggctcacgcctgtaatctcagcactttgggaggcctaggtgcgcagattacgaggtcaggcgattgaggccaggctggccaatrtgatgtgagaccccatgtctactaaaaatacaaaaaattagccgggagtggtggtgttcgcctgtagtcccagttactcaggaggctgagccaggagaat

SEQ ID NO: 8679 - DNA, 201 bp, Homo sapiens
aagagtggcttagaacagggaaaatgtggccgggcgcagtggctcacgcctgtaatctcagcactttgggaggcctaggtgcgcagattacgaggtcaggmgattgaggccaggctggccaatatgatgtgagaccccatgtctactaaaaatacaaaaaattagccgggagtggtggtgttcgcctgtagtcccagttac

SEQ ID NO: 8680 - DNA, 201 bp, Homo sapiens
ggaaatgagaagagtggcttagaacagggaaaatgtggccgggcgcagtggctcacgcctgtaatctcagcactttgggaggcctaggtgcgcagattacraggtcaggcgattgaggccaggctggccaatatgatgtgagaccccatgtctactaaaaatacaaaaaattagccgggagtggtggtgttcgcctgtagt

SEQ ID NO: 8681 - DNA, 201 bp, Homo sapiens
atgctttcagaaaggaaatgagaagagtggcttagaacagggaaaatgtggccgggcgcagtggctcacgcctgtaatctcagcactttgggaggcctagrtgcgcagattacgaggtcaggcgattgaggccaggctggccaatatgatgtgagaccccatgtctactaaaaatacaaaaaattagccgggagtggtggt

SEQ ID NO: 8682 - DNA, 201 bp, Homo sapiens
cgtcaatctgctatgatccttttatggttctgacgttgcagttttatttttgcatgtttctagagacatcaggaggggatcttttcgggatgtggcttcaraaaggagcctgttggatggtctcttactagtggtcagcaaagaacagttcttttgtaaattgcactgcattaagagcattcctgtttccatctcattgat

SEQ ID NO: 8683 - DNA, 201 bp, Homo sapiens
atatttaataaatattttggggccttgtagtgtttgttgccaactactcaactctgccctcatagtgcaaaaacaggcataaacgatatgtaaaggagcargcatggctgcgagaaactttatttatggatactggaatttgaatttcatatacattttcatgtgtcacaaaatattattctttcccccccgcccccaacc

SEQ ID NO: 8684 - DNA, 201 bp, Homo sapiens
gtcgatatgctagagtgatgtgaaaaaaataataaaagcgagatatttcatggcaaagcgatctcagggtaaacactgcacaccagtaagtattcttgggkcaaatgggaaaagggttaaaatgaccagatctccagagatctcactcactgtggtgaagacagcgccaagccatgagggctccgccccagtgattcaaat

SEQ ID NO: 8685 - DNA, 201 bp, Homo sapiens
aatgctacattttctcggatttgacattttcagtgatggagaactattatattttgtaaatggaaataccactactaaaaacagaaggctataaatagaaygatatccttcgtttccaaagtcgatatgctagagtgatgtgaaaaaaataataaaagcgagatatttcatggcaaagcgatctcagggtaaacactgcac

SEQ ID NO: 8686 - DNA, 201 bp, Homo sapiens
gaacagaactaacatcagaatcatctgaatcatcagaattgtgtattttggaaaaatcggattcatcaaatgaatcttcagccaacaactgttcgagaatkatgttaacatcacatgcaggaatgctacattttctcggatttgacattttcagtgatggagaactattatattttgtaaatggaaataccactactaaaa

SEQ ID NO: 8687 - DNA, 201 bp, Homo sapiens
gccagcgctcatttaattttacataaacatgctctttgaagctgaagcaaatgtgaccgattttcaaagtgataataaaatataaaaacagttcttggaawtatttctgaacagaactaacatcagaatcatctgaatcatcagaattgtgtattttggaaaaatcggattcatcaaatgaatcttcagccaacaactgtt

SEQ ID NO: 8688 - DNA, 201 bp, Homo sapiens
ggtaaaatcaacaagatttggccaacagctctgaaggggatgacaggcgtggtgaatggagaaggaaggacagaaggctagtttgggacttctggcttggmcagtgtattgtgtagtggaaccatcgctgaagataggaggagtccttttcagtcatactgaattcatgacgcctgtggggcacccaagtggaagtcatcc

SEQ ID NO: 8689 - DNA, 201 bp, Homo sapiens
atcctatgccaaacttcctagcctccacctgtaccctgaattggccctagcctagttttccaaactttatccccaggtggttgaactttctaagtttcccsaagctgatcagtgttttggggtggtatggaactcagaatagatcactttttttattgactaactctgaccataagtatgcttctgtgcgagcctgacctc

SEQ ID NO: 8690 - DNA, 201 bp, Homo sapiens
aggttgaaggaatgagtgcgtgtatcttgtcaaaggaaatcacaagcccatgtaaactcgctcttgcttccgtcacctcgtgctttgaaacataaccacartgtgctgaggtttcacattgttacatcctacaagcgtgcttacctgcatcaccttgctgggctgtttcagcattggaatatcactgggaatctcaagttc

SEQ ID NO: 8691 - DNA, 201 bp, Homo sapiens
tttttttttttttttttttttttttactttcaccaggtatttttttgtggagtatgcatttaattcacatttacaaattggtttctgtttttaactaaagrtactttttcagcagaaatgatgtgtatgatgtcatatctaacttgtgatctcactggtatttgatgttaagcctcaaaatcatcaaattttttttacggc

SEQ ID NO: 8692 - DNA, 201 bp, Homo sapiens
gtcgaagcagaaaggagttgcagcttctggccagtagaattaattatttattatccttttcataaatactttccgaggccgacataactgaaaattgctcrggctgtttgaaaacacacacacacagttttccagtggctaatttgaaaaatgtcaccgtattagttttcatttacatctgtcaggaaacatatctataca

SEQ ID NO: 8693 - DNA, 201 bp, Homo sapiens
atactgagatcctggtgtgcacaggaaaagagctaacctttgtggatgaaattgtagagtcactacctgcatttgctgtagctcttacaattattttattyttggaagacatcgagagcatggtccaaagctgcataggttgcaagtgggtagaggcagaatttctctccaggcctggtggattctaaagctgtttactct

SEQ ID NO: 8694 - DNA, 201 bp, Homo sapiens
cactatgccagcaaagttgagtagttgggatggagactgtatggcccataaagcctaaaatactctctgctcctttccagaaagcttggcaacccctactrtcatctccacgtctgcctttgttcttcttatttgtcccttccctctgaaggcaggatagcatagggtgaccataagactctctggaactagcctgcttga

SEQ ID NO: 8695 - DNA, 201 bp, Homo sapiens
taaaaattgtatgaaattcaaatttcagtgttcataactaaattttaaaaacttttattgaagttccagagagatctgaagtagttttattggaacacagycctacacaccttcatttataagctatctgtggctacttttgcactatgccagcaaagttgagtagttgggatggagactgtatggcccataaagcctaaa

SEQ ID NO: 8696 - DNA, 201 bp, Homo sapiens
gcatggtggtgcatgcctgtaatcccagctacttgggaggctgaggcaggagaattgcttgagtctgggaggcggaggttgcagtcagctgagattgtgcygttgcactccagcctgggcaacaagagcgaaactccatgtcaaaaaaaaaaaaacaacaaaaaacacgaatatctttttttgtcagctccatgagggcac

SEQ ID NO: 8697 - DNA, 201 bp, Homo sapiens
gggaggctgaggcaggtggatcatgaggtcaggagttcgagaccagcctgaccaacatggagaaaccccgtctctactaaaaatacaaaattagccgggcrtggtggtgcatgcctgtaatcccagctacttgggaggctgaggcaggagaattgcttgagtctgggaggcggaggttgcagtcagctgagattgtgccgt

SEQ ID NO: 8698 - DNA, 201 bp, Homo sapiens
cccttgctggctgcagttgatttgttacttaccgtgaggttatcatagctttgcagagactttgtgatggggctgtcaacagagagagagagagagaaagraaagaaagaagtgccaccagtccattttgttccactcaaatgtagatcgtaatttttaggtttgtaattactgatgagaagaatgcctgagccagaactt

SEQ ID NO: 8699 - DNA, 201 bp, Homo sapiens
gggcagatgcagccattcagttgacttcctgtggacaccagagatgacaggcccctgtccccagcttaccatccagcatataaggcatatatgcccctttscatgaagtataatctaatgagaacagttggagaaggtcaggcaaaggggacaggacaggaactcaggaggaggggatatttagacttacagacctgccct

SEQ ID NO: 8700 - DNA, 201 bp, Homo sapiens
ctgtcttcattcaacaaatatatttcggtctctgttagatacagtgtatctctgttagatacagagcattctgttagatacagagaatctctggtagatayaaagtattctgctattctgatcttcctgttagaagatcagatttacagaagtctacatttgctctcaagggaccttcagtctgtttggagcaatctcttt

SEQ ID NO: 8701 - DNA, 201 bp, Homo sapiens
aagtggatttaaaattactttttactgctaatggggcatctgtcttcattcaacaaatatatttcggtctctgttagatacagtgtatctctgttagatasagagcattctgttagatacagagaatctctggtagatacaaagtattctgctattctgatcttcctgttagaagatcagatttacagaagtctacatttg

SEQ ID NO: 8702 - DNA, 201 bp, Homo sapiens
cgaatcacagttgtaattcacatttttctccaccaattctgataacttgcattaagaaattgactgtgtaagttaaattttagatcaataatgcaaattgsaagacctagtacaggccaaggcctcattatatctgagtagggctttaagaaagcaagaaagaatcgcttgaacctgggaagcggaggttgcagtgagttg

SEQ ID NO: 8703 - DNA, 201 bp, Homo sapiens
tatatatatatatatatagttataatgtggtgggttctcgaatcacagttgtaattcacatttttctccaccaattctgataacttgcattaagaaattgmctgtgtaagttaaattttagatcaataatgcaaattggaagacctagtacaggccaaggcctcattatatctgagtagggctttaagaaagcaagaaaga

SEQ ID NO: 8704 - DNA, 201 bp, Homo sapiens
gtatgtgggcccatttgccatgtgtgtgtgtgtgtctgtctatctatctatctatgtatatatatatatatatatatatatatatatatatatatatatasttataatgtggtgggttctcgaatcacagttgtaattcacatttttctccaccaattctgataacttgcattaagaaattgactgtgtaagttaaatttt

SEQ ID NO: 8705 - DNA, 201 bp, Homo sapiens
cagattggtatcatgctttatgtgtgttcattctagtcctgcacgtgtagaaatgtaagattttaatgtatggtaaggtagatagatagatacatacatasatacatacatacatacatacatacatacatataaaattaggtaagaggatacttttaatgtatggtaagctatgattgcaccactgcattctagcctagg

SEQ ID NO: 8706 - DNA, 201 bp, Homo sapiens
gcatagaatgtttatatggtggccaaaaaagcagattggtatcatgctttatgtgtgttcattctagtcctgcacgtgtagaaatgtaagattttaatgtrtggtaaggtagatagatagatacatacatacatacatacatacatacatacatacatacatataaaattaggtaagaggatacttttaatgtatggtaag

SEQ ID NO: 8707 - DNA, 201 bp, Homo sapiens
aaaaaaaaaattagttatctctgccctttgggaggctgaggcaggtggatcacttgaggtcaggagtttgaacctagcctgggcaacatggtgaaaccccrtctgtagcaaacatacaaaaattagctgggtgtggtggcgtgcctgtaatcccagctattggggaggctgaggcaggagaatcactcgaacccgggaggt

SEQ ID NO: 8708 - DNA, 201 bp, Homo sapiens
aacagaatatcctaatcttgcaagtggcatatcatgttccttcttttttaagagagaaggagaaattcctgcagatcatcagggactgaggctaactgaarctttggaatggatacagtgctactctcagctgaaagcacaaatcacttccatcacgtatatgagattcctacttgcagcactgcagaggggtgataagca

SEQ ID NO: 8709 - DNA, 201 bp, Homo sapiens
ggggttgccagagaacttacacaggagcgtttctgctggaatcagctcgatgcctcttgaggacagagactcccagaggaaggagcgggcagccatccttrctgtgctgcagcctccacaggtgacacctcctggtgtgggagggacccaggtgaacagggtctggagtagacccccagcaaactacagcagtgttactgg

SEQ ID NO: 8710 - DNA, 201 bp, Homo sapiens
ccatgctcaggagatgtcagccttttccattgtctccccgcccccaccgccagccctgcttaaattatcccctctttttaaacagaatatcctaatcttgsaagtggcatatcatgttccttcttttttaagagagaaggagaaattcctgcagatcatcagggactgaggctaactgaaactttggaatggatacagtgc

SEQ ID NO: 8711 - DNA, 201 bp, Homo sapiens
ctttaaaaatacagcctgcttgccatctcacgacttttcccttaatgcaacaaagaaatatgtgtttggctgtgaaatctttttttttttttttttttttkttttttgctgtggagcgcaaaatgttcatttatctctggatggtttgtttctggccacctgccctaagtgtatctgaatattgtaacggtgatcacttct

SEQ ID NO: 8712 - DNA, 201 bp, Homo sapiens
aggtggatcacaaggtaaggggtttgagaccagcctggccaacatggtgaaaccccatctctattaaaaatacataaattagtcgggcatggtggcatgtrcctgtagtcccagctgctcaggaggctgaggcaggagaatcactcgaacccgggaggcagaggttgcagtgagcctagactgcaccattgtactccatcc

SEQ ID NO: 8713 - DNA, 201 bp, Homo sapiens
cactttgagaggctgaggtaggtggatcacaaggtaaggggtttgagaccagcctggccaacatggtgaaaccccatctctattaaaaatacataaattastcgggcatggtggcatgtgcctgtagtcccagctgctcaggaggctgaggcaggagaatcactcgaacccgggaggcagaggttgcagtgagcctagact

SEQ ID NO: 8714 - DNA, 201 bp, Homo sapiens
cctgtaatctcataatctcagcactttgagaggctgaggtaggtggatcacaaggtaaggggtttgagaccagcctggccaacatggtgaaaccccatctstattaaaaatacataaattagtcgggcatggtggcatgtgcctgtagtcccagctgctcaggaggctgaggcaggagaatcactcgaacccgggaggcag

SEQ ID NO: 8715 - DNA, 201 bp, Homo sapiens
aagttcaaagaaaggagtaaatcacgaccaggcacagtggctcgcgcctgtaatctcataatctcagcactttgagaggctgaggtaggtggatcacaagstaaggggtttgagaccagcctggccaacatggtgaaaccccatctctattaaaaatacataaattagtcgggcatggtggcatgtgcctgtagtcccagc

SEQ ID NO: 8716 - DNA, 201 bp, Homo sapiens
aagtgctccgtaaatgtcagcatctattattatcatttgtgtttttttttccccttctctgccttcctttctctccctccttggtctgcttcctcctgttrctatcagagcctgcctgcctcatccttgttccagccttgatggtgatgatgattgtggttgctgttgctatttgtttttttggtttgtttgtttgttttg

SEQ ID NO: 8717 - DNA, 201 bp, Homo sapiens
aaagacaaaacagaaaaaggaggagaggacacagaggagaaggctctgtgaagtcagaggcagagattggagtgatgcgtctacaagccaagagatgccayggtcatgggcagcccccagaaacgaggagagaaacctggcacggtttccacaaggagtcacccctgccaacaccttggtttcagacttctggtctcctga

SEQ ID NO: 8718 - DNA, 201 bp, Homo sapiens
tgggccctaaatccaatgacggttatcctcatgagaagaggaaagcagggggcacagtggtgggtgtgcctgcaatcccagctactcgggaggctgcggarggggcatcacttgagcccaggagttcattgccagcctgggcaatatagcaagaccccatctcttaaaaaaaaaataacaccaaaagacaaaacagaaaaa

SEQ ID NO: 8719 - DNA, 201 bp, Homo sapiens
ggcagagatggggaaggtgctgttcccttcctcctgggaagggcaaagaaagcagggtggtcctcccatccccgtgaggaaggaagagcctcattcatgcygagaccctgatggagaactgggtccagggataatgttttgtgttcctgctcatgggactggtgtgttattgtcaagggatcttacaggccttgcttccca

SEQ ID NO: 8720 - DNA, 201 bp, Homo sapiens
tgcctgattccaggatgctctaacctggccacgcatcccccgtggattctcagctgttgtgtgtttcctcctcaggtggccactgtgtctggtgctcaccyacattttggttcatcctgactttgcctcagcctccccattctgcatttctcccacggcttctcccagccctggcccagtgacactgtaatgtggactgtg

SEQ ID NO: 8721 - DNA, 201 bp, Homo sapiens
tatgcagtatatgtgctaaattactttttttgttgttgttgagatggagtttcgctcttgttgcccaggctggagtgcagtggtgtgatcttggcttgccrtgatctctacctcccaggttcaagcgattctcctgccgcagcctcccgagtagctgggattacagacatgtgccaccacacccggctaattttgtatttt

SEQ ID NO: 8722 - DNA, 201 bp, Homo sapiens
gttcagaggctgcaggaatgattcaaagtctgactgatttatgtgcattgggcattttgttgatgtcattcagattaatgatggcactgaaaatgtgtaayggaaatgagaagtttgtatcctgcctgctataccatgattccaatttaagagggggtaaaaatattgcactttttaatctattgttttttgaaagagact

SEQ ID NO: 8723 - DNA, 201 bp, Homo sapiens
gtgttcttgcctggcttattgagctccatggtaaatgttcagaggctgcaggaatgattcaaagtctgactgatttatgtgcattgggcattttgttgatrtcattcagattaatgatggcactgaaaatgtgtaatggaaatgagaagtttgtatcctgcctgctataccatgattccaatttaagagggggtaaaaata

SEQ ID NO: 8724 - DNA, 201 bp, Homo sapiens
gtctcaaaaaaaaaaaaaaaaaaaaaaatctgtgttcttgcctggcttattgagctccatggtaaatgttcagaggctgcaggaatgattcaaagtctgaytgatttatgtgcattgggcattttgttgatgtcattcagattaatgatggcactgaaaatgtgtaatggaaatgagaagtttgtatcctgcctgctatac

SEQ ID NO: 8725 - DNA, 201 bp, Homo sapiens
cccctaacaacctctacctggcaatcttcatttaactccaaactcaggacctcaatcctctgtttggcctgtgttccacgggacaggcatggggcacagakgtctgttatatataagggacaaatctctgggttggtcactcctggattccccagcccggaccacacattcaggtgcatctcccacacaggatcattctaa

SEQ ID NO: 8726 - DNA, 201 bp, Homo sapiens
tccaaggatgtacctgtgaataaggcaagttcctttttatcattgtctttgcagtctattaggggctacacaatttaaacagagaatatatataaaatggkagaaagtacaagtaagtataccttatttttttaaaaaaaatgaatgtggtatttcacccacagcctcaagaatcactttccttaaaattgccagagtagg

SEQ ID NO: 8727 - DNA, 201 bp, Homo sapiens
taatcattcagtaagtcttgactgcctgctatggaggttaagccctttactaagttccaaggatgtacctgtgaataaggcaagttcctttttatcattgkctttgcagtctattaggggctacacaatttaaacagagaatatatataaaatggtagaaagtacaagtaagtataccttatttttttaaaaaaaatgaat

SEQ ID NO: 8728 - DNA, 201 bp, Homo sapiens
tcacaccaatgatatatattttccacacatttagattctccatgccactccttatctctttagtgcagaaaacggagaggaggttcagtattcttaagaamctcccatgattgctttgaggcaatggatttaacaggtatctttatcccttatttacgcactgactgtggtactgagtcatccctggtgtttctggatttt

SEQ ID NO: 8729 - DNA, 201 bp, Homo sapiens
agcaggggaggcatgatctggaagataaagcagctaggagtatagactagggggctgatggaggggaacacctatcacaatatgtgttctcacaccaatgrtatatattttccacacatttagattctccatgccactccttatctctttagtgcagaaaacggagaggaggttcagtattcttaagaaactcccatgatt

SEQ ID NO: 8730 - DNA, 201 bp, Homo sapiens
agcatttgactgttgcatcctttgattgggccatgttcatgcagccagcctgggaaagcaattagtagttttaagcatgggaaatcatataaaagtaaacyaaaattgcatttgaattaattgatgaacatgtttgcttgaccatatcctgctgttaggcgtcttcaagttaacttaagtggttgataaaactttccaaaa

SEQ ID NO: 8731 - DNA, 201 bp, Homo sapiens
tttagacatttagattttttctgttttatctctctctctctatatgtatatctatatatatatttatctatatctatatagagatatatatatatatatawaataatgaatgaaatggactgtttgcaacctcagatgtatttctaggacttagagtgattagcttgaggcgatggtagtttctgtttttggagtctctgt

SEQ ID NO: 8732 - DNA, 201 bp, Homo sapiens
ttaacttatatctggtcctttagacatttagattttttctgttttatctctctctctctatatgtatatctatatatatatttatctatatctatatagakatatatatatatatatataataatgaatgaaatggactgtttgcaacctcagatgtatttctaggacttagagtgattagcttgaggcgatggtagtttc

SEQ ID NO: 8733 - DNA, 201 bp, Homo sapiens
tgttgtcatcgttttatgattaacttatatctggtcctttagacatttagattttttctgttttatctctctctctctatatgtatatctatatatatatwtatctatatctatatagagatatatatatatatatataataatgaatgaaatggactgtttgcaacctcagatgtatttctaggacttagagtgattagc

SEQ ID NO: 8734 - DNA, 201 bp, Homo sapiens
ctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacat

SEQ ID NO: 8735 - DNA, 201 bp, Homo sapiens
ggtacagtgaaaatatggtattataatctgatgggatcggcattgtgtacatagttcgttattgactgaaatgttggtatgaggtgtatgactatgttttytcatgacctctgctttttttgtctttaagtttttaatttttgttttacttttgtcttttaattttaattctattgcaaccaaatctatcagcctgtcttc

SEQ ID NO: 8736 - DNA, 201 bp, Homo sapiens
tgataacacacgtatatattatctctttaaaaattaaaaaaaaaaaagccagccaaaaaaagaaaatggaagtgttcaagaaactgccttttttcatgtartagtatttctgtgtcactaaatccttcaacagcattatttttaatagctgcccaatgtcctaatggatgggtgagtcatgatttacttaaccaatcccct

SEQ ID NO: 8737 - DNA, 201 bp, Homo sapiens
ccattctcctgcctcagcctcccaagtagctgggactacaggcacccgccaccaagcccagctaattttttgtaattttagtagagatggggtttcaccaygttagccaggatggtctctatctcctgacctcgtgatccgcctgcctcggcctcccaaagtgctgggattacaggtgtgagccaccacgtccggcctgtt

SEQ ID NO: 8738 - DNA, 201 bp, Homo sapiens
ctcagaaagtaataaagccctgcagtaatcagagggctgaggccaggtccccagtgagcggctgaacacacagtgattcaaacccactccagacctgtgtwcttaatcattaccttcacctggagggacagacctggccttgggcaagccacccccactccctggctctgtgaccttggcagctgactggccctctccaag

SEQ ID NO: 8739 - DNA, 201 bp, Homo sapiens
ccaagtggaaggtggtgtaggcaaagagaaggatgcataggcacattggacggtggaaggcaggggctgctgaatgatgtggcaggaaacatgcaaagtgytcagcgtccctgggcggtgcagagtcttgggaagcaagaggatggagccatcctttcagtttccagcctgggtttcccaaaggagagggtgtttgagttc

SEQ ID NO: 8740 - DNA, 201 bp, Homo sapiens
aaacatcctgtggaattcgcctcagatgcccctccatttgcactggtatatggaggatgtttgaaaaccaccagaacctattgtgtactttggaacaatgrcattttcctgcttgattgtgaagatggccgctggaaaagaagccaactcccagggggcacgaggggctaagctgtctcctgggaagtttgagggaggcca

SEQ ID NO: 8741 - DNA, 201 bp, Homo sapiens
ttcaggagcagcctgggctgagtttttaatgtggcagcagcctcggctggtttcagcatgcaggtgagaaggccgttcatctggaacttgggctacccaasagtgcaagtggggagatcagagcatggaaaatgtttttgtataaacttaggtggaccaaaatgatcatttcaacaacatttcggacttgattttttgtat

SEQ ID NO: 8742 - DNA, 201 bp, Homo sapiens
agcaccactggccaaagcgaggatagctgattgcactcctactttcctgctggtggaaacagcatgtatataggtacaactctggtgtggggaaaatgctraagatataaagtagaaatagcctttgtgtgatgtgagcagcagaacaaaaatcgagggtgccaaataatcgtatgaagtggtgaactgcctaagatggaa

SEQ ID NO: 8743 - DNA, 201 bp, Homo sapiens
ttcagggattaggacctggacatctttggttgggaaatgggcatcattttgtctaccacaacgtgagagcccattgccctgcatccacagtcataaaagtstgttcccttcctccctgattcttcctaacttctcctgcctgccttgcaggatatgtggagttatcagttcctagcaccactggccaaagcgaggatagct

SEQ ID NO: 8744 - DNA, 201 bp, Homo sapiens
cctctccctatttatttttattttatttgtgagacagagctttgctttgttgcccagactggagtgcagtggcttgatcttggctcactgcaacttccgcytccagggttcaagcgattctcctgcctcagcctcctgagtacctgggaccacaggcacatgccaccatgccagctaatttttagtagagatggggtttca

SEQ ID NO: 8745 - DNA, 201 bp, Homo sapiens
cagtgtttcctctttgttaatcctcatgatgattggtatggtttggctgtgtccccacccaaatctcattttgaactgtaatctccataatccctacgtgycaggtagggacctggtaggaggtgattggcccgtggtggcagtttccctcatgctgttctcgtgatagcacgtgagttctcgtgagatctgatagtttta

SEQ ID NO: 8746 - DNA, 201 bp, Homo sapiens
gaggcaggtggattgcttgagctcagtcgtttgagaccatcctgcacaatacggtgaaacctcatctctactaaaatacaaaaatgtagccaggcgtggcrgcacatacctgtagtcacagctactcaggaggctgaggcaggagaattgcttgaacccgggaggtggaggttgcagtgaggtgagatcgcaccactgtac

SEQ ID NO: 8747 - DNA, 201 bp, Homo sapiens
gtgcggtggcacactctgtaatcccagcactttgggaggccgaggcaggtggattgcttgagctcagtcgtttgagaccatcctgcacaatacggtgaaamctcatctctactaaaatacaaaaatgtagccaggcgtggcggcacatacctgtagtcacagctactcaggaggctgaggcaggagaattgcttgaacccg

SEQ ID NO: 8748 - DNA, 201 bp, Homo sapiens
gatctcaggagagccaactcaccacacagcatacgtgctaaaccatgcatgagaaatctgtccgcatgatctaatcaccttccaccaggccccacctccarcgttagggattacatttggacatgaaggctgggtgcggtggcacactctgtaatcccagcactttgggaggccgaggcaggtggattgcttgagctcagt

SEQ ID NO: 8749 - DNA, 201 bp, Homo sapiens
gagcaagggggcaggtgcaaaacacttttcaacaaccagatctcaggagagccaactcaccacacagcatacgtgctaaaccatgcatgagaaatctgtcygcatgatctaatcaccttccaccaggccccacctccaacgttagggattacatttggacatgaaggctgggtgcggtggcacactctgtaatcccagcac

SEQ ID NO: 8750 - DNA, 201 bp, Homo sapiens
ctgtacaggaagcatgatgctagcatctgcttggcttctggggaggcctcaggaaacttacaatcatggtggaaggcaaaggggaaggaaagcatctcacrtggtgcaaacaggagcaagagagggagcaagggggcaggtgcaaaacacttttcaacaaccagatctcaggagagccaactcaccacacagcatacgtgc

SEQ ID NO: 8751 - DNA, 201 bp, Homo sapiens
tcattcttgcactgctataaagaaatacctgagactgggtaatttatttaaaagacacctttaattggctcacagttccacaggctgtacaggaagcatgmtgctagcatctgcttggcttctggggaggcctcaggaaacttacaatcatggtggaaggcaaaggggaaggaaagcatctcacatggtgcaaacaggagc

SEQ ID NO: 8752 - DNA, 201 bp, Homo sapiens
ttcattcttgcactgctataaagaaatacctgagactgggtaatttatttaaaagacacctttaattggctcacagttccacaggctgtacaggaagcatratgctagcatctgcttggcttctggggaggcctcaggaaacttacaatcatggtggaaggcaaaggggaaggaaagcatctcacatggtgcaaacaggag

SEQ ID NO: 8753 - DNA, 201 bp, Homo sapiens
gcagggagtaatgtgtatatgaatcatcagctatgcaacataatgctgatgctaagtactaacattgatggagtgttggcatgagctgggcagagtgctcyatcctctatgtgtgtattagttcattcttgcactgctataaagaaatacctgagactgggtaatttatttaaaagacacctttaattggctcacagttcc

SEQ ID NO: 8754 - DNA, 201 bp, Homo sapiens
attcatttaagataatgaagctcctgtccttgacccaatctccactctaccgtttgatgtccagtgtggactgcccctctgaaagcccttcactgcggctyagcctgtggtggaaggtgtccaaggtggctggaacacctcctgctgggggtgtcagtcttggctctcctgttttctgcctgtgcaatggtgggtaggtcc

SEQ ID NO: 8755 - DNA, 201 bp, Homo sapiens
tccagcctgagtgacaagagcaacactccatctcaaaaaaaaaaaaaaaaaaaaaaggacagggaaaatgtccaggaaggatgtggcttagctgaagatcwgcttcagcttgatcccacgggaagctctggagggtgaattgtacagcagagttggtcctgactgagaccagggcctggctgacctatggcagtcagcgat

SEQ ID NO: 8756 - DNA, 201 bp, Homo sapiens
gccactctcttgcataggattttcttttctttctagaaacaggaactgagtatgtttccaatatttttttatttctcctaaaaaacatcagagactatatrtataaaatctcacaaactttgtttcccagaaaaacaactatatttaaatgcagctcatactgtatgtaagtatgatgtaggaaaatctgttaattgtgtg

SEQ ID NO: 8757 - DNA, 201 bp, Homo sapiens
cttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaa

SEQ ID NO: 8758 - DNA, 201 bp, Homo sapiens
gagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcagg

SEQ ID NO: 8759 - DNA, 201 bp, Homo sapiens
agctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgaagtctgctgctgtcagctctgtggtcgct

SEQ ID NO: 8760 - DNA, 201 bp, Homo sapiens
aggtggttggtttgtaattgttcctacctcttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctc

SEQ ID NO: 8761 - DNA, 201 bp, Homo sapiens
gtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatag

SEQ ID NO: 8762 - DNA, 201 bp, Homo sapiens
tgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattaaa

SEQ ID NO: 8763 - DNA, 201 bp, Homo sapiens
cttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttct

SEQ ID NO: 8764 - DNA, 201 bp, Homo sapiens
gcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcc

SEQ ID NO: 8765 - DNA, 201 bp, Homo sapiens
caaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagataca

SEQ ID NO: 8766 - DNA, 201 bp, Homo sapiens
aaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaa

SEQ ID NO: 8767 - DNA, 201 bp, Homo sapiens
tctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagt

SEQ ID NO: 8768 - DNA, 201 bp, Homo sapiens
aattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcc

SEQ ID NO: 8769 - DNA, 201 bp, Homo sapiens
aacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttcctt

SEQ ID NO: 8770 - DNA, 201 bp, Homo sapiens
taagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgagga

SEQ ID NO: 8771 - DNA, 201 bp, Homo sapiens
atgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtattttt

SEQ ID NO: 8772 - DNA, 201 bp, Homo sapiens
cactggataggtaatagacgccggcatggctatgctgtggttcctgctgatgggcacactattacaggtgcatgataagtgtgtcgtacgcaggaagtacrtttcccccagccttccctacctgctgagggctgctcccagcctaaggatttcatccagatagattcatagcgcttccagtaaatgcaccccttgcctttc

SEQ ID NO: 8773 - DNA, 201 bp, Homo sapiens
cctgctgatgggcacactattacaggtgcatgataagtgtgtcgtacgcaggaagtacgtttcccccagccttccctacctgctgagggctgctcccagcstaaggatttcatccagatagattcatagcgcttccagtaaatgcaccccttgcctttcaaagttgaaaaagaaattactttggacacaaagaggtgtttc

SEQ ID NO: 8774 - DNA, 201 bp, Homo sapiens
tcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttca

SEQ ID NO: 8775 - DNA, 201 bp, Homo sapiens
cgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggccaacatggtgaaaccc

SEQ ID NO: 8776 - DNA, 201 bp, Homo sapiens
tgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccat

SEQ ID NO: 8777 - DNA, 201 bp, Homo sapiens
cagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggc

SEQ ID NO: 8778 - DNA, 201 bp, Homo sapiens
atcatattctcttcactgaaacatttcagatgacttaaaaattcaccttgtagaacttttaaaattgaaactttctggtgaacatcattagttgacagatrtgtcattgaagtttcatccttcttcatttcagagtctgctggaagacccttcatttaccactctctccttcctggaggtgtggaaatactctacctgggt

SEQ ID NO: 8779 - DNA, 201 bp, Homo sapiens
catattctcttcactgaaacatttcagatgacttaaaaattcaccttgtagaacttttaaaattgaaactttctggtgaacatcattagttgacagatatrtcattgaagtttcatccttcttcatttcagagtctgctggaagacccttcatttaccactctctccttcctggaggtgtggaaatactctacctgggtga

SEQ ID NO: 8780 - DNA, 201 bp, Homo sapiens
ttcaccttgtagaacttttaaaattgaaactttctggtgaacatcattagttgacagatatgtcattgaagtttcatccttcttcatttcagagtctgctrgaagacccttcatttaccactctctccttcctggaggtgtggaaatactctacctgggtgaggctctcgtggctttttgtgccaagtgtccgtaaacttc

SEQ ID NO: 8781 - DNA, 201 bp, Homo sapiens
tctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataa

SEQ ID NO: 8782 - DNA, 201 bp, Homo sapiens
cccaggctggagtgcagtggcatgaccatggctcactgcagcctcgacctctggggctcaagcgatccttctgcaacagcctccctagtagctgggactayaggtgcatgccaccacacccagctaatttttatattttttgtagagatggggttttaccatgttgcctaggctggtctcgatctcctgggctctagcaat

SEQ ID NO: 8783 - DNA, 201 bp, Homo sapiens
tcgacctctggggctcaagcgatccttctgcaacagcctccctagtagctgggactacaggtgcatgccaccacacccagctaatttttatattttttgtrgagatggggttttaccatgttgcctaggctggtctcgatctcctgggctctagcaatcctcccacctcggcctcccaaagtgttgggattacaggcgtga

SEQ ID NO: 8784 - DNA, 201 bp, Homo sapiens
cccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacat

SEQ ID NO: 8785 - DNA, 201 bp, Homo sapiens
attctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggac

SEQ ID NO: 8786 - DNA, 201 bp, Homo sapiens
aatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttttcattgttaacgtggcatcggagtag

SEQ ID NO: 8787 - DNA, 201 bp, Homo sapiens
taattgtgtagctttgcctttccttagttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattattatcaattgcctctct

SEQ ID NO: 8788 - DNA, 201 bp, Homo sapiens
ttgtctttatggtgtttttcattgttaacgtggcatcggagtagctcgacttttgcatcatgataaattcataacccaagagaaggcagaaaacataattrttatcaattgcctctctcctggaattgccattggctgagtggaacaaaatacgaacttaaggagtagctgattcagagaaatccagggtaggaacgggtc

SEQ ID NO: 8789 - DNA, 201 bp, Homo sapiens
tctttatggtgtttttcattgttaacgtggcatcggagtagctcgacttttgcatcatgataaattcataacccaagagaaggcagaaaacataattattrtcaattgcctctctcctggaattgccattggctgagtggaacaaaatacgaacttaaggagtagctgattcagagaaatccagggtaggaacgggtccca

SEQ ID NO: 8790 - DNA, 201 bp, Homo sapiens
gcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagt

SEQ ID NO: 8791 - DNA, 201 bp, Homo sapiens
ttcttttcttttcttttctttttttttaagatggagtctcgctctgtcaccgggctggagtgcagtggtgctatttcggctaactgcaatctctgcctccygggttcaagcaattctcctgcctcagcctcccaagttgctgggactacaggcgtgcgccaccatgcccagctaatttgtaattgtttgtttctaaaagga

SEQ ID NO: 8792 - DNA, 201 bp, Homo sapiens
tctgtcaccgggctggagtgcagtggtgctatttcggctaactgcaatctctgcctcccgggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaa

SEQ ID NO: 8793 - DNA, 201 bp, Homo sapiens
cctcccgggttcatgccattcttctgcctcagcctcccgagtagctgggactacaggcgcctgccactacacctggctaatttttttgtagttttagtagrgatggggtttcaccgtgttagccaggatggtctagatctcctgacctggtgatccgcctgtcttggcctcccaaagtgctaggattacaggcgtgagcca

SEQ ID NO: 8794 - DNA, 201 bp, Homo sapiens
gatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatca

SEQ ID NO: 8795 - DNA, 201 bp, Homo sapiens
ggtggggaggagttcatattcttttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattcattttg

SEQ ID NO: 8796 - DNA, 201 bp, Homo sapiens
tttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatca

SEQ ID NO: 8797 - DNA, 201 bp, Homo sapiens
tgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttac

SEQ ID NO: 8798 - DNA, 201 bp, Homo sapiens
tagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatggga

SEQ ID NO: 8799 - DNA, 201 bp, Homo sapiens
gcccggtggctcacacctgtaatcccagcactttgggaggccgagatgggaggatcacgaggtcaggagttgaagaccaccttgatcaatatggtgaaacsctatctctactaaaaatacaaaagttagccggtgtggtggtgcatgcctgtaatcccagctactcaggaggctgaggcaggagaatcacttgaacccagg

SEQ ID NO: 8800 - DNA, 201 bp, Homo sapiens
ccagcactttgggaggccgagatgggaggatcacgaggtcaggagttgaagaccaccttgatcaatatggtgaaaccctatctctactaaaaatacaaaarttagccggtgtggtggtgcatgcctgtaatcccagctactcaggaggctgaggcaggagaatcacttgaacccaggaggcggaggttgcagtgagccgag

SEQ ID NO: 8801 - DNA, 201 bp, Homo sapiens
ttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtccca

SEQ ID NO: 8802 - DNA, 201 bp, Homo sapiens
ccctggttgacctggaatgacctagaccagcagtcacaagctcctgcccatggacaaaatacagccggtacctctttggctatggcctgcaggctcagaayagttcttacattttcaatcatctgcaaaaaagaataaagaggagaatattatttcttgaaggaggaaaatgatatggaattctgatttcagtgtcataaa

SEQ ID NO: 8803 - DNA, 201 bp, Homo sapiens
acccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagag

SEQ ID NO: 8804 - DNA, 201 bp, Homo sapiens
gtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgta

SEQ ID NO: 8805 - DNA, 201 bp, Homo sapiens
tatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctcc

SEQ ID NO: 8806 - DNA, 201 bp, Homo sapiens
tctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggct

SEQ ID NO: 8807 - DNA, 201 bp, Homo sapiens
ccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattca

SEQ ID NO: 8808 - DNA, 201 bp, Homo sapiens
ttaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgagg

SEQ ID NO: 8809 - DNA, 201 bp, Homo sapiens
gcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggtt

SEQ ID NO: 8810 - DNA, 201 bp, Homo sapiens
agcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtaatcagagggctgag

SEQ ID NO: 8811 - DNA, 201 bp, Homo sapiens
ctgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatat

SEQ ID NO: 8812 - DNA, 201 bp, Homo sapiens
cagtaagtattcttggggcaaatgggaaaagggttaaaatgaccagatctccagagatctcactcactgtggtgaagacagcgccaagccatgagggctcygccccagtgattcaaatacctcccattacggacatgtttcaacatgagatttgagcggggacaaatatccaaactatatcaggatcccagcagactgggt

SEQ ID NO: 8813 - DNA, 201 bp, Homo sapiens
acaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagata

SEQ ID NO: 8814 - DNA, 201 bp, Homo sapiens
ggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccac

SEQ ID NO: 8815 - DNA, 201 bp, Homo sapiens
atggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagt

SEQ ID NO: 8816 - DNA, 201 bp, Homo sapiens
ttttggtctttataatccccagagcctggcttaattattttaaagtaaatcaacactttgaacacttgcaggttagaaaaccagtggactgatggatgcgwtacagccattgtttccaagtgtattagtttctgctggccgctgtaacacattatcaccagtgtagcacctaaacaacacaaatgtattgtctttcagttc

SEQ ID NO: 8817 - DNA, 201 bp, Homo sapiens
agtgggccagattcagcccgtgggccataggttgccagcctctgactctggtgttcagatcacagactttggatgtctcatatctgaatctttctaatctygtgatagggcaaggtaattaaaatgttaatacgttagttttctcactgtcaatgtgttctatgacatcatttatgcaaagcatacaaagctgagaataaa

SEQ ID NO: 8818 - DNA, 201 bp, Homo sapiens
ttgtaaaatgatatgctgtcttttttgacccagttactttataaagctacattctttggcaaacattaacacaacttctccgtgtgtgggctaaataaatwttcgggcaacactgattgagcactgccttgggtaaataattctctctccacacatttcctagtttataatgaggagttttcttcgtggtctgaccaaatg

SEQ ID NO: 8819 - DNA, 201 bp, Homo sapiens
ctcagaagagaaatctattgaaagttactaggtgccaggtgtctcggaaagtgtttaacacatgcctgagacgttaaaggcaagattcatgcattctttcrgcagacagtttcttcacttaccggggaagggggtgtaatatatgggggtatagggataaataattctgtgtgctgtgcaggccgtggagactcatcttct

SEQ ID NO: 8820 - DNA, 201 bp, Homo sapiens
agagttaaaaaaaaaaaatcactggatttgaagttggcctatgttagattactccaaggaagttagttaatatgttaatatgaatctagatgaacattgartgttttgctcttcttgttaatttgcgccatctactaatctctggacaatggagaaaaagtcgtaggttatgagttttttatttatggacattaagcaata

SEQ ID NO: 8821 - DNA, 201 bp, Homo sapiens
tcacgcctgtaatcccagcactttgggaggctgaggcaggtggatcacctgaggtcaggagtttgagaccagcctggccaacatggtgaaaccccgtctcyatgaaaaatacaaaaattacccgggcatggtggcgggcacctgtaatcccagctactagggaggctgaggcaggaaaatggcttgaacctcggaagcgga

SEQ ID NO: 8822 - DNA, 201 bp, Homo sapiens
ctccatgaaaaatacaaaaattacccgggcatggtggcgggcacctgtaatcccagctactagggaggctgaggcaggaaaatggcttgaacctcggaagyggaggtggccgttagccgagatcacgccactgcactccagcctgggcaacagagcaagactctgccttaaaaaaaaaaaaaagaaagaaaagtaaaagga

SEQ ID NO: 8823 - DNA, 201 bp, Homo sapiens
agggcctctcggaggacgtgaatccacattaagactttggggataagtaggagcgccttaggcatggggacccatggatgcgaggcctgtaggacacagasaggatggcatgaaggcctgtgcaactggaggggtggggatggggacactaagagatggctggaagtgtgggggtggggacactaagagatgactggagaa

SEQ ID NO: 8824 - DNA, 201 bp, Homo sapiens
ctgcagtaggagtgaggggatcagaggagagctttggaagccccctggatgcgggacaggaagggagataccagtgtctaggaggccagtgaggcagccasaggctccaccaggatcagggctgcgagggtcatgaggaggaaaccaatttgaaggagtccaggggaataggacttggaaatgaccgatgggacatttggg

SEQ ID NO: 8825 - DNA, 201 bp, Homo sapiens
ggtcatgaggaggaaaccaatttgaaggagtccaggggaataggacttggaaatgaccgatgggacatttgggaagaggaagacagaagagcgcagtcccrgcttctggctttagcagttgggcaaggggagatggggagatgtgcccatgggttgagggttgaggacattaggagggagccggtatggcaggaagagctg

SEQ ID NO: 8826 - DNA, 201 bp, Homo sapiens
gtaatctgttgaaatatatatcttgctcattggtgagctcctgctccttcctcgttgctcttgcagatttatcacttctcgtaaggctgcgcttgtacttsgggattttctctgtgccacactgggaaacatagggtggttgcatgctgcagtcctgagcacttatttcactcacatctttacacgaagatttggtgggtg

SEQ ID NO: 8827 - DNA, 201 bp, Homo sapiens
ctagcagagctcctcggagcgtgtggctaggtgcctggtaatgcaagccccctgtcctccaccctctgttgtactgagtcacagtctccggggtgaagccyagcagtctgcgttgacaggccccaggggatgccgctacttcctgaattctgaattctggaaactgagccggagttcagggcctggctcccattaccaggg

SEQ ID NO: 8828 - DNA, 201 bp, Homo sapiens; identical to SEQ ID NO: 1302

SEQ ID NO: 8829 - DNA, 201 bp, Homo sapiens
cgagattgcgccattgcactccagcctgggggcaacaagagcaaaactctgtctggaaaaaaaagaaaggagcagcttggcaaaccccaccttgtcgcttytgtgagtgcctctgaccctttggctgccaggacgggcgtattttatggaaatgctaagcaccaacagagtaaagtggtttggtttttcacagtggtggga

SEQ ID NO: 8830 - DNA, 201 bp, Homo sapiens
tggcacatactggtgcccaatcctcccttctgggtgcttcttccaaggccttgtgatggaagtgagtaccctcttcgacatcagacccagcttcaaatccyggctctgctatgtattggctgcgtggctttagacaagtcttttaaccttgctgtgcttctgatttctcagctgaaaaatggagatgatgatagtggtttc

SEQ ID NO: 8831 - DNA, 201 bp, Homo sapiens
ccaatcctcccttctgggtgcttcttccaaggccttgtgatggaagtgagtaccctcttcgacatcagacccagcttcaaatcctggctctgctatgtatyggctgcgtggctttagacaagtcttttaaccttgctgtgcttctgatttctcagctgaaaaatggagatgatgatagtggtttctgtaaggccttatggt

SEQ ID NO: 8832 - DNA, 201 bp, Homo sapiens
caaatcctggctctgctatgtattggctgcgtggctttagacaagtcttttaaccttgctgtgcttctgatttctcagctgaaaaatggagatgatgatartggtttctgtaaggccttatggtgaagcacctagctcagggcctggaaggcaggtgtaaccagtggttcagttgttataaaccaacactaaccctcgcct

SEQ ID NO: 8833 - DNA, 201 bp, Homo sapiens
cattgaataaagtaaaagacacaggtagaattaatttcattgagcccaatatatccaaaataatatcattttcacatctattcaatataaaaatttactamtgagatatttcatactaagccactgaaatccagtttgtatcttacacatctcagttttgacgagccacatttcaagggcgtgatagccacatgtggctcc

SEQ ID NO: 8834 - DNA, 201 bp, Homo sapiens; identical to SEQ ID NO: 1288

SEQ ID NO: 8835 - DNA, 201 bp, Homo sapiens
tggcatcttccatccatccttcaacttaagcaagttcctccgacagggtctctgcaaatgcctcccggccaatgtccaccagctcatctccggcaaaatakgcatctctcttaccagagtgtctgatggggaaaacgttctggtgtctgactttcggtccaaagacgaagtcgtggatgtaagcagtttgcttatctggac

SEQ ID NO: 8836 - DNA, 201 bp, Homo sapiens
gtcaggtgtgggtccaagcccactagacaagtttgctcttcccagagcacatttctgccttcaagtcatcctggcttgtcagggctgggggagttctgctstagaaatattagagtggaaggaaaaagatgtgttgggagctatttttctttaatactaaaagttggttgatgaatttgtcgttggccaagaccaaggaga

SEQ ID NO: 8837 - DNA, 201 bp, Homo sapiens
ctagaagaagctgtgtctctggctgtgacggcaccctagagtgtgtgtggtgccctctactggccggcaatgtgggtccaccgtagctcagactgcacacygcagcagcgggaacggcctctaagccaacttcctccatgtgtttcaggtcccaaatgccagtgagcagccaacaggcctccccatgcacacctgagcagg

SEQ ID NO: 8838 - DNA, 201 bp, Homo sapiens
tctctcttaccagagtgtctgatggggaaaacgttctggtgtctgactttcggtccaaagacgaagtcgtggatgtaagcagtttgcttatctggacgttrtcaagttagaaaagctgttttgggatgggtgtggtggctcatgcctgtcatcccggcactttgggaggccgaagcgggtgggttgcttgagcccaggagc

SEQ ID NO: 8839 - DNA, 201 bp, Homo sapiens
ctgtcatcccggcactttgggaggccgaagcgggtgggttgcttgagcccaggagctcgagaccaacatgatgaaacccagtctctacaaaaattacagaraaattagctaggcatggtgttgtgggcccatagtcccagctactagggaggctgaggcaggagaattgcttgagcctgggaggtggaggttgcagtaagt

SEQ ID NO: 8840 - DNA, 201 bp, Homo sapiens
catcttccataatgaagatgccttctcactggaaaccctacaagggtgggaacgtgccttatttgcctgtatcctcagggtctagcagagagaagataatytgtaataccaaaacaccattaaattcagctgatgctttcataagcgctccttggaggaaggactccatttacttgacagatctgtgcaagacagcagcct

SEQ ID NO: 8841 - DNA, 201 bp, Homo sapiens
cagccagttgcatcctctgtttaaccttgtttgcggaagctttctctaaacagccagcacttgtctgttcccacatgggtccgttctcccagtgaatcacygtggtgcctgctgactgctctgtagcacagtgcttcgcaaagtgtgatcctgggaccagcagagcagcagctcctttgagcttattggaatggcagaccc

SEQ ID NO: 8842 - DNA, 201 bp, Homo sapiens
tccttcagaggcgtggtaagtcggctttctctgctagcgctgagtcctgggggcctctgaagtgtgctcacacatctcctgcctgcagggcactggtgtcrggcacctcagggtctgtcccatggtggagccccatgcctcactgcctttcagacagagtagccacagctggccctatttccaggctacccgggcagcaaa

SEQ ID NO: 8843 - DNA, 201 bp, Homo sapiens
ctagccttttagggtaatttttgaactcacaagagcagcagcggaacctttgatgcaatcctgtatgtagcaccagcagagccacgtggcagagggactcrcattaggagcctcccattacagactacgtgctcctgtgcgttatcttatagggtccccacaaccaaggggagatgtgattattcatcctgtgtggctgtg

SEQ ID NO: 8844 - DNA, 201 bp, Homo sapiens
cagaacagggcatgtcttggttcactgcagggcggctcttctcattctctgtagtttggggtccaggatagtggtccacggagccactggagtgcccagcyactgagtgaccaaagcatattttggatttccgacattgccacagcatggttgggcatcagcaggaccccaaccccttgttatgctggtggctttatgtgg

SEQ ID NO: 8845 - DNA, 201 bp, Homo sapiens
ccagggggatggagaagccgaagcaggagtgtttgttctgcaggctctggagtaggcattgggtctgtgccggctcacttgctagtcttgcatccttcccyaaccccctctggggatgtctggccacatcagaagacagtttgggttgtcagaactgggggagtaccaggccgaggtgggtggatcatgaggtcaggagat

SEQ ID NO: 8846 - DNA, 201 bp, Homo sapiens
atgctgtgtcatcacccgttgagtgcgctcataggcatcttcctgacaattagaacccattattcttcaaattcaatgcaagcaaattcaaagcattactrtgtacataccgcatgctaatcaattgcaccactggagctcctaaattcaaaacattactataaaaaagttcaaaatgcatggaaaagttgtacatggcag

SEQ ID NO: 8847 - DNA, 201 bp, Homo sapiens
acccgttgagtgcgctcataggcatcttcctgacaattagaacccattattcttcaaattcaatgcaagcaaattcaaagcattactgtgtacataccgcrtgctaatcaattgcaccactggagctcctaaattcaaaacattactataaaaaagttcaaaatgcatggaaaagttgtacatggcaggagaatatttggg

SEQ ID NO: 8848 - DNA, 201 bp, Homo sapiens
attactgtgtacataccgcatgctaatcaattgcaccactggagctcctaaattcaaaacattactataaaaaagttcaaaatgcatggaaaagttgtacrtggcaggagaatatttgggcttctgactaccccttgaatgaagatgatccaccagccgccttcctccttggtcttcactccagattcctagcatttcatt

SEQ ID NO: 8849 - DNA, 201 bp, Homo sapiens
ttcctccgtgtggaagggcgggctggggagagcctcccagctggaatcttttggatgcctttctctgtgggtatctgatggctggctctgatggctggctstgatggctgtggctggaaatcattgttgacatgagtttcacagatgcaggctctgtccaaattgtagcaaaagctgcctgccccagccgagctatgggca

SEQ ID NO: 8850 - DNA, 201 bp, Homo sapiens
ctctgtgggtatctgatggctggctctgatggctggctctgatggctgtggctggaaatcattgttgacatgagtttcacagatgcaggctctgtccaaaytgtagcaaaagctgcctgccccagccgagctatgggcaataaggtggtttaaggatatagatgaaggaaaactcacccttagaataatttatccaaaatg

SEQ ID NO: 8851 - DNA, 201 bp, Homo sapiens
ggacattttctgaggtcccaggttcattgtttcatttaagtctcaaaagtccctccaggtgttggttctaattgtcaaagcatggggggagatgggctcawgggttaaaggtcttatcccagatttctgtatcctccttgcaagcagcaaaggggtctggatttgaatccatgaccatgtttctcctttgggtttccatca

SEQ ID NO: 8852 - DNA, 201 bp, Homo sapiens
ggtgagggggcaggtgttctggggtgcagctcttctttgcctccctgattgccaggagctaccagttactgtctgcacaatcaaacagaaatagacctgtycttgatggttaacggaaataaaaggcgcttgtcccagaagctcaggtgaggcaccaccctgattatgggaatcacctgggaacatatacccagacctaaa

SEQ ID NO: 8853 - DNA, 201 bp, Homo sapiens
taaaaggcgcttgtcccagaagctcaggtgaggcaccaccctgattatgggaatcacctgggaacatatacccagacctaaaactcagatccacttcccargctgtggttatatagtcaggggggtgcagtatgggtattaggattttttattttttagttataaagatttttttttggtttgtttttgagacagggtctt

SEQ ID NO: 8854 - DNA, 201 bp, Homo sapiens
taaaactcagatccacttcccaggctgtggttatatagtcaggggggtgcagtatgggtattaggattttttattttttagttataaagatttttttttgrtttgtttttgagacagggtcttgctctgccgcttaggctggagtgcagtggtgcaatcatagctcactgaagcctcagactcctgggttcaagcagtcct

SEQ ID NO: 8855 - DNA, 201 bp, Homo sapiens
aaatggagatgatgatagtggtttctgtaaggccttatggtgaagcacctagctcagggcctggaaggcaggtgtaaccagtggttcagttgttataaacsaacactaaccctcgcctttgcacctcatgaatccagatatgtagatggagcccacaaagctagcaggagccaagctcacgtgtgtcctgctttaaagccc

SEQ ID NO: 8856 - DNA, 201 bp, Homo sapiens
acacctgtgctcgttctcttcccttcccctcttccccttgcatttggctaataacaggccagctgcctgcctccctgcagtttggtagatgggtgggtaaygaccaccactcccacgttcgcctgatgggcttgttttccgtgcccttcacaggcatctgcaacaggccccagccaggcctgaagtcatcctcagaaggga

SEQ ID NO: 8857 - DNA, 201 bp, Homo sapiens
cgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgag

SEQ ID NO: 8858 - DNA, 201 bp, Homo sapiens
agctgctagaccacctgcgtctcagcatcctgccctgggatgagagcatcctggacaccctctcgcccaggctcgctacaggtacccactcctcggggtgrgcacgggcagcaccttgttttctttcttgtgcattatggaggaagatggtactgccacatgggagcgatagggtgaggcaaccatgacaggtggttggga

SEQ ID NO: 8859 - DNA, 201 bp, Homo sapiens
ggaacatctccttccatgtgtacagcctgggctgctgccatcactcccagcacagcccccaacccccccaatcctggaaccttgccaagtctcccttcccrtggggtcatgaccaggaggaaaacaaactccagctgagccccttggggttccccatataggctcctgcctgtggcagctgggccctctgtacccctttcc

SEQ ID NO: 8860 - DNA, 201 bp, Homo sapiens
tgaccaggaggaaaacaaactccagctgagccccttggggttccccatataggctcctgcctgtggcagctgggccctctgtacccctttccaactctgtstccctaacatggcacctgagctcctgccatcctggatttcatggaccccaaggatgggggtcctgcatctgggacttggcctattactcggagctccttt

SEQ ID NO: 8861 - DNA, 201 bp, Homo sapiens
ccacctgtccacccacctcaaggctcctttcttgagacctctcctaatttctcccttcccctaaacccacaattttgaacctccatcgaatggtgctgtaktttataatgtcatcaaatatcaaatggagacagtgctatggtccaaatgattgtgtaccccccagaatttgtcttttgaaatcctaacccccaacatgat

SEQ ID NO: 8862 - DNA, 201 bp, Homo sapiens
tccagtgtttgggacccttcctgggggctggagtgcatccctggacaccccccaatcccatcctcttctctagtttccactgacctaggcccaccctcccstctccggctcagtactcctggaaatgagattccgtacatttgaatcttgtcctaatgaaatatttgtccatgtgggtacctgtgtgtgtgtggtgggggt

SEQ ID NO: 8863 - DNA, 201 bp, Homo sapiens
ctgtcatgaatgggattggtgcccttattaaacagacccaagagaggtcccttgtcccttctactgtgtgaggactcagaaggtggtgtctatgaagaagsaggccctcaccagacaccaacatgtctgctgccccttgatctgggaccttgcagcctctagaactctgaaaaatcgatgtttgttgttttataagccact

SEQ ID NO: 8864 - DNA, 201 bp, Homo sapiens
cttattaaacagacccaagagaggtcccttgtcccttctactgtgtgaggactcagaaggtggtgtctatgaagaagcaggccctcaccagacaccaacaygtctgctgccccttgatctgggaccttgcagcctctagaactctgaaaaatcgatgtttgttgttttataagccactcagttggtggcattttgttagag

SEQ ID NO: 8865 - DNA, 201 bp, Homo sapiens
aggtgaacgggaagcatgcacatcccatgactggagcaggagtgagagagagagggaaatagagggaaggtgccatacacttttaaacaaccagatctcaygagaacacattcactatcaagagaacagcaccagtggggaaatccgcccccatgatccaatcacctcccatcaggctccgcctccaacactgggaattac

SEQ ID NO: 8866 - DNA, 201 bp, Homo sapiens
gaagcatgcacatcccatgactggagcaggagtgagagagagagggaaatagagggaaggtgccatacacttttaaacaaccagatctcatgagaacacaytcactatcaagagaacagcaccagtggggaaatccgcccccatgatccaatcacctcccatcaggctccgcctccaacactgggaattacaatttgacat

SEQ ID NO: 8867 - DNA, 201 bp, Homo sapiens
gggaaatagagggaaggtgccatacacttttaaacaaccagatctcatgagaacacattcactatcaagagaacagcaccagtggggaaatccgcccccaygatccaatcacctcccatcaggctccgcctccaacactgggaattacaatttgacatgagatgtgggcagggacacagatccaaaccatatgaccagatt

SEQ ID NO: 8868 - DNA, 201 bp, Homo sapiens
tggtgcctgagaagtacctaggagaacatagatgctgtgacgtttgatgtagctgttttttgttttgtgttttggtttttgagacagagtctcactctgtygcccaggctggagtgtgcagtggcgtgatcttggctcactggagcctccatctcccaggttcaaatgatcctcatgcctcagcctcctgagttgctggga

SEQ ID NO: 8869 - DNA, 201 bp, Homo sapiens
ggagctgggagtggggaccctatgctccgtaagcactctcttagctgttcttggctgtgctccccgcttcagcttcacactgcccttgctgtgaagggagmagcctgggccgggcgcggtggcttacacctgtaatcctagcactttgggaggccgaggtgggtggatcacctgaggtcaggagttcaagaccagcctggc

SEQ ID NO: 8870 - DNA, 201 bp, Homo sapiens
gtggggaccctatgctccgtaagcactctcttagctgttcttggctgtgctccccgcttcagcttcacactgcccttgctgtgaagggagcagcctgggcygggcgcggtggcttacacctgtaatcctagcactttgggaggccgaggtgggtggatcacctgaggtcaggagttcaagaccagcctggccaacatggtg

SEQ ID NO: 8871 - DNA, 201 bp, Homo sapiens
ttcttggctgtgctccccgcttcagcttcacactgcccttgctgtgaagggagcagcctgggccgggcgcggtggcttacacctgtaatcctagcactttkggaggccgaggtgggtggatcacctgaggtcaggagttcaagaccagcctggccaacatggtgaaactccatctctactaaaaatacaaaaaattagctg

SEQ ID NO: 8872 - DNA, 201 bp, Homo sapiens
gtccagaggtgagcattttaggtggctccgtgtcttcctcacagggttgatatgaggatgaaacaagatgatagatcatggtggcatgtagtctgggaccyggattgtcgtgccacagatcacagctcacagtctatgtgcaatgcccctgaatgttgcccacctgtcctcaagccacacatgcacctgtaactcagtgca

SEQ ID NO: 8873 - DNA, 201 bp, Homo sapiens
tccccgtggggactcctagagctgtcagtggcctcacatagcagctggtccagtctcttgtgattgcccaaggaaactgaggcctggagagcttggggtcrctgctctgaggccatagagatgcctagtagaagggccaggcctagaagcaggatccttgctgcccctctgagctgtttccatttaaaatcacatgaaggc

SEQ ID NO: 8874 - DNA, 201 bp, Homo sapiens
aaatcacatgaaggccggcgccgtggctcacggctgtaatcccagcattttgggaggccaaggtgggtggatcatgtgaggtcaggagtttgagaccagcytggccaacatggtgaaatgccatctgtactaaaaatacaaaaattagtggagcatggtggcacgtgcctgtactcccagctacttggaaggctggggcag

SEQ ID NO: 8875 - DNA, 201 bp, Homo sapiens
cagtctctccttcaaaagccggctcctttctctccctcgccttcctagattccttctccactccccaggatcagcctcctcctccccaccccaccactgcyggggggatgtctgtggtcaggcatttatcagagaccctgaggtgggggtcctttatgtgtctgggggatggagagtctagaggaggtagcgttcagacct

SEQ ID NO: 8876 - DNA, 201 bp, Homo sapiens
tgtctcatgggaggcagctgagtcagtcagaggtcctggcacacctgctgagagctgccacccaggccaacctgaaccggagcctgggaagacttcccgtyggatgagtctctttgagggcagcattgatggtggaagagcagagaggccccagataagcagggaaaggtgcttcagacagagtggctgggatgaggactg

SEQ ID NO: 8877 - DNA, 201 bp, Homo sapiens
tgagtcagtcagaggtcctggcacacctgctgagagctgccacccaggccaacctgaaccggagcctgggaagacttcccgttggatgagtctctttgagkgcagcattgatggtggaagagcagagaggccccagataagcagggaaaggtgcttcagacagagtggctgggatgaggactggggagtgtcagatagcgc

SEQ ID NO: 8878 - DNA, 201 bp, Homo sapiens
tgctagggaagagggcagtagtggccaagtagagggtggatcctgggccctggctggcagcaggcagcaaggggggctgccagggcccaggcagggacgayctgtagaccgagaggcttcctaaggctcttggacaggaggaggtgtcggttccaagcctaaggagtggggcagccctggtgactggtggtcagtggtgcc

SEQ ID NO: 8879 - DNA, 201 bp, Homo sapiens
caggcagcaaggggggctgccagggcccaggcagggacgatctgtagaccgagaggcttcctaaggctcttggacaggaggaggtgtcggttccaagcctraggagtggggcagccctggtgactggtggtcagtggtgccaggcggtgggtggtaggacaccctggcaggcaagtaggtttgtgtgggggaaactgatag

SEQ ID NO: 8880 - DNA, 201 bp, Homo sapiens
gcaaggggggctgccagggcccaggcagggacgatctgtagaccgagaggcttcctaaggctcttggacaggaggaggtgtcggttccaagcctaaggagyggggcagccctggtgactggtggtcagtggtgccaggcggtgggtggtaggacaccctggcaggcaagtaggtttgtgtgggggaaactgataggcccct

SEQ ID NO: 8881 - DNA, 201 bp, Homo sapiens
ttcctccatgtgtttcaggtcccaaatgccagtgagcagccaacaggcctccccatgcacacctgagcaggactggccctgctggactccctgctcccccragggctgtccagcagagaccaaagcagaggccaccccgcggtccatcctcaggtccagcctgaacttcttcttgggcaataaagtacctgctggtgctga

SEQ ID NO: 8882 - DNA, 201 bp, Homo sapiens; identical to SEQ ID NO: 1299

SEQ ID NO: 8883 - DNA, 201 bp, Homo sapiens; identical to SEQ ID NO: 1301

SEQ ID NO: 8884 - DNA, 201 bp, Homo sapiens
cttcagacagtgccagtcctttttccccttctttaaaagcgatatgtggatggaggagtgagtgacaacgtacccttcattgatgccaaaacaaccatcaycgtgtcccccttctatggggagtacgacatctgccctaaagtcaagtccacgaactttcttcatgtggacatcaccaagctcagtctacgcctctgcaca

SEQ ID NO: 8885 - DNA, 201 bp, Homo sapiens
cagtcctttttccccttctttaaaagcgatatgtggatggaggagtgagtgacaacgtacccttcattgatgccaaaacaaccatcaccgtgtcccccttytatggggagtacgacatctgccctaaagtcaagtccacgaactttcttcatgtggacatcaccaagctcagtctacgcctctgcacagggaacctctacc

SEQ ID NO: 8886 - DNA, 201 bp, Homo sapiens
caccgtgtcccccttctatggggagtacgacatctgccctaaagtcaagtccacgaactttcttcatgtggacatcaccaagctcagtctacgcctctgcmcagggaacctctaccttctctcgagagcttttgtccccccggatctcaaggtgagttggtggtgagggggcaggtgttctggggtgcagctcttctttgc

SEQ ID NO: 8887 - DNA, 201 bp, Homo sapiens
gggtgtggtggctcatgcctgtcatcccggcactttgggaggccgaagcgggtgggttgcttgagcccaggagctcgagaccaacatgatgaaacccagtmtctacaaaaattacagagaaattagctaggcatggtgttgtgggcccatagtcccagctactagggaggctgaggcaggagaattgcttgagcctgggag

SEQ ID NO: 8888 - DNA, 201 bp, Homo sapiens
ccttatccctccttccttcagaggcgtggtaagtcggctttctctgctagcgctgagtcctgggggcctctgaagtgtgctcacacatctcctgcctgcarggcactggtgtcgggcacctcagggtctgtcccatggtggagccccatgcctcactgcctttcagacagagtagccacagctggccctatttccaggcta

SEQ ID NO: 8889 - DNA, 201 bp, Homo sapiens; identical to SEQ ID NO: 1291

SEQ ID NO: 8890 - DNA, 201 bp, Homo sapiens
agctgtgtctctggctgtgacggcaccctagagtgtgtgtggtgccctctactggccggcaatgtgggtccaccgtagctcagactgcacactgcagcagygggaacggcctctaagccaacttcctccatgtgtttcaggtcccaaatgccagtgagcagccaacaggcctccccatgcacacctgagcaggactggccc

SEQ ID NO: 8891 - DNA, 201 bp, Homo sapiens
gcaaggagaggaagttgaagttcactgacagggttgttaaggggattatgcaatagatgagacccatgggcctgaagtccgagggtgtatgttagttcccygttcttttgacccatggattaacctactctgtgcaaagggcattttcaagtttgttgccctgctcacttggagaaagcttatgaaggatcaggaaaatta

SEQ ID NO: 8892 - DNA, 201 bp, Homo sapiens
tgtcctccctccatatcagcctgtttgtggctctgagaagctctgcccacatgtgaaagcttgttaagcacttaagcactaacccagagcttcagacagtrccagtcctttttccccttctttaaaagcgatatgtggatggaggagtgagtgacaacgtacccttcattgatgccaaaacaaccatcaccgtgtccccct

SEQ ID NO: 8893 - DNA, 201 bp, Homo sapiens; identical to SEQ ID NO: 1293

SEQ ID NO: 8894 - DNA, 201 bp, Homo sapiens
tggaaggtggagctttactcttagggggaactataacagtcatatatatatatttttttcttttcttttttttttttttgagatggagtctggctctgtckcccaggctggagtgcagtggtgcaatctcggctcactgcaacctccacttcacaggttcaggcaattctcctgcctcaacctcccgagtagctgggatta

SEQ ID NO: 8895 - DNA, 201 bp, Homo sapiens; identical to SEQ ID NO: 1300

SEQ ID NO: 8896 - DNA, 201 bp, Homo sapiens
tgaggcaggaaaatggcttgaacctcggaagcggaggtggccgttagccgagatcacgccactgcactccagcctgggcaacagagcaagactctgccttaaaaaaaaaaaaaagaaagaaaagtaaaaggaaaaaaaagaggctctggcctgctggggtgcctgcaaagtctccgtggaagggtgacattcaagccgaga

SEQ ID NO: 8897 - DNA, 201 bp, Homo sapiens
ggcttgaacctcggaagcggaggtggccgttagccgagatcacgccactgcactccagcctgggcaacagagcaagactctgccttaaaaaaaaaaaaaaraaagaaaagtaaaaggaaaaaaaagaggctctggcctgctggggtgcctgcaaagtctccgtggaagggtgacattcaagccgagacctccagggaactg

SEQ ID NO: 8898 - DNA, 201 bp, Homo sapiens
catcctctgtttaaccttgtttgcggaagctttctctaaacagccagcacttgtctgttcccacatgggtccgttctcccagtgaatcaccgtggtgcctrctgactgctctgtagcacagtgcttcgcaaagtgtgatcctgggaccagcagagcagcagctcctttgagcttattggaatggcagaccctcaggtccca

SEQ ID NO: 8899 - DNA, 201 bp, Homo sapiens
tggaccactcttaggtcctcctgccccacttccatctgggtgtgtgccctgggctgtccaccacacagctacatcctgccatcttccctcctggagccacygtgccatgcatggatctgtagcttcatttttcttggcttttccctggtttttctggagcagagtctctagtaaactcccaaggaagaaaacgtttgactt

SEQ ID NO: 8900 - DNA, 201 bp, Homo sapiens
tcagaaggtggtgtctatgaagaagcaggccctcaccagacaccaacatgtctgctgccccttgatctgggaccttgcagcctctagaactctgaaaaatygatgtttgttgttttataagccactcagttggtggcattttgttagagtagcctgaacacggactaagtcaaacagaagaacccacaaaccagctacaga

SEQ ID NO: 8901 - DNA, 201 bp, Homo sapiens
gtctgcgttgacaggccccaggggatgccgctacttcctgaattctgaattctggaaactgagccggagttcagggcctggctcccattaccagggttggrcgttatcctgaaaatcataggccttggtttcctcacttggctaacaggggtgatccccatcccctcaatgggtttccgtgagctcctgagagcccgtagc

SEQ ID NO: 8902 - DNA, 201 bp, Homo sapiens
ccttatggtgaagcacctagctcagggcctggaaggcaggtgtaaccagtggttcagttgttataaaccaacactaaccctcgcctttgcacctcatgaawccagatatgtagatggagcccacaaagctagcaggagccaagctcacgtgtgtcctgctttaaagccccatacccctttctccgggtgacaaacacctgt

SEQ ID NO: 8903 - DNA, 201 bp, Homo sapiens
tggggagcaaggagaggaagttgaagttcactgacagggttgttaaggggattatgcaatagatgagacccatgggcctgaagtccgagggtgtatgttarttccccgttcttttgacccatggattaacctactctgtgcaaagggcattttcaagtttgttgccctgctcacttggagaaagcttatgaaggatcagga

SEQ ID NO: 8904 - DNA, 201 bp, Homo sapiens
tgcctctttgccaggcacttttgtgcagtgcacacactgtacaacagtagacggcaaccctgagagccagagtagagcctgtcctagcaccggaatgctcsgtaaggatttgtcgcaggagtgattccaaagccaatgtcctccctccatatcagcctgtttgtggctctgagaagctctgcccacatgtgaaagcttgtt

SEQ ID NO: 8905 - DNA, 201 bp, Homo sapiens
cagataaaaggtatgggcattaggccagggcactgcaatttctaagctgtgtgacctcaggcaagttactcgacttctctgagcctcagcggtttcatccrcaatatatggataggaaaaccgacctcagtgggttgtctgacagtggagggcacttgattaaaaaaaaaaaaattaccctggtctgaatattaccctgga

SEQ ID NO: 8906 - DNA, 201 bp, Homo sapiens
atctttcgttctaggcatagtttgttaatatgattcagagccagcagttaggagaacacagtgtgactctcctagaacttcttgattgggcttcctctgaktgggtttcctctgattgggcttcctctgaaagtgggggggatggggggtggggagcagaatggtcagagcttggctcagcagtcagactgctcttcttca

SEQ ID NO: 8907 - DNA, 201 bp, Homo sapiens
gttccagggcagtttcttttcttcactttttatctcttttttttgggtgggggggcggggtacagagtcttgctctgtctcccaggctggagtgcagtggygcaatctcaacctcccgaggagctgggactacaggcacaggccatcacaccttgctaatgtttgtactttttgtagagacggggttttgccctgttgccc

SEQ ID NO: 8908 - DNA, 201 bp, Homo sapiens; identical to SEQ ID NO: 1298

SEQ ID NO: 8909 - DNA, 201 bp, Homo sapiens
ctagtttttctgtttcttcatctttctcttttatgctacttattctgggcgtgttcttggtgggttttttcccatatagcaacagaggacttggagctcarggagaaaagggtaggtgcatcacctggcagagctcccagacagtgacaggcaggctgcgggaaggatgtctacttggcggtgctaccgctttcctagaaa

SEQ ID NO: 8910 - DNA, 201 bp, Homo sapiens
gacttggagctcagggagaaaagggtaggtgcatcacctggcagagctcccagacagtgacaggcaggctgcgggaaggatgtctacttggcggtgctacygctttcctagaaaccctttccctggagctggttgaactgttgggttttgccctggtggtgaacgctggctccccgtgctctgcctgtttcatcaccagcc

SEQ ID NO: 8911 - DNA, 201 bp, Homo sapiens
tagtttccactgacctaggcccaccctcccctctccggctcagtactcctggaaatgagattccgtacatttgaatcttgtcctaatgaaatatttgtccrtgtgggtacctgtgtgtgtgtggtgggggtgcagacggagggtttgtttctcactagctggaactactggggtgtggtatgcttcctgggaatttgtgtg

SEQ ID NO: 8912 - DNA, 201 bp, Homo sapiens
ccagcctgggcaacaaagcgagactccgtctcacaaaaaaaacaaaacaaaacaaaacaaaatctgggggagtgccactggcatctgatgtatagaggccygagatgctgtgtcatcacccgttgagtgcgctcataggcatcttcctgacaattagaacccattattcttcaaattcaatgcaagcaaattcaaagcatt

SEQ ID NO: 8913 - DNA, 201 bp, Homo sapiens; identical to SEQ ID NO: 1306

SEQ ID NO: 8914 - DNA, 201 bp, Homo sapiens
atacaaaaattagtggagcatggtggcacgtgcctgtactcccagctacttggaaggctggggcagaagaatcgcttgagcctgggaggcagaggttgtastgagccaagattgtaccactgcactccagcctgggtgacaggagagaaaccctatctcaaaataaaatgaaaggtaatgaaatgaataaaataataaatc

SEQ ID NO: 8915 - DNA, 201 bp, Homo sapiens
tcctgacaattagaacccattattcttcaaattcaatgcaagcaaattcaaagcattactgtgtacataccgcatgctaatcaattgcaccactggagctyctaaattcaaaacattactataaaaaagttcaaaatgcatggaaaagttgtacatggcaggagaatatttgggcttctgactaccccttgaatgaagatg

SEQ ID NO: 8916 - DNA, 201 bp, Homo sapiens
ctggctctgatggctgtggctggaaatcattgttgacatgagtttcacagatgcaggctctgtccaaattgtagcaaaagctgcctgccccagccgagctrtgggcaataaggtggtttaaggatatagatgaaggaaaactcacccttagaataatttatccaaaatgctgctgtgttgtgggttagaggacattttctg

SEQ ID NO: 8917 - DNA, 201 bp, Homo sapiens
tgggaagttctggtcttgccatttgtccctggaccactcttaggtcctcctgccccacttccatctgggtgtgtgccctgggctgtccaccacacagctayatcctgccatcttccctcctggagccactgtgccatgcatggatctgtagcttcatttttcttggcttttccctggtttttctggagcagagtctctagt

SEQ ID NO: 8918 - DNA, 201 bp, Homo sapiens
tgcttctgaaagggagggaatgagccagcccatccccagttgctttttaagatcattgggaagttctggtcttgccatttgtccctggaccactcttaggycctcctgccccacttccatctgggtgtgtgccctgggctgtccaccacacagctacatcctgccatcttccctcctggagccactgtgccatgcatggat

SEQ ID NO: 8919 - DNA, 201 bp, Homo sapiens
gaagagggggtcaggagtggtgaaaaatgggagaggagggcaggctgggccttttggatacagggggattgcatcctgcagtggtagggagccactgaggrctgctgcagtaggagtgaggggatcagaggagagctttggaagccccctggatgcgggacaggaagggagataccagtgtctaggaggccagtgaggcag

SEQ ID NO: 8920 - DNA, 201 bp, Homo sapiens
tgtatttttagtagagacagggtttcatcatattggccaggctggtctccaactcctgacctcaggtgatccgcccgccttggcctcccaaagtgctgagrttacaggcgtgagccatggtgcccggccaacaatcacatgtgttgtaaacaacaacaaaaatctgtcagcctggtctaacctagatttgtgctttgtttt

SEQ ID NO: 8921 - DNA, 201 bp, Homo sapiens
gcgtgagccatggtgcccggccaacaatcacatgtgttgtaaacaacaacaaaaatctgtcagcctggtctaacctagatttgtgctttgttttgttttgmcactttgtgatgcacaggaggaagtttaggctgtaaaatactagccttttagggtaatttttgaactcacaagagcagcagcggaacctttgatgcaatc

SEQ ID NO: 8922 - DNA, 201 bp, Homo sapiens
caggagaatggtgtgaacccggggggcggagcttgcagtgagctgagatcctgccactgcactccagcctgggcaacaaagcgagactccgtctcacaaamaaaacaaaacaaaacaaaacaaaatctgggggagtgccactggcatctgatgtatagaggcccgagatgctgtgtcatcacccgttgagtgcgctcatag

SEQ ID NO: 8923 - DNA, 201 bp, Homo sapiens
agttgctgggattacaggtgcacaccaccacgcctggctaatttttgtgttttcagtagagacagggtttcaccatgttggccaggctggtcttgaactcytgacctcaagtgatccaacaacttcagcctcccaaagtgctgggatgacaggcatgagccaccatgcccagcctgatgtagctgtttctgtgcacattat

SEQ ID NO: 8924 - DNA, 201 bp, Homo sapiens
atggtgaaaccatgtctctactaaaaatacaaaaattagctgggcatggtggtgcatgcctgtaatcccagctactccggaggctaaggcaggagaattgmttgaagcaggacctaggaggcggaggttggttgcagtgagccgagatcatgccactgcactctagcctgggctacagagcgaaactccgactcaaaaaaa

SEQ ID NO: 8925 - DNA, 201 bp, Homo sapiens
atatttttttcttttcttttttttttttttgagatggagtctggctctgtcgcccaggctggagtgcagtggtgcaatctcggctcactgcaacctccacytcacaggttcaggcaattctcctgcctcaacctcccgagtagctgggattacaggtgcctgccgttacgccaagctaatttttgtatttttagtagagac

SEQ ID NO: 8926 - DNA, 201 bp, Homo sapiens
cagtggtgcaatctcggctcactgcaacctccacttcacaggttcaggcaattctcctgcctcaacctcccgagtagctgggattacaggtgcctgccgtyacgccaagctaatttttgtatttttagtagagacagggtttcatcatattggccaggctggtctccaactcctgacctcaggtgatccgcccgccttggc

SEQ ID NO: 8927 - DNA, 201 bp, Homo sapiens
tggagtctctctgtgtcctccaggctggagtgcaatgtcgcgatctcagctcactgcaacctccacctcctgggctcaagagattctcctgcttcagtctsctgagtagctgggattacaggcatgtgccaccacacctggctaatttttgtatttttagtagaggtggggtttggcatgttggccagcctggtctcaaac

SEQ ID NO: 8928 - DNA, 201 bp, Homo sapiens
tttaaaaaacaaaataatctagtgtgcagggcattcacctcagccccccaggcaggagccaagcacagcaggagcttccgcctcctctccactggagcacrcaacttgaacctggcttattttctgcagggaccagccccacatggtcagtgagtttctccccatgtgtggcgatgagagagtgtagaaataaagacacaa

SEQ ID NO: 8929 - DNA, 201 bp, Homo sapiens
cttgaacctcggaagcggaggtggccgttagccgagatcacgccactgcactccagcctgggcaacagagcaagactctgccttaaaaaaaaaaaaaagaragaaaagtaaaaggaaaaaaaagaggctctggcctgctggggtgcctgcaaagtctccgtggaagggtgacattcaagccgagacctccagggaactgtc

SEQ ID NO: 8930 - DNA, 201 bp, Homo sapiens
caacctactcatgagcccaggagataggaaatctccgtcccattgtacagatggggaaacagaattttggaaaggagagccaagcagcacacacccctccmtgaggggcagagccgagatttgaactgggatgtcatgactccagggccctctccctccccagggtccccttatctgaaggcggtttttctttccagctcg

SEQ ID NO: 8931 - DNA, 201 bp, Homo sapiens
agggggtcaggagtggtgaaaaatgggagaggagggcaggctgggccttttggatacagggggattgcatcctgcagtggtagggagccactgagggctgytgcagtaggagtgaggggatcagaggagagctttggaagccccctggatgcgggacaggaagggagataccagtgtctaggaggccagtgaggcagccag

SEQ ID NO: 8932 - DNA, 201 bp, Homo sapiens
attgcatcctgcagtggtagggagccactgagggctgctgcagtaggagtgaggggatcagaggagagctttggaagccccctggatgcgggacaggaagsgagataccagtgtctaggaggccagtgaggcagccagaggctccaccaggatcagggctgcgagggtcatgaggaggaaaccaatttgaaggagtccagg

SEQ ID NO: 8933 - DNA, 201 bp, Homo sapiens
aacccagtctctacaaaaattacagagaaattagctaggcatggtgttgtgggcccatagtcccagctactagggaggctgaggcaggagaattgcttgarcctgggaggtggaggttgcagtaagtcatgatcatgccactgtactccagcccgggtgacagtgagatgctgtctggaaaaaaaaaaaaaagaaagactg

SEQ ID NO: 8934 - DNA, 201 bp, Homo sapiens
aggtaataatgatgatcgtaaaattagagacagataaaaggtatgggcattaggccagggcactgcaatttctaagctgtgtgacctcaggcaagttactygacttctctgagcctcagcggtttcatccgcaatatatggataggaaaaccgacctcagtgggttgtctgacagtggagggcacttgattaaaaaaaaaa

SEQ ID NO: 8935 - DNA, 201 bp, Homo sapiens
gggcaacagagcaagactctgccttaaaaaaaaaaaaaagaaagaaaagtaaaaggaaaaaaaagaggctctggcctgctggggtgcctgcaaagtctccrtggaagggtgacattcaagccgagacctccagggaactgtctcctgggagcacagagccctttgctcagcccccaggtggctcagtgcccccagccagca

SEQ ID NO: 8936 - DNA, 201 bp, Homo sapiens
ctcatcccatagtaagcatccagctagagatgttgatttctattttcaggtaataatgatgatcgtaaaattagagacagataaaaggtatgggcattagrccagggcactgcaatttctaagctgtgtgacctcaggcaagttactcgacttctctgagcctcagcggtttcatccgcaatatatggataggaaaaccga

SEQ ID NO: 8937 - DNA, 201 bp, Homo sapiens
agaaagcttatgaaggatcaggaaaattaaaagggtgctctcgcctataacttctctctcctttgctttcacaggccttggtatgttcctgcttcatcccyttctacagtggccttatccctccttccttcagaggcgtggtaagtcggctttctctgctagcgctgagtcctgggggcctctgaagtgtgctcacacatc

SEQ ID NO: 8938 - DNA, 201 bp, Homo sapiens
tggagaaagcttatgaaggatcaggaaaattaaaagggtgctctcgcctataacttctctctcctttgctttcacaggccttggtatgttcctgcttcatscccttctacagtggccttatccctccttccttcagaggcgtggtaagtcggctttctctgctagcgctgagtcctgggggcctctgaagtgtgctcacac

SEQ ID NO: 8939 - DNA, 201 bp, Homo sapiens
aatgaagatgccttctcactggaaaccctacaagggtgggaacgtgccttatttgcctgtatcctcagggtctagcagagagaagataatctgtaataccraaacaccattaaattcagctgatgctttcataagcgctccttggaggaaggactccatttacttgacagatctgtgcaagacagcagcctggcgcgtcta

SEQ ID NO: 8940 - DNA, 201 bp, Homo sapiens
ccttggaggaaggactccatttacttgacagatctgtgcaagacagcagcctggcgcgtctaacctgcagccagttgcatcctctgtttaaccttgtttgyggaagctttctctaaacagccagcacttgtctgttcccacatgggtccgttctcccagtgaatcaccgtggtgcctgctgactgctctgtagcacagtgc

SEQ ID NO: 8941 - DNA, 201 bp, Homo sapiens
attaacctactctgtgcaaagggcattttcaagtttgttgccctgctcacttggagaaagcttatgaaggatcaggaaaattaaaagggtgctctcgcctrtaacttctctctcctttgctttcacaggccttggtatgttcctgcttcatccccttctacagtggccttatccctccttccttcagaggcgtggtaagtc

SEQ ID NO: 8942 - DNA, 201 bp, Homo sapiens
tggacatgtcttttcaaggaaaataaaagcaggctttctggaatggcgacttccaaacatatttgtcaatttaaaggagctgggagtggggaccctatgcyccgtaagcactctcttagctgttcttggctgtgctccccgcttcagcttcacactgcccttgctgtgaagggagcagcctgggccgggcgcggtggctta

SEQ ID NO: 8943 - DNA, 201 bp, Homo sapiens
gcgttatcctgaaaatcataggccttggtttcctcacttggctaacaggggtgatccccatcccctcaatgggtttccgtgagctcctgagagcccgtagmatggtacttggcacatgctgggcatcaggaggtatggcctctcttgctattgttgttattggtagacacagaaggatttaaaagtaggggaatgcaaaga

SEQ ID NO: 8944 - DNA, 201 bp, Homo sapiens
ctgcgttgacaggccccaggggatgccgctacttcctgaattctgaattctggaaactgagccggagttcagggcctggctcccattaccagggttgggcrttatcctgaaaatcataggccttggtttcctcacttggctaacaggggtgatccccatcccctcaatgggtttccgtgagctcctgagagcccgtagcat

SEQ ID NO: 8945 - DNA, 201 bp, Homo sapiens
gtacccctttccaactctgtctccctaacatggcacctgagctcctgccatcctggatttcatggaccccaaggatgggggtcctgcatctgggacttggmctattactcggagctccttttcagccgcctccctccacctgtccacccacctcaaggctcctttcttgagacctctcctaatttctcccttcccctaaac

SEQ ID NO: 8946 - DNA, 201 bp, Homo sapiens
aaaaattagctgagtgtggtggcacacacctgtagtcccagctactcgggaggctggggcaggagaatcacttgaacctgggaggccgaggttgcagtgakccgagatcacgctgctgcactccagcttggggacagagcgagactgcatctcaaaaaaaaaaaaacatacaaaaaaggtatatatgactatagccctttt

SEQ ID NO: 8947 - DNA, 201 bp, Homo sapiens
attccattcatctctgaagtgtatgcagtaatggcctcattcggctgagatttcccagcagcaaaaaatgtgcttggcagaacagttgctctaaatacctkggacatacattctttctaggattaaacaaataatacttgctgccctttgtataaaaagatcacttttctggtgcaccattagtgtacatttgatttgatt

SEQ ID NO: 8948 - DNA, 201 bp, Homo sapiens
aggatctttgttacacatttttatttttctcaattttggattttttgagggtgcgaatttacttagctgagaaatttagaagtcctttattcagtctagtmtaaagtgtccagataaaaacataccttagagatattgtgggtgcagttccagaccaccacaataaagcagataccacaataaagcaagcatataaattgt

SEQ ID NO: 8949 - DNA, 201 bp, Homo sapiens
agcatgtctcatctaacactccaggatctttgttacacatttttatttttctcaattttggattttttgagggtgcgaatttacttagctgagaaatttaraagtcctttattcagtctagtataaagtgtccagataaaaacataccttagagatattgtgggtgcagttccagaccaccacaataaagcagataccaca

SEQ ID NO: 8950 - DNA, 201 bp, Homo sapiens
aacatcagtgttcaaaatcccaaaatattattctcatcagcaaaatattgctcctacacacaaggtacctcttctccttttttcacttgctaataataatrgcaagtattaatataaggtatttgttgagcaattattaaatatgtcatctctaacacaacagtccaaaaagacaggcctaagttcttctactttatagat

SEQ ID NO: 8951 - DNA, 201 bp, Homo sapiens
tcccaaaatattattctcatcagcaaaatattgctcctacacacaaggtacctcttctccttttttcacttgctaataataatggcaagtattaatataargtatttgttgagcaattattaaatatgtcatctctaacacaacagtccaaaaagacaggcctaagttcttctactttatagatattgagactcatagagg

SEQ ID NO: 8952 - DNA, 201 bp, Homo sapiens
gtttcatttcttttttgaaaagtaaaaagaaaatttacaaaactataaaacaagttatatatatgtatatataaaactagcatattaacaaatatatatgrgtaattatataaaattatttatacatatataattacccatatatatttttcataattacccatatatatgtatatgtatatatatataattacccatata

SEQ ID NO: 8953 - DNA, 201 bp, Homo sapiens
atatatatgtatatgtatatatatataattacccatatatatgtatgtgtgtatatatatataattacccatatatatgtgtgtgtgtgtgtgtgtgtgtrtatataattacccagaattaaacacctttaggtgtaattagagtacattaaaatttggcatactttcctttagttcttttctaaattataaaagtaacat

SEQ ID NO: 8954 - DNA, 201 bp, Homo sapiens
cacatgggtcattaaagtccgtctgtaaagtctcagggactttctcatcattttccctaaacctaatgcaagatattcacatttctttttgtgcaaagaasaatcttaattcagctgataatcggggcctcccttaccttcccactgctcactataacagagaacaagtactagctcataactttttatgactttgtattg

SEQ ID NO: 8955 - DNA, 201 bp, Homo sapiens
gatgaacagagggagagattcaacaccaaatgcgtccctcttctgaatcccatctctcgaatcagacagcacttctgtgtacttcccaatatccatacaartaccaggaaacttattttacttgcctctggccttggtttgcaggtttggggaaacacaggagtcaaacagaatttttttgggtgaacccacagatttcac

SEQ ID NO: 8956 - DNA, 201 bp, Homo sapiens
gaaaacccttcaccagaagcaaatagatacccctgcaaatatctggtaatttcggccgggcgtggtggctcacacctgtagtcccagcactttgggaggcygagatgggcggatcacgagctcaggagatcaagaccatcctggctaacacgttgaaactccacctctactaaaaatacaaaaaattagccgggcatggtg

SEQ ID NO: 8957 - DNA, 201 bp, Homo sapiens
ccatcggcaccagctttgggggcatggagaggcagcggagagatgggggacgggttgtcagtcttggatgaacagtggagcggtcgggttggcgtctgggyattgtgtgtgcttgtgtctctgtgtgtgtgtgaaattttttcatcccaccaccaatctccccctccatcctcccccaattctgccatgatcttgccttct

SEQ ID NO: 8958 - DNA, 201 bp, Homo sapiens
tcactgcactccagcctgggtgacagagcaagactctgtctcaaaaaaaaaaaaaaaaaaaaaaaaaaaaagaatacaagagagtgtgacccatagttcaractactcaagtctatgtgggtctgcttcctgaacagctggtaaacagtggagaaagccatactcaaatgaatttcctttcaatttcagtgcgtcctttca

SEQ ID NO: 8959 - DNA, 201 bp, Homo sapiens
gaaattgccaccggaatgtaccctctctacttccctaactcctctctttacttctttggcccgttctttctgccacaacctaccactaaagatcctgcttwgaatgaaccaaggtcccaggggattgttgcataggcataagggttgttcttggaagcctctgggtttgttgatacagaggatccctatggctccttgatg

SEQ ID NO: 8960 - DNA, 201 bp, Homo sapiens
attgatagtcctctccaattagggtacaaaaagattatttttttcttcagaaattgagtggatggtctgctgctgtaggtttcattctcaacatcattttrtcccttcctaaaaatatccatttttaaactgctgatttattttggccatcgtccccacaaactttttgtaaagcatcagtgattttaccattctctcacc

SEQ ID NO: 8961 - DNA, 201 bp, Homo sapiens
tgcagtgatggatccaaaaggtggtagctgtgctgttgtcaactctgctctctgtggcatgtcctcttgaaagagatctcagtggtgcacttccatggctrccctcataggggagggccaggccacccagagagcaatgaggcatttgctgaaacacagcgagaggggagggagagcaaaacatatttttccagacccggg

SEQ ID NO: 8962 - DNA, 201 bp, Homo sapiens
tccagagcagtaacagacagctgtgcccagcactttcttctaaaagttggagatgctggatggaaaatttgtcattgtttacatagcacccacacacacamaaaaaatcctgactcactagcttctgtgttgtcattttttggtccatggttctattgctgcctaattttcatacgggaccctcacagtggttagtctgca

SEQ ID NO: 8963 - DNA, 201 bp, Homo sapiens
ggtatagggcagaacagtggttctcaatttagctgcatgttaagattgtcttgggggaatttaaactccagaccacaccccaggctaattaaatcagaatmtcttggcatgggatccaagcatttgtatgtttttaaagctctccacataattcctgtgcacaatcaaggttaaggactaactagtacaagatcaagggag

SEQ ID NO: 8964 - DNA, 201 bp, Homo sapiens
gacatgcaagaatcttattgagggagatgcctatgtaggattaaaggggagggagcaggaaggagggagagtgttcagaccttgatgcacacctgactccrgtgaaaggagacagcaaggaaagattgagtaggaagagcctcctctgcagcccagctctgagaaagtctcagccaggctgatgggaagtccccaagcaag

SEQ ID NO: 8965 - DNA, 201 bp, Homo sapiens
aaaagttggagatgctggatggaaaatttgtcattgtttacatagcacccacacacacaaaaaaaatcctgactcactagcttctgtgttgtcattttttkgtccatggttctattgctgcctaattttcatacgggaccctcacagtggttagtctgcacagtaaggagtcaactgtgacatcctcatccttgaatgcta

SEQ ID NO: 8966 - DNA, 201 bp, Homo sapiens
atggaaaattcaaccttgtttctctgttttcatacaaagtggggttcttggaattcttagaaaatggggaggaccctttgcacaggctgaagttgtgtgaraagtctggacagagtttccagctttcaaaatttagtaggggaaaactaaatagaggctttctcccttgtctcaaaactggattttaatttgcacactgct

SEQ ID NO: 8967 - DNA, 201 bp, Homo sapiens
cttgttggaggttattttatgggattcatttttggtgttccatggcttttcagaggaggctcagtgtccactgatagtctctgggaagactacgtaggcayaggtccgaccattgctatattttcttatatctatgaaatcctaagttaacattttaaactacagtctactgtgtgtcaagtgttgtcctaggctcttatt

SEQ ID NO: 8968 - DNA, 201 bp, Homo sapiens
aatgcgctacttattaaactttattttcccactgaagaaagaaaatcctaccttcagggaataaaatagagattcattttctgacctcctagtataatgcyaaaggaaaagcatacaatctctttggggagggagctgttaggaaggccagaggcagctgtcttggaaacatacagaaaggtgctattgggacagagcata

SEQ ID NO: 8969 - DNA, 201 bp, Homo sapiens
gttaaactttataaccacaccaagatcattgagctagtaagtggcaggcttgggatttaagaaagcttgtaatgatgttacatttgatggtttaaactgtsctgtgggaagggaatccaagaagataatcccatgtttctgcttcttgtgatgtttgcaaatctgtgttctggagtaagtctttgagttgactcttggagc

SEQ ID NO: 8970 - DNA, 201 bp, Homo sapiens
aagggaaaattcttatttcggagtcactgttcagaatgaaaatgtgagactaagtatttgttttgcaaagcgcaacagaatagagaagaaaagttgggcawtctgtagggcgacccatttggaaaaataaatcctaccccttttgaaggggagaaattaatgagatgagtgtcagtccctccctccccacccactgacctc

SEQ ID NO: 8971 - DNA, 201 bp, Homo sapiens
tttgattaaatattttctatttagagagggtaaataattctcttttgggactccagggggcctagccaactggctgttttattcattcatttgacttgtgmttctttagtgctttctacaagctaactcctgggttaggctttagaaatacaatgttgaacaagacaggtacatcgctgtttttatggagcttgctgccta

SEQ ID NO: 8972 - DNA, 201 bp, Homo sapiens
gggttggcttttctgcataattccaaagctaggctgacggcagagatagcaatattgcccttaggaagagctggatgggttctttgcagagggcagatggrtggcagattgcagccctggctattttattgcccagtaggaatctttactggttgtctgaaatctgatcagaaccaagagccttcaaattaaatgtgctcg

SEQ ID NO: 8973 - DNA, 201 bp, Homo sapiens
atccataactgtaccatatttcctttctgtatgttgagagatacacatggtcaaatttcctaaaacctgaatctaactcaatctaaattatatgatttccrtttctacacagtggaacaagtgtgtgtgaaataaaatcaccagcccagaggcattcacccaaataaatcttggagattttctgcaacatttcatccctct

SEQ ID NO: 8974 - DNA, 201 bp, Homo sapiens
gatgagcattttcttttacattctggacacacacataaaaaaacttttctatcattaacctgccacagccttatggaaattctgagaagtccagttcagcytcataacgcgtgaacgttatttatcttgaatgctgcaaatttggcatattggtggggggtgacaaggttaggtagatttattagcatcctgtcaggaaat

SEQ ID NO: 8975 - DNA, 201 bp, Homo sapiens
aactgctccaagaagcctttctcgagctcatgctccccttcaccaaactgccacaacaacctgtgtgaatcttgatcaccaagcttacagtgctgtttgarataattatctgctcaagtttctggtgttcccattagactgtcagtgcctcatcgatgtgctcagcctctagctgtgaatggtgcacaggtgaccccagtg

SEQ ID NO: 8976 - DNA, 201 bp, Homo sapiens
tctgtatagatattggcactgcccttgttttccagattatctctggagtgctctgagggatcagttggttggccaacaaataccatttgtgcctcaggctytttgtaaaacctaggggaatgtctgaatttcccttgattgagacatctcccttccctgtcaagtcctgaaggagctgtaaactcaaggaataatgccaaa

SEQ ID NO: 8977 - DNA, 201 bp, Homo sapiens
aatcaatatctaacggtattctttaagaccctgaatccagccacacttgaaccatttttctaaaggaatgtgaattcatagtgtttttcttttatcttggktctatgttatttgattttaaaatatattaaaatctagcaatgttattttatatgtggctgatacattatatatccatagtcaaggagatagcactaatca

SEQ ID NO: 8978 - DNA, 201 bp, Homo sapiens
agcttgtctgaactatggagggaaaaatagagaatcaatatctaacggtattctttaagaccctgaatccagccacacttgaaccatttttctaaaggaaygtgaattcatagtgtttttcttttatcttgggtctatgttatttgattttaaaatatattaaaatctagcaatgttattttatatgtggctgatacatta

SEQ ID NO: 8979 - DNA, 201 bp, Homo sapiens
tattcctttcagatagactctagtatataatatcattctgctattcatcaggaagtggctgaataatttattatacaacttgtctatagatcagagtagaygaataataaaatctttagtatgtaaaaaccttacaagaaagttgagacttatggtagcaaaggatccagaaggattgggtcattttgtagttattagtaa

SEQ ID NO: 8980 - DNA, 201 bp, Homo sapiens
gagatttcactaataggagggcaggagttgagcacagatccaatagaggaaaaatactgtcttcaggcagataggggatgtgccactggggccgagatgaygagtttcgtgaaaaacagagttcaaaagaggaggctcttgagtgtaaagataatttgaggggaaaagaaaaaaatagaatgtgactggaaggaacggaat

SEQ ID NO: 8981 - DNA, 201 bp, Homo sapiens
tacaataaaatgtgactaatatgtttttttctaaaacccagtcccatataggtgtcggatccacagaagtaatttaagaatggtttatttgaagatctctwtgtataatttatagatttctcagtgtgattaagaaatgaagttattacatttttttctctaattagtaatgcacgtatgcctccttttaatgatattatg

SEQ ID NO: 8982 - DNA, 201 bp, Homo sapiens
ataaataaccaaacatgagaggaatgagaggagatggggatggggagtgggaggaagagggtagatagaaataaaaggaagaacaacattacagagaagcrgagatgacacagagggtggacacgtgggaaggcctggatcacaggggaaagagtgagccccaaaataacactgtggcttttgcagcaaggaggaaataag

SEQ ID NO: 8983 - DNA, 201 bp, Homo sapiens
ttgaggttcagagaggttgctacttatatggtagcaaaagtatttcccttccctacttaccctactatacaaaacaaacaaacaaacaaacaaacaaaaamccagaaaacttgatgataaatgtcaatcaacactcagcctctgcatctgatgagcaacagaaattagcggggactgtggtgaattggaaaacctgtgcct

SEQ ID NO: 8984 - DNA, 201 bp, Homo sapiens
gtatttagaatacagtatattttgattttggtgttgaaaaaggtgtggaggtatgcagggaaaaatctcacatgcttttacctacacacacacacattcaygcaacacaaagtgcacgcacatattggtcttgaaattccccaaggaccaaaatggacccatgtgatgagtctgtgttataacagggaatctaccgtaggt

SEQ ID NO: 8985 - DNA, 201 bp, Homo sapiens
ttcaggtcacctatgtataaagtgagaaataaaggctggctaggagtcagccatgggaaggggatagaataagttgaacattcatggtaaagagaatactrtattcaagatcctaaagcataatatgtttggaaaacagaaaatacagtatggccagaaggcagaactcaaaggagaatgagagccagcggatgcggtagg

SEQ ID NO: 8986 - DNA, 201 bp, Homo sapiens
acagctgtctctctttttctggctggcctgcctgcatgcctagataactgaatggcttttttcagaatgaggtatggtctaaggattttgctacttcaacrtcagtttcctggatcttttcttctactccagcttgccatatgtcccttttatattttcttggccactctcttacaaatagggccatagatcagagatggt

SEQ ID NO: 8987 - DNA, 201 bp, Homo sapiens
gcttgcactcatggctctgtgattcatgagggcagaaaaactgactggcttacagctgtctctctttttctggctggcctgcctgcatgcctagataactraatggcttttttcagaatgaggtatggtctaaggattttgctacttcaacgtcagtttcctggatcttttcttctactccagcttgccatatgtcccttt

SEQ ID NO: 8988 - DNA, 201 bp, Homo sapiens
ctttcctgactaccctgtacaaataaaaacaagaataagcctccaccctatcctagcactccttcttccgtttagcttgtccatcaccatctaacatgccrtaaattcacttctttatttgccccatccccttagattttaaagttcatgaaagtaaaactgcatctgtgtcatctactttggaacagttcctggcactta

SEQ ID NO: 8989 - DNA, 201 bp, Homo sapiens
cccggccatgtcacagttttataggcctttcctgactaccctgtacaaataaaaacaagaataagcctccaccctatcctagcactccttcttccgtttarcttgtccatcaccatctaacatgccgtaaattcacttctttatttgccccatccccttagattttaaagttcatgaaagtaaaactgcatctgtgtcatc

SEQ ID NO: 8990 - DNA, 201 bp, Homo sapiens
agatcgggtgctcttataaaacatcagtacttataattgtatcctgcagtggaaaattgtgcaataatctttttctgaaggcatggccatgaattgtactrtattactccatctatcttcttttaacactaaacaaaatgaagagaatacattgtgcatggcccctagaaatttaccttcaaatagaaacaaagctgctaa

SEQ ID NO: 8991 - DNA, 201 bp, Homo sapiens
agccttgggaaattccaggtgagaggggaggactctggagctttttaaaaagaccctagagttcattttacccaacaattttatttcataaatgagaaaaytgaggcctagagaagtatggcttaccaaggttacaaactaaattatggcagttttagctcatggcttatgttagctagactgctggttcgatttttcagt

SEQ ID NO: 8992 - DNA, 201 bp, Homo sapiens
agcaactcttaaatttctctccatttcctatttctagtaattagctcagtgtcacagctaaggttttcttactgacttcagcatggagacttagcagttayggaaaggagaggctagagctttccaccaactgcatgtcactggtgactccaagagagaatccaacaaatcaactactaataatccttactatttaaaccg

SEQ ID NO: 8993 - DNA, 201 bp, Homo sapiens
ttttacagcccacaaagagaagttaattgcctgtggtcacgcagctagtaagtggttgagctgagatcagatcccaggaagtctgagttcagagcttgctstagctgctatacagtgtaataaagcagcaataatgatgacttgcattctcatagtactttttttcttaaaactttatccctattttacaggtgtggaaac

SEQ ID NO: 8994 - DNA, 201 bp, Homo sapiens
gccaaggtttacctctgagaagtatcaagctgttcagcattggctagaacaagctcttctgaccctgtcgacccaacagtgaaaaagtgtcagtgtagggragcggaagatgttaagcatgtgcatgaggaaggaaatagtttctttccagcaggtgagaagcccagagagttttggtggcctgggcaagctcctatgcct

SEQ ID NO: 8995 - DNA, 201 bp, Homo sapiens
gggagtaggacttcaacatatgaattttgaggggacataattctgtccataatgtaagaccaggtataaagaagcctattgcaagccacaaacacagaatytgactaagatgtatttattcaaattcccactatgtgttttactagctgtatgtctttcagcagctcacttaacctaactgcaattctaattagtcatgta

SEQ ID NO: 8996 - DNA, 201 bp, Homo sapiens
tactgagtgagttttgctctgcatcagtggaggctataaaatgcagtatttatctgtatatgagttctataccaatgtgatctatctctctaattagatartcaactatttttaaagagctgcaaataagccttacaagaatgtcataaatgcattccatttagaaacatcttgcagataaattgtatttttattcttcct

SEQ ID NO: 8997 - DNA, 201 bp, Homo sapiens
gagcgcttatacctcccctcctccaaccttccactgcccggtacattattttggaaatttgagcagagttgtctttggaatgacggcgcctcatcaatacrgaatttgtgataatctggtccttgggtgggcttgagtttatccacataatggaggtggagtggggagacagaagtatgttaattaagactaaaggcccac

SEQ ID NO: 8998 - DNA, 201 bp, Homo sapiens
gagtagttgtgttaaagactgtatagaccacaaagcctaatctgctttgctgcctcctgatctagaagatttagactaggaattcaagtagacagaaaacyggtgttacaaggtttagaccttacttcttggcacaccccactcattccaagtgggattttagctgttcgctccaactttttgcatctcgcctttacctta

SEQ ID NO: 8999 - DNA, 201 bp, Homo sapiens
ggcctaacctgatttgggcctgctccagccttcagtgcctattcccatcaggatattagctgggaaatgtggaatgagtgtcagcaatttgggagcccttycttcctttccgagtccccatttatcttcttccacaatttctcccacatgttcattttaaagtagctctctatctaaatgctttaggataaatctggattg

SEQ ID NO: 9000 - DNA, 201 bp, Homo sapiens
ttcatggggaggcctaacctgatttgggcctgctccagccttcagtgcctattcccatcaggatattagctgggaaatgtggaatgagtgtcagcaatttkggagccctttcttcctttccgagtccccatttatcttcttccacaatttctcccacatgttcattttaaagtagctctctatctaaatgctttaggataa

SEQ ID NO: 9001 - DNA, 201 bp, Homo sapiens
actttctgtaaattaaaaattgttagtgatcagttttgaagcgttgagagcctatcagggaccacatgcctggaatgagcatttaccatgtggtgcctttrgaagctaatattgattctcattattttaaatgattacaaacattgcaggtgttttgtaataatctccattgtctaattagaacatgcgtgaaatgagctc

SEQ ID NO: 9002 - DNA, 201 bp, Homo sapiens
tcattttgttttaatgctaacttaataatcatgtcttagtgtaactaagcttttcttcatcaagaacattataagctcattgatgcacaggctaaatcttkatgcttatttggtgctttttaatctgtctagcacagaatagggcacaacacaggtcttcagtgtgcctttgctgaattgaaatacaaaaaaatagcacat

SEQ ID NO: 9003 - DNA, 201 bp, Homo sapiens
attactacatatccaaaaactgaaacttactcaacagggaaatagctaggtcttatattttccaaaataaggtactaaatccatcatgtgtaaaaaagttwatcatatgtaggcatgacttgtaaggctctaaaaatgtctgcattttagggtattcctttttcctagcattggttcttttatgacctttgtgtttttctt

SEQ ID NO: 9004 - DNA, 201 bp, Homo sapiens
tcctctgaggtgttttgatactgttaacatgagcatcaaagtaataccaactcttaaaacacacataattacttaactatcagtgtatttctaagaacccwgtcatatgcacccttcttattttatgctcatgttgtaaatagacatacatgatgctgtgctgtcatagagaaaccatccatgttcactgcttaaagaagt

SEQ ID NO: 9005 - DNA, 201 bp, Homo sapiens
ataatttggtcactgttcattagtgagattaaatttggctactgagagtaggtcatgcaaatcatctttctggttaaaaaaaggcctgtagctactgggtsaaatttgctttgaattatttttcataatcacaagtaattgggcatgtcgtactcagttataaataaatatacaaaagtacactgatctactttccttaat

SEQ ID NO: 9006 - DNA, 201 bp, Homo sapiens
taacgacttttgttagcatcaattatactgtaatttctagtgtctgtgttattcttttgggggggatgctattttattttattcactttaaatgagggcayttaaagtaggactgatttgctcggggaacaagatcagaatttccatcaaataagtgccattttgcaggtttggtacatctaagcagggaggaggctgagt

SEQ ID NO: 9007 - DNA, 201 bp, Homo sapiens
aacaactaatgataaatatttgagatgatggatatgctaatcaccctgatctgatcaatatatattatatgtatcaaaacatcactatgtaccctgtaaawatgtacaattatttttcagttaaaaaaggaaaagaaacaaaaaaataaatattctgagaagatgaccttaagagagatgttggaagagagggagggttgg

SEQ ID NO: 9008 - DNA, 201 bp, Homo sapiens
taatgtaattgaggaagacttctgggagaaaggtgcacttgaatagagattgaatgaagtgaggaaaagaattatgtccgtgctcgggtggaagcaatgcwcttgataggtacaggaaaggaaactccaaaaggtgtagaagaattacagcatcctagtgacacagaggcccatggagtggagttttgcaaggaggaaagt

SEQ ID NO: 9009 - DNA, 201 bp, Homo sapiens
gatggtcagtgaccctttgatcttgagtttcctcgtgatgttgataaactcctgtgttgggatgactggtctagagggtgagatgaggatatgcatagaakatgcctattccaacacctggtgcttattgagggctccattaaaggcaactgctcttattatttgcatatatcttatgccatgctctagattgtaaattca

SEQ ID NO: 9010 - DNA, 201 bp, Homo sapiens
ctcttttctcttaaagggcactctaaagtgccttcccagtgtgtaggaacaggactgaaagggccgtttttcttggctgctggtgactttccaaagcaagygtctttcccttctcaccttgtccatggccccttgtgccctttatttgctctttctgcctgatgtagcagccacaagctgagagggctttctgtgaagtgg

SEQ ID NO: 9011 - DNA, 201 bp, Homo sapiens
ttcagtcaactcatttaagttcgcttttccaggagtcactggggaccaggaatgagtcctggtgcatggtaatcccatgcagagttcccagccatccctcygtcagcccagcacctgtgtcttcccacatccactgtcaatgccttccctctgagatttgctcagagtgcgcctgtcttcgcaatgtccccatctcttggt

SEQ ID NO: 9012 - DNA, 201 bp, Homo sapiens
attagactgactttgctttccctttaataattcaggtaattattatatttacagaatttgcctattttttgaaatcaacactttgttaatcaccagacccrtgacaatctataagtagccactttacgtggcttatagatctaaagtgaatgttggttttcacacattcattcataactattatttttactgatatattag

SEQ ID NO: 9013 - DNA, 201 bp, Homo sapiens
aatataataatgacttacaccttagactgtaaccattgtgaatttattctatgtgtatctatctctggttttctttgttggagtggcaagatttaaagcargccaattttatgcctcattctatgtgcaccaaaactacttacatgatattggttttcagtgcctgctacaacaaaaacaatatcccagtaacagcccact

SEQ ID NO: 9014 - DNA, 201 bp, Homo sapiens
ccatcatttgggctatatctatctgcatatcatacataatatccttgcaggaattaatccagcatccatatgagtgtaactcatacctaggctgataacaraatctgaaaggtttttcactgaaatatatcaggtgactaaagaatttcacaacccaaaagaggagggtatatcgatcctagtggaattctatttcatgga

SEQ ID NO: 9015 - DNA, 201 bp, Homo sapiens
aggctggtcttgaactcctgacctcgtgatccgccctcctcagcctcccaaagtgctgggattacagggaagtacacatcttagttgtggagtgtgataartatatagaattgagacatataggatgtgactgtgaagtttgaatataaacttttaatgaaatccaaccaaatatagcagaatggtagattgtttaaaatt

SEQ ID NO: 9016 - DNA, 201 bp, Homo sapiens
gactatatgtctccataggcctttttgtaagaagtattcagtgatataatttcccctatagcagacctacaatgaactgcttagtttcatgtcactgctgytcatattgtcctttgctaaaagctgagaatatgacactaaaacgagattcaaggaaagaaaatctgtaaaggatggaaaacgcagatagtatgttcaaaa

SEQ ID NO: 9017 - DNA, 201 bp, Homo sapiens
agatggtaactgggtggaataagacttctaagcccacataagacaggatggtgtgatctttctgggagggtgccacgtctgtccaatattgatacaatagygcaccagtggcagcttcttggttgggccaagtaagccttctcaatgtatttactccttcagtatttataacaatcaggaagctgtaattattgtccatat

SEQ ID NO: 9018 - DNA, 201 bp, Homo sapiens
gcagtcctctccctcagcactcttaattccttcttatctactttattattttttcctgagtacttgtcaccattgggcatactatttgttatatttatgtrtttgtttattatctgtctctctccactagaatttaagagccacaaaggcaagtattttaatctgtttacactgatgtgtcaccagcacctagaacattgc

SEQ ID NO: 9019 - DNA, 201 bp, Homo sapiens
ctagagagggtggtgtggctccagaatgctggggcagacttcaacgcaaaaactgcacaaagagggcaggggtaggagaggccctgggaggtgttaaccamtgagcttgaaccttcgcatttttctctttcttaaaagaagttaccattaaccagtactttcaatttcttctcaacctacccaacgccttctaccttcctg

SEQ ID NO: 9020 - DNA, 201 bp, Homo sapiens
ggcctcccctaaacttgaacagggttacattgtagaataacataacaggaaatgaaaagagaaatgtgatgctcttcaacaattggtttatggggcctttwaaaaagtgtgtatagagtcaatgatgaattaagatgcagtgtgaaagaaaatgacacaggacagatattcagagatcatttgttcagttttaaaatcaga

SEQ ID NO: 9021 - DNA, 201 bp, Homo sapiens
tcatgatagtcgcacaggaaacttgacagtgacagcaggggaacagcacagtatcctacttggccactggtaggaggatgcaatttaaatcctggcatgcrtagaatagcctcacttatctgtggattgttattgtaatctacatagtaagtttcaatcagaactcagttttgtgcagttgatttccaattcccgactctg

SEQ ID NO: 9022 - DNA, 201 bp, Homo sapiens
ggctagttggtttgtttacttgtttgtttacacttactcattactagctttccctataaagcaagggaaaacactctgtccccaggggccagctgcataayatgaatagatgaaatagaccagaccagatgcaatctgcagtcatgggaactctgaactgaagagaacctgccctcatttaaaggcatccaaatgaaacat

SEQ ID NO: 9023 - DNA, 201 bp, Homo sapiens
ttactctctttaacatctttcacattagaaatctatggagaagaaatatgaaagactcatatataaacatggggcaaaccatgaagctaaatcttaatgtrtcccaaaccccagagggagcataaggttaactttgggtggccagggtgcttagtgataacattatgagctttctacattagcagggccccctggtgtggt

SEQ ID NO: 9024 - DNA, 201 bp, Homo sapiens
tgtgttcagccctctcccttctgtgtataactgttgatagtttgtggctaagtgtgtatttccgtcatcttttgtatatactgagttcttgttgcatgagrttgagttgacaattttggtggtgtgtcttcaaatgtttgggggcatgagaatggtaaattcaggtgatttccttgaatctaatttttaacatttcttctc

SEQ ID NO: 9025 - DNA, 201 bp, Homo sapiens
gggaaaatgggagatgtctgagaaataccctagaggaaatttgaaatagaaaaacagagctgaggaaagaaataaagatgaatcaaaaattaaattggagytatatgatggttcagggagcaacacatgtgtagagaaggaaatgagaggctggaactttggggaatcccagagttaagtaatagacaggggaagaggcag

SEQ ID NO: 9026 - DNA, 201 bp, Homo sapiens
ccaaacctattttgctgtcatttgaaagcatgttattttctgcatgttcacatttcaccttgcttcccagagtgtttacagcaacttgccacagtaacacrtactaaaataatggtatgatacacaagtaagaataaaaaatgtgatctagagaaaaataagagttaaacacaagaccctagggtggaggatggtctgaga

SEQ ID NO: 9027 - DNA, 201 bp, Homo sapiens
gtgacttgaacttacacatgaatgagaagtagctagtcacaagaatatctataacaagattgttataaatagcaaagatagatagatagatagatagataratagatagatagatggaaaaagccctaaagtatgaatgagcttggcagatttgaaaaatagattgactagtagagagtggatatttgcgaagatttatta

SEQ ID NO: 9028 - DNA, 201 bp, Homo sapiens
tattctctctgtgaagcttggccgtgatttccctcaactcctgctctccacaagtttccactttgtactgagctcttacattgccttggtcattccctttmtcttctccctacctatgttctgaggaaataaacaatgaagtttcatcttctttttttttttttttttctgagacagagtcttgatctttcacccaggttg

SEQ ID NO: 9029 - DNA, 201 bp, Homo sapiens
ttgtatgaagtatgtgaatccatgcaactcgatctctcttgatttttatttgcaagcttatgttgtataactttctgacaacacaagaaattggccaggakacaaaagaaattctgtagaaatatagaggcttttttggagcttgtgtgcacatcagatgtttcttcagatacctttttggttcctgtgtctcattgtttc

SEQ ID NO: 9030 - DNA, 201 bp, Homo sapiens
catcaaaaccaaaagcaataccttgtttgcaaggcctgcctaatattccattataacgctgtgccatctgctattgatggtcatttaggttgtttctggtrttttactaagggtgcttcagtaaatcactttgtatgaagtatgtgaatccatgcaactcgatctctcttgatttttatttgcaagcttatgttgtataac

SEQ ID NO: 9031 - DNA, 201 bp, Homo sapiens
agtttattactacatatccaaaaactgaaacttactcaacagggaaatagctaggtcttatattttccaaaataaggtactaaatccatcatgtgtaaaamagttaatcatatgtaggcatgacttgtaaggctctaaaaatgtctgcattttagggtattcctttttcctagcattggttcttttatgacctttgtgttt

SEQ ID NO: 9032 - DNA, 201 bp, Homo sapiens
gggaggtgaagttcctggtctacgtgcctggagcataaatttgcattctgaaatgaacattttaaaagagatgtacaaatggttacactatttagcgcccrcagccaacctgaattaattattcaagaactgtatgaactgttggtgcatctggatcctgcaaaggataagtcacacatctgttgctcactcctctgggct

SEQ ID NO: 9033 - DNA, 201 bp, Homo sapiens
tgatgagagattgtcttaggaacactgaagtacactggcaaattttgggaagcagagataaattatgttgctaaaagccaaggaaggctgggcgcggtggytcacacctgtaatcccattactttgagaggccgaggcaggtggatcacctgagatcaggagttcgagaccagtccggccaacgtggcaaaaccctgtctc

SEQ ID NO: 9034 - DNA, 201 bp, Homo sapiens
atgtaatattgcaattagatgatgagagattgtcttaggaacactgaagtacactggcaaattttgggaagcagagataaattatgttgctaaaagccaargaaggctgggcgcggtggctcacacctgtaatcccattactttgagaggccgaggcaggtggatcacctgagatcaggagttcgagaccagtccggccaa

SEQ ID NO: 9035 - DNA, 201 bp, Homo sapiens
gaaaagcctaggttattaacagcggaaacagtagctaacaccacagacatctcaactggttcagcctacacaattcttactgaaaaatttaagttgagcamactttctagttgatgggtgccaaaaccgtcgtacctagatcagctgcagacaaaagcagaactttcaatgaaaattttaaacaagcgggatcaaaatcct

SEQ ID NO: 9036 - DNA, 201 bp, Homo sapiens
catgtgtgtgttatctccatcccaataaatgctattgggaatatataaggctgacattatcattttagttgattaaaataaaatatctaagttactcgtakcatgcttaaaatatttttataagtaaggtaaataggcttgacaaactggtgatatcttaatttgcttctcatatccatttttatggatatgataaaggta

SEQ ID NO: 9037 - DNA, 201 bp, Homo sapiens
cctgatgtgattattacacatcatatgcctgtatcaaaatatttcatatactcaataaatatatacacctactatgtacccataaaaattaaaaatataamagtaaaaatcggatccatcttttccctaactagtggttgttcaaagagacatttaaggcacaagtgttgtttgtgcagtattgttttgcacatatcaaat

SEQ ID NO: 9038 - DNA, 201 bp, Homo sapiens
tttctaataacaattcatgtccaattatctgactgccagcacagttatctgctatggttgttagaaactttagaaagaagtaaatcctccaaaattgtcastcttaaaatctgagagaaaacagaatgaatagataagagatgcttcaaggcagttcagctctgtgatggttccgttgagatagaacacacatatacaaag

SEQ ID NO: 9039 - DNA, 201 bp, Homo sapiens
ctaccaaatcctaaaagatttaactaactggctcactaaccaatgcacacacatacttacttatttcacccagtatgtgttgactaccttttgcccaccargagctaggcaggttcacagtgcctagctcccaggcacaaagataaatcagaaaccattctgtctaagtcaacctttcattttagcttagcaggaaacaca

SEQ ID NO: 9040 - DNA, 201 bp, Homo sapiens
tgagaggtgacaacgtgctagcagccctcgctcgctcttggcgcctcctcggcctcagcgtctgctctggctgcgctggaagagcccttcagtccgccgckgcgctgtgggggcccctctctggggctggccaaggcctgccctctgctggcggggaggtgtggagagacaggcagaggtgggagtcggggctgcactggg

SEQ ID NO: 9041 - DNA, 201 bp, Homo sapiens
gacagatcatactttaattggtaaattatagtcaattgccaacagcagtaagtgctagagaggaaaggaccagaataagggtaggaggtacttttgagagktgacaacgtgctagcagccctcgctcgctcttggcgcctcctcggcctcagcgtctgctctggctgcgctggaagagcccttcagtccgccgcggcgctg

SEQ ID NO: 9042 - DNA, 201 bp, Homo sapiens
tgggctagaatactgaattagggctgaggaacatcatcacattctccacgctgtcccagtatactgttggatgatgtcagagcaacgtgaaaggattttgrgttatggtttagctcatagtccatgcagaagaggccataattagcacagggtaccatggcacttctcatctgagacatgtgacatggatttgcacagatg

SEQ ID NO: 9043 - DNA, 201 bp, Homo sapiens
aagttttcacttccttctgaccttaatcactccctcaatgaacccataagtatcactgaacatgggtgtcaccagttagcaacagtaagataaccgctaamttctgaaacatggaagctctagcattgcttggatgatgtcttccctgactgcctgtgagcctctggccaggatccggggtaagtgcctcacaaatcactg

SEQ ID NO: 9044 - DNA, 201 bp, Homo sapiens
acctcgcctggctaattcttctgtatttttagtagagattgagtttcaccatgttggtcaggctaatctggaaatcctgacctcgtgatttgcccacctcrgcctcccaaagtgctgggattacaggcatgagccaccgcgctcggcctcttctttactatagagtaaaagttgcatggtcgttttcttgcatttgggtca

SEQ ID NO: 9045 - DNA, 201 bp, Homo sapiens
agaaagtggaaagttctttgaataccttaaagcattgcatgaataataattgtacctgcaggtgtattgtctggattatctaccacccgtatacattttargaccattttttatcttgactttctacaatgaagtttacttatgaaaggtgagaataggggactaagagattttccatcttgctttctcatccttcatgga

SEQ ID NO: 9046 - DNA, 201 bp, Homo sapiens
cataagaactcactcactatcacgagaacaggaccaagggaatggtactaaaacgttcatgagaaattgtccccatgatccaatcacctcccaccaggccycatctccaacactggagattacaactgaacaggagatttgggtggggacacatccacaccatatcaccgtcttcactgccatagtgttactcttatctaa

SEQ ID NO: 9047 - DNA, 201 bp, Homo sapiens
atcacttgggattcacagaaatattagatgcagtgttattagtgaaaccttagttccctttatagatatgtcttatgtcccatttgtaatattattattgwtgttaccatacgcaaactttatttcttagtttggatgcttggtctcaaccagacccattacctccttatcttcctatctcttagggtcacttcatgctta

SEQ ID NO: 9048 - DNA, 201 bp, Homo sapiens
taataacctcagttagaacaaataattgttttactagttcagatacacttaacattataatagatgccctcataaggtgctatgtataaatcctttttttraaaaaaagcttgaatcatcatgtaaatgttttagggcaactcattgcttagagaaatcctttgaagttttcttttataatgcaaaaactcctactgcctt

SEQ ID NO: 9049 - DNA, 201 bp, Homo sapiens
aaaaaaaaaggaatcaaataaggaagagatagatagtaaaagagaagtggatgtaagcaatttagaatatattttatcaaaaattgctttttaagtggcaytttctcttgctgcagaagacattattgaacaaaaaaaaagcccaatgcaattcaatttaaatttatcactctattattttaatatatttactcagggtta

SEQ ID NO: 9050 - DNA, 201 bp, Homo sapiens
gccaaaataaataaataaataaacaacaaaccaaccaaataaataaataaagcagataaaccgtggttctttgcttaaaaaaagttgcagcaaagaaaagmtttagagtaatttctagttagaagtggctgtgagattcactgtcttctggtgatatttgaaatatactatattcatgcaaatgtttctgattatttaaac

SEQ ID NO: 9051 - DNA, 201 bp, Homo sapiens
agagactagagggcaggcatagccctctatggagatgggccgttcaagttttaataaatgtgttgcatttgtcatcttagtatggcatgacaaatgatctmttttatattaggagctgcccaaagatgttgggttaattttagtcaaagtgattttatgcccacaacatctggatgagtttggtcaaaggaaagaagttta

SEQ ID NO: 9052 - DNA, 201 bp, Homo sapiens
agaaaaatcagaccttggcaaatatcttgagcagtaggctataaataactcccacatgcttagtgttccaataatggaacactaggcataagtggctacayacattatctcaactgccccaaaaagtagctcaaatacacagggaaaggctgagtgactgtacaccatggttgctagtaaggggattcctgcactgagtta

SEQ ID NO: 9053 - DNA, 201 bp, Homo sapiens
tccaagaacatgtaaaatagaaatgaatgacagagctggaatttgagcccaggcattctgtctcttaacccatttatgctggaggttgtgattttttaaaytgatgtatgacagaaaaatcagaccttggcaaatatcttgagcagtaggctataaataactcccacatgcttagtgttccaataatggaacactaggcat

SEQ ID NO: 9054 - DNA, 201 bp, Homo sapiens
cttcttgctttaagaacctggttattacagaggtgaaaaatcccatcaaaatgctagagaatttggcacaattattgcttatatttctcctattgctgctyttactgctgtagctgcctcctgaactgctgctgctgctaccatggcttctagatgcttctttgacaatttatttattttccagtggaacccatctgtgag

SEQ ID NO: 9055 - DNA, 201 bp, Homo sapiens
ttatgcaaatctgatgtcatttcatgggagggtcttgaacatctgaagatttttgtgtctgtgggaggtcctgaaaccaacccctgtggatactgaaggayaactgttactcaaaagagggattgctggatcatataaagttattttcttaatgcattcatgtatgcactagtgtgtgtatgcctctatacacccatgcct

SEQ ID NO: 9056 - DNA, 201 bp, Homo sapiens
catctgcacggacactcaggttgatataatgtcttggcttttgtgaataatgctgcaatgaatgtaagagtgcagatatctattcaaggtactgatttcayattttttggatacataattggtcctccatatccatggattttacatttatgaattcaaccaactgtggatcaaaaatatttgaaaaaaatgtgtctgtac

SEQ ID NO: 9057 - DNA, 201 bp, Homo sapiens
tttctagattattttactctgcataatgtcctctaggtttatccatgtttttgcaaatatcagaatacccttctttgtcacaggatgaataatatttctayatatatgtgtgtttatacatgcatacatatctctctcacacattttctttgtccattcatctgcacggacactcaggttgatataatgtcttggcttttg

SEQ ID NO: 9058 - DNA, 201 bp, Homo sapiens
taccgtgtgtgtgtgtttgtgtgtgttaagaatatttcaggttcactcttagcacattttaagtatacaatacattatcattaactatagtctccatactmtatattaggtctccagaatgtattcatcttataacctaagtttgtactatttgacccacacctccccatttcccctatttcctgacccctggtaaccaca

SEQ ID NO: 9059 - DNA, 201 bp, Homo sapiens
tcacctcacatagctaccgtgtgtgtgtgtttgtgtgtgttaagaatatttcaggttcactcttagcacattttaagtatacaatacattatcattaactrtagtctccatactatatattaggtctccagaatgtattcatcttataacctaagtttgtactatttgacccacacctccccatttcccctatttcctgac

SEQ ID NO: 9060 - DNA, 201 bp, Homo sapiens
tcgtagcaaaaaatgtagagagtatttctttccccatccccaactttactgagatataattgacgaataatatcatatgtattcagggagtacaacataaygtttgatgtatatatacattgtaaaatgattaccacaatcaagctaattaacatatccatcacctcacatagctaccgtgtgtgtgtgtttgtgtgtgtt

SEQ ID NO: 9061 - DNA, 201 bp, Homo sapiens
gttttgttggagtgatcatgccagaactgggactttctaatcttgaattcaaatcatgagagttaagcctgtcatgaactgtgagtgcaagctgacccagsaaccatgtggttctcaaaaaaaaaaaaaaaaaaaaaaaagcttatggctctttttgtgccacaatggcagaattgagtcattgctacaggcagtgcatgg

SEQ ID NO: 9062 - DNA, 201 bp, Homo sapiens
ctcatttatcaatcctttgttgagtctcaaccactgtcctaggtaatgctgatacaatcttatgttttgaagctcgccacaaaatttgatcaccactagakccaagatttaacacattatttcatttaatagctattttgagtcttcagggtacaatttacagttttgggggggaagatgtagggaaatatgactcgtcag

SEQ ID NO: 9063 - DNA, 201 bp, Homo sapiens
tctgttgttcccattgagccagctctgctgtccccactggtcacgaaccggatcagtacatggagattcctgagcatatgcagggcagcggcatgagagcrtctaaaatagagtcattcccattgccccagcacatccttccttcctacattcctgggagaaaagagcagaaacaaaggcttttctttcttctctcttttg

SEQ ID NO: 9064 - DNA, 201 bp, Homo sapiens
ctacttccttgaatttggcaaagtaagcacgatcattggagttactgcttttgggattatttatttatcacatcacctctgccatcattacttcccactcrtctttgtttggcttactttctactgtgcttctctctatcaaatctttgcacctccttaggaagatctggaagtcacctctctgtaaatctgagaagttat

SEQ ID NO: 9065 - DNA, 201 bp, Homo sapiens
tggttactgtgtgggtcctgttcacaatcttgatcatgattgtattccaacttctatgtcagagtttgcaagcatgtggcttataaactcaagatggctgrtacaatgttgttcaatatttaatggaggggtattaccaagatctagttttctaggttttcttgagaaattagaaaatctggcaacactaagtttgtaata

SEQ ID NO: 9066 - DNA, 201 bp, Homo sapiens
gatggggtttcaccatgttgcccagctggtctagatctcctaggctcaagcaattcaccctcctcggcctcctaaagtgctgggattacaggcatcagccrctacttctggcctgtgtttttcttttttaaagataagacctaaagaggattttgactattttgaaaatatattcatatctgtgtatttttggttattcac

SEQ ID NO: 9067 - DNA, 201 bp, Homo sapiens
ctggctaatttttttttctcttttgtagagatggggtttcaccatgttgcccagctggtctagatctcctaggctcaagcaattcaccctcctcggcctcytaaagtgctgggattacaggcatcagccactacttctggcctgtgtttttcttttttaaagataagacctaaagaggattttgactattttgaaaatata

SEQ ID NO: 9068 - DNA, 201 bp, Homo sapiens
ctcaaactcaagattctttttcctctacacttcactactttaactctcccgattattttgtggactgatgaataagtacgtgtaaactgattttagttttyctggtaatgaaaaaaaaaaaaaacaatgagtattgttactcttgtaataatcacatcattttttgtctttctttctttttctcattttatttttagacag

SEQ ID NO: 9069 - DNA, 201 bp, Homo sapiens
tctaatatttatttttggtggtagtggttttagcaaaataaaagtaataaatacataaatggactggtcccacgagcttactatctatggtttttttcaarttaattctaacccattcatctctctgagcctgctaggggcaggaggtgcttagagtctatggaagaaaaacgtcatgtttcagagctctggtaacaggaa

SEQ ID NO: 9070 - DNA, 201 bp, Homo sapiens
tatcaccccaggctcaatgtcttaaaatagcacctcgtaggctctcaataacagaagatggcaccaaattaatacactgaaaatgccacaagattttagayaaatgtaaaaacattcaggctttgattatttggtgaacattttgaggcattacgtgagttggagcaaaactcttgaggttaaataatatttgaatgggct

SEQ ID NO: 9071 - DNA, 201 bp, Homo sapiens
ataagtatttgaatgttttccaatctgcctgaacccgtttcaacccaaggagatagtaaataaaaggagcagactgatgaaacactcacacttgatatgtstttttttttgaatgaatgaatcaatgaataaatgattgagtgaggttccacatgatcaaatctcttgcactaggaaaggagggatgctagtttataaaag

SEQ ID NO: 9072 - DNA, 201 bp, Homo sapiens
aaattcattaaggctaagagtgccccttaaattatgttctgctgtatcctggaggaacacctgaagaagttaataataaaccctagagattaggcaagtgraaagaattatgaaataaaacaaagcaaagaaattgtgtaaacaaattaattaattgtctgaaagtgaaagcatgtttgtaattttgcccttgtcaaagaa

SEQ ID NO: 9073 - DNA, 201 bp, Homo sapiens
gagagaattctggcttccattagatgcttgaacgtgtcctttagagtaagattttctttacaaatccaggcttcaaatatggctatgtaataagatgggtkttttccatagtacatgagctcttaaatctgtattattgttattattattattattaatattatcagacctgtctttgtggcttaaaattaagaaacatca

SEQ ID NO: 9074 - DNA, 201 bp, Homo sapiens
gaggggtattaccaagatctagttttctaggttttcttgagaaattagaaaatctggcaacactaagtttgtaataataccagggacaactagccaaactsccctattttgttgaatcatgtgctgtctaagtcctcacagtccttgccacccccaaccctgcaatcatcctacatgtagtgtttctatttatcattgtat

SEQ ID NO: 9075 - DNA, 201 bp, Homo sapiens
tcatcatcattggtcgttagagaaatgcaaatcaaaaccacaatgagataccatctcatgccagttaggatggggatcattaaaaagtcaggaaatggccrggtgtggtggctcatgcctgtaatcccagcattttgggaggccgaggcaggcagatcatgaggtcaggagatcgagaccagcctggctaacatgatgaaa

SEQ ID NO: 9076 - DNA, 201 bp, Homo sapiens
tatctctgaaggccgatgttccttgaaagactgtgtgaaatattgaactatatgatctctgaaagttcttgaattctccattatcatcagaatacctggcmcttccaagcccttgaccttcgtctgtggagtattgactctagctgccttccagacattgtcatctatgcttcttttcctctgaggacgatgaaccccggc

SEQ ID NO: 9077 - DNA, 201 bp, Homo sapiens
tctacaaattgtgtgtcacttccttgacccattacctccccaatgtatatatcatgtgaatatcaaacaattgaatgttttgttggtacaattggattcaytcacacggaaacgtggagtctatttcttccttcaaatcctcatcctccaattaattagctgaaaaactgactgcatctctgattctctaagaagcatgga

SEQ ID NO: 9078 - DNA, 201 bp, Homo sapiens
ggactatttggtcaaatgttctgcaattcagttccactgcttgactgtaattcacctataaacccagaaaaatactgctggagttcagaggccctgactgytattagacagagaaaacctatagcacactggaacaatcacatttaaaagatttgcctcaagctttctatggtcactattactctttaatttatgctttta

SEQ ID NO: 9079 - DNA, 201 bp, Homo sapiens
gggacagaaaattctgactgatcatttcttgagctagaagcagctataatattcctgttctccatcctttataattactttctcataaatactaaactacwcccccctgagcatctagaagatttaaacactgatcaaaggcaggtttagctgtatcctcaggacaagctgattcaatgaagaaaagctcaggctcttgga

SEQ ID NO: 9080 - DNA, 201 bp, Homo sapiens
tattttataggtctattttcttgactatcataataacttatgccaaagccataagccaggttttctcttttcccctcagacagaagcagcataatgtaccmgagtggcacactgtgatgttataaagcccacaatccaacttcagtgcagtcacgctgagatgggaagaatgcagctttcatttaaacacaccttaataat

SEQ ID NO: 9081 - DNA, 201 bp, Homo sapiens
tttgaacatcaaattaagcaaagccatgaagtttggaatttttcttggcattttcttcccgtaccctgcaaatattaaatcaattgtcaatcaattgtcarttttacctttaaccatttctcttcttcatgtctttctccacacgatcactgatctagggtgagctcttactatctttacttataataggctagtttattc

SEQ ID NO: 9082 - DNA, 201 bp, Homo sapiens
ggttactcatgacctcatatttccccttatatgatgagccgtgctgagcagctgcgtgacagcatgtaatttgggcaatgcctgattgaggccaagtaagrtatctaccatattgaatatttggttttcttgaactcacccaagaaagctgaatattctgtgtggaaacaggttacacccaaaaaatatacttgagggtgc

SEQ ID NO: 9083 - DNA, 201 bp, Homo sapiens
ttgaaaattcatatagaataccttcattttcttcacactttggtctgtaaacagtgtggaagtagtgaagaagacacaaagtcactttagacatgtttatyactctcacttttatcctctcccctccatcagtgaagactcctacttgccatctttcctctaaagatccttagtccctgagaagcaagagctactgaagat

SEQ ID NO: 9084 - DNA, 201 bp, Homo sapiens
gcctgactggctcataccaaagacaattacggtagattttgcagggcctgtagatgaggagcagtgaagggaaggatcatctctatcatgagctagtgtcrataatcataagatgctccatttgagacccagactttgtggtgccatttagtcggatgcagttgaaggtgcagatgccagagagagactctaaaaggacaa

SEQ ID NO: 9085 - DNA, 201 bp, Homo sapiens
cagggctgtctagcatcagtggacttgaatggacgcctgccagacctcatcaatgatgctcttcatcggagcggacagatcgagcgtggctgtgaaggtamaacctatttttttcttgttaagctacagccttgttgcaagcaccaagcctctttgctgcctctgccactgcctccttcctcagttgaccagtcctgtctc

SEQ ID NO: 9086 - DNA, 201 bp, Homo sapiens
ttccagaggcaaaccacaggttcagagtgccatgcatttttgatacatcatccatatcctgttttaacaatgttgaattatcctgtaatgcaattttttcygtttttacttagactactcatcaagaaatggttcattttctctgataacctcgggaatgtcatgctgtgggggctgagagatgacaggatgagtgtcaaa

SEQ ID NO: 9087 - DNA, 201 bp, Homo sapiens
gcattgtagaaattttggttcatgtgaaacatagtttgaagggaaatcaagttactgtttcatttacctctttgaataaatagaaagatgttcaggtaaarccaagtgattatgatacagatctcaccccctccctccccaacctccacccaagcaaaagtttccaatggttccccatacacttttggaaacagagctttg

SEQ ID NO: 9088 - DNA, 201 bp, Homo sapiens
gcctttctaaagagggtaattttcatatattttatgcattgtagaaattttggttcatgtgaaacatagtttgaagggaaatcaagttactgtttcatttmcctctttgaataaatagaaagatgttcaggtaaaaccaagtgattatgatacagatctcaccccctccctccccaacctccacccaagcaaaagtttcca

SEQ ID NO: 9089 - DNA, 201 bp, Homo sapiens
agccatttggaggtgaggaagagggaagagtagtgggttagagcacagggaacaattctgggacctctgggtgtgagacccttcttctcccctcccccagygcttctccctcctgcctggaggggctgtttatggtgctccaatgacagcctctctcctccgaagggataatttctcaggctctgcctgctgattagacct

SEQ ID NO: 9090 - DNA, 201 bp, Homo sapiens
cctgatagttggaagactttcgtgcacttttttgtttgtttcgtctgtttagtggacagagacaggtctgttctccctggagatgagcagctgcattcccrtttactggcttttctgttggttcttgcttgacagtttgttttggagatccagcactacttctttcttagaaatggtttatcttgtctgaaataatcctcc

SEQ ID NO: 9091 - DNA, 201 bp, Homo sapiens
gacaacggtggtggttgtacaacattacgaatgtacttaatactactgaactgtacacttaaagatggttatgatggtacatttcatgttatgtgtatttyatcacaattcaagaaaactgggaaaacaaaactagcaccagggcttctgactccaaactgaggtttctttcccacaccccgtatcaccatcccctacaga

SEQ ID NO: 9092 - DNA, 201 bp, Homo sapiens
cccctcgttagtatttctggagtgaataaacgaatgatatagcactctgttgtttacaaagcacttacatatttgtggcctcattcaaacctcacagcaayctggtcatgtacttactgtcattattcccagtagttggggatatggaaaatgaagctcacagaggctcagttggcaaaagtcacacagctagtaggaagc

SEQ ID NO: 9093 - DNA, 201 bp, Homo sapiens
ttcaattaacatagtctaaaattacatttgattatctggcagccacaaatgcttttatatatatatatatatatatatatatatatgtgtatatatatatrtatgtgtgtgtgtgtgtgtctttttgtcaatttaatttctcaattcttgtttactatatagttacaaattgtaccttccatccttatgggttgtttatat

SEQ ID NO: 9094 - DNA, 201 bp, Homo sapiens
aaggattctgaagctccctctgggctcaacattatggtaccatgattaattaatgattgattagtgaagtgtgctgtgaacacgtgtagggaagattcatrtattttgccaccttatctaacatatcccagaagcagtggtataatactaatcagtgtgatatatgacagaaatatgggacttattcagaagcttgaattt

SEQ ID NO: 9095 - DNA, 201 bp, Homo sapiens
actactccagaggtgggagtgactttcaaagtccttgtttgcccagcctccttgtcttgcattagaagagaccaagcatcaggaggccagtgacttccccrtgtttacatggcaaggggcgccagagctggggctcacaccttggtttctcgattctgactcgagtgcactctttgctgtggggggccttgcgtggtcacg

SEQ ID NO: 9096 - DNA, 201 bp, Homo sapiens
cctctcatgctgctttcctcttgctgatcttggcactgccagaacttctgaccatgtctaaagtacccaagtcttggtaaacaggctggcaagagtgggtrtaagctcccttgcttccttcctggtggagcagtattgggtgggacattcttagctccccacatcttgatggaaggagctgggttgaccctgacatgcccc

SEQ ID NO: 9097 - DNA, 201 bp, Homo sapiens
gttcgcacagatgtcatcatccctcttctagtccctgcaggagcctcatgggagatcacgtgaccagtatttcacagctctttcccccagcacagaaatayctgccgtgttgagaggcctgtccatctcctagtccctgctagagcctcatggacaatcacgtgaacagtatttcccagctccttctcccagcacaggaac

SEQ ID NO: 9098 - DNA, 201 bp, Homo sapiens
ggtggtcatgcacagaagcagaaagaaaattcctctgtggttgttaacgtgaaggttttccaggggcttggggcactggttaaggaaacagattaatgagyagcaaacaggaattgatgggagtcctctgacattttgaggatatccctacacatcactgcaggctgagggaagcttggctgaaagaaactggccagaggc

SEQ ID NO: 9099 - DNA, 201 bp, Homo sapiens
atcgcaccgtggcactccagcctgggtgatagagagactccatctcaaaaaaaaaaaaaaaagtttattagcaagtataaatgtatcagaacttaacaggkcaatttcttgtattattgtgagactaaaaaaaattgggaaaaaaggaaagctttgaagagaaaaaaatgggtagccatcagaatcattttgtgaaaggaa

SEQ ID NO: 9100 - DNA, 201 bp, Homo sapiens
aaagtgtcctctgcagactttgttgccactaaactagaaataatccatagtttctcctgtttccttttccgttaatgaccaactttatatacactcaaaaygaataagtgatacggtttgttcttctcctctacttctctgtttcccaaagtaatttgcaagttagaagaggaaatccattaggagaagctgaatggatta

SEQ ID NO: 9101 - DNA, 201 bp, Homo sapiens
acattcgttcatgttctttgaaacagggcacacttgcctttcccagaaatttttcaaccaaacaggactaggacatagatcaaggtctgtcagcctatgcycaaagtgtcctctgcagactttgttgccactaaactagaaataatccatagtttctcctgtttccttttccgttaatgaccaactttatatacactcaaa

SEQ ID NO: 9102 - DNA, 201 bp, Homo sapiens
ctgtccagagttaaatttatagtcacaaagcaagagaaaagtctttgtttccaagccaatgggctgggtttccagaggcataaatcctaggaattagtaayatcccatataaaatcactgaaggttggtgcctatggttatgtcagtggcctctatgatactccctaaaggcgtaatttattccacagtccctagacacat

SEQ ID NO: 9103 - DNA, 201 bp, Homo sapiens
ttattgggcaggcactctacataaattatttcttttcattcctatgagatgggtactttatgaggaaagagagaggttcagagaaggcatgtcagttttcyaagatcacacagctcattgttgactgagccttgacatgaaactacagctatgtttaaaaccagtgctatttctagtgtactatcctgcttccttgtaatt

SEQ ID NO: 9104 - DNA, 201 bp, Homo sapiens
gcaggtgacattagtcagactttattcttatctatgaaagttcataagtaagtgagcttttgtgtttttctgcttaactctcattactacctgttatctcyttgaagacaagggatatgtaaaggtacatatatgtgtatagattgtgtatgtgtttgagtatgtatgtatgctttaagccttgttccaagattggtttat

SEQ ID NO: 9105 - DNA, 201 bp, Homo sapiens
ttacagtgtctactatactaacattttttgttgaagatttcccatgaagatattgattattgtctttttcagtttttaatcagatgcattggctaataccwgtttgtagctgaagctaagtctatcctcttaggccatggtgtgaattgtgtgtttccctttcttccttcatctctggcttagctcctttcattaccttca

SEQ ID NO: 9106 - DNA, 201 bp, Homo sapiens
gtaagtctttagttgcagggtgagctgggcagcacattacagtgtctactatactaacattttttgttgaagatttcccatgaagatattgattattgtckttttcagtttttaatcagatgcattggctaatacctgtttgtagctgaagctaagtctatcctcttaggccatggtgtgaattgtgtgtttccctttctt

SEQ ID NO: 9107 - DNA, 201 bp, Homo sapiens
ttttaaattttgatcacattttgaagtaatattttgaatatattgggttaagttaaatatattattaaagttaattatacctatttctccttttttggggyggctgctagaaaatttaaaattatatatttgctttgcattatattcctcttggactgtgttggcctagatcgtttattagcttaggcaacataatgcaaa

SEQ ID NO: 9108 - DNA, 201 bp, Homo sapiens
ccttctcctgaattagtcttagcccagtaacatcttgtgctgatgtcagtcttctggttgaccaagtaaacgtattttttcatttcctctttttttgctcrtctttttcatctctcgctgatgattgtcaactgcaatgacaccgtacttttatacactgcatgatgtatacttactcagaatttttcttattgccaaata

SEQ ID NO: 9109 - DNA, 201 bp, Homo sapiens
ttattcaagaaaacactgcagttcaggctaatgtttttgtatatttgttttgtacattttgtacatgtttttgtaatgtgtttatacatatgtacatagawggctttacatttggtgatcagcatttaaattatttacgtacttaaactattacaaatacactacttggcacactctttccccagatcttcatctggctgt

SEQ ID NO: 9110 - DNA, 201 bp, Homo sapiens
tggagattacgcttaaagtgggagtactgtatacatgaataagcagagcaggccaggtaagcaaagttgtggttggggaaagatgcattccagacagccaraatgttttgcctcattggaagattgtttttctcacccttagcaccctctgcttattcgtctctttgtttttaaccatttctaagttgtatcttaagactc

SEQ ID NO: 9111 - DNA, 201 bp, Homo sapiens
gtcagtatactataaatatcagtgaatattcagaatagaagctgatagaaaaatcaaaccatagaaaagcagggagagtgtgagaatatattcaccatgtrtacatatatgcccctaaacaaaagcctgaaagtatctactctaaaattgatttatcctcctcactatcctttttaaattttttatattattcaccttttc

SEQ ID NO: 9112 - DNA, 201 bp, Homo sapiens
cataccttttatacttaaacttaaatctatagtaaattatgagtttggttcattttatcattatatctctatgtgtttttgtattttctgaggattatatkagattaataccaatgaatctattaaatagttgttgcttctctaatatgaatcaaatctaagctgctgatcaggctgaggtgttgtttttaaatcattaaa

SEQ ID NO: 9113 - DNA, 201 bp, Homo sapiens
agtagtgatagcagtgaataaggaaagctatctgtttgaatttgcttgtgcaaagaggcagaaccatttcaaagatacagggtgcagattttagtgaagawgttagagctgacccctgctgggactgtggcatttcagtagaggaatggtgaatcccttcccagtggggaacacacatcatccacatacatgagggaaaaa

SEQ ID NO: 9114 - DNA, 201 bp, Homo sapiens
agggtttcaccatgttggtcaggctgatctagaactcctgaccccaagtgatccatctgcctcggcctccccaagtgctgggattacagacatgagccacygcgcccagccaaatgtgttcattttaagtcactcactttgtgccaatttgttatagcagccacaggaaactaatacaatacttgtgccaacttaagtaac

SEQ ID NO: 9115 - DNA, 201 bp, Homo sapiens
cctctaagtgcacaggaatatggtgagtgacactgggacttataactggagaagatggcagaattcatcttcgttgcctgcagctttccaatcctgagccyttttccactttcatcgtgtttccatctccatcattcctttcattcagggttttcatgatcttattctatcagagaagatagaactacacatccctctcct

SEQ ID NO: 9116 - DNA, 201 bp, Homo sapiens
ctaacccagtgattctcgagctcaggtgcatggcagaatgcctggagggtttattaaaaacactgattcctaagctccacctaagaccgattgaatcaggwtcttttagtgtagggtgcaggaatttttttttataacaacttccccaggcgatttttctgccagtctatagaatggcctttggggatctctttatctttt

SEQ ID NO: 9117 - DNA, 201 bp, Homo sapiens
ggtcagtcttgaacaggcaaagagcactttgtggagtgaatgatggcaactggaatgaaggagactcatcatctctagccagtgtaattcagctttgcatyttcagttttctctgatcctctttttatttgtaagcactggcataataacaccactggagagataagatgagaactattatagaggttatcattgtgaagt

SEQ ID NO: 9118 - DNA, 201 bp, Homo sapiens
agttcttcacattcttcatagggaatgaatagtgatggttttttctgttattcactaacccctgtttatctgagagataaattaatcagagtaagggatgkcaggacacgaagagtgctctactgttcctttactgattgctagctttgccattaaccacctaatccaaggtacagggagctaggagagggttttactaca

SEQ ID NO: 9119 - DNA, 201 bp, Homo sapiens
aagcaggagggagagaggaaaggagggaagtggagggaggctaaatatacaaaatcagtgtctattataaaatatcggtgctcaaaagtctacaaatgttrtaccactatattataattacctctatttcctttgacatttgagtttccttatttttaaaaatgtggaacaaatctggaaagatagtgatataaaagctta

SEQ ID NO: 9120 - DNA, 201 bp, Homo sapiens
gaccttttgccaggcactgttcaagcactttctacgtcactacatatttcttttaatttttacaacaactcattaaacaggtactattactatccttattktacaggcgaggaagcacgtgagaattggctaaagccatatagttagtaagccatagagttaggatttaaacttgggtccaaatcctgtatgcttaaccat

SEQ ID NO: 9121 - DNA, 201 bp, Homo sapiens
taaaagatcatgataaaagataaaggatgatgacctgagatcttctttattttttattactaatttgtttgaagaatagtccatcatttccagtaactttktgaccaaaaaaatggctatgtggttgttgccatcaaggccagtaatagagaagagggacaaagagagaggtgctccattggtatcctcaacctgtgtgta

SEQ ID NO: 9122 - DNA, 201 bp, Homo sapiens
gcgcccggcccgtctctaagttattttctaagctaaaagtcatgctactgcaaccaacggatatccccccttttttggagatacttggtaatgtagaaackatttcagagagtcaaaattctacagatagagtttagaatgcacaaaatctagacatggcattgaggcatctagatattgcctttacctatttcctgtagg

SEQ ID NO: 9123 - DNA, 201 bp, Homo sapiens
tcccaaagtgcttggattacaggcatgagccaccgcgcccggcccgtctctaagttattttctaagctaaaagtcatgctactgcaaccaacggatatccycccttttttggagatacttggtaatgtagaaactatttcagagagtcaaaattctacagatagagtttagaatgcacaaaatctagacatggcattgagg

SEQ ID NO: 9124 - DNA, 201 bp, Homo sapiens
ccgcgcctggcctcaggccctattctaataaaacttccaggtagatgcttgttgtccttctctgtgagtccaaacaaggtctctagttattgattctcatrttattgcagcttctacaaatttcaccctcaagtcagctttttggcttttctgactcaagtcacaagataaccatccttttgtttcatttttgtaaattct

SEQ ID NO: 9125 - DNA, 201 bp, Homo sapiens
agaaaagttgagattcccaatgacattgtttttctttatggaaactgattccttagtggagactcttttgagtatcttttgttcatttttcctgcaggaarttgacatatattgaagccctagtgtgttccaggcactatgtttgaggttggaaatgcaacaaacaaaaaatccaaaacagaaacaccaacttgacacggc

SEQ ID NO: 9126 - DNA, 201 bp, Homo sapiens
gatcactctcagattttgtggggatagagtgttggtagcaggaagcggcagaggaattcaactccttcttgagcttcttgtgttttataatcctccctatktcccacctgttttgtctcagaggggataagtcaatagagctgctgctgttcacaaagccatgcaggtaagagacatgtaccccttgcttcaaagtcttag

SEQ ID NO: 9127 - DNA, 201 bp, Homo sapiens
cattctttgcttctctttttcctcatcaccatggaaaccgattgtgacatcacagatgctgcattatgtgattattttgtaggataaacttcactgtgcargaatttatgcaacaatacacccttcagtaattggcaagagtcatgttgcatggagaaattatgacaagaaaggaaaaggcaaattgatttttcctgaaga

SEQ ID NO: 9128 - DNA, 201 bp, Homo sapiens
tcacaactctcataaagtttgtgatttttgtagactatactgaacatttagtgactcccagggaggatcattttaatcagcatacaatagtttgctcttcstcttcccttccattttcttctttccctttctccccccttctctagttttttaatctcacctcctctccctgcccttttctatcctcctcccctctcattt

SEQ ID NO: 9129 - DNA, 201 bp, Homo sapiens
cttacaggatatatgaactaataatagttatacgactgcttcggatttgtcgcgctccccttggataagtttaatatgattttgtacacattaattaattmtcttaataacagacaaaatagaaggaagccactaccgtcctttccagtgcatcagatgaatcaaaatgaatcaaagggctgggcatggtggcccacactt

SEQ ID NO: 9130 - DNA, 201 bp, Homo sapiens
agctgcttttgttcccatttcactgatgaggaaatcgaggtttaaagagattcagcatctcacctaagatcacccagccctggctgggtgcggtggctcaygcctgtaatcccagaactttgggaggccgaggtgggtggatcacaaggtcaggagatcaagaccatcctgcccaacatggtgaaaccccgtctctactaa

SEQ ID NO: 9131 - DNA, 201 bp, Homo sapiens
cattagaattgctatttgtcataaggacccccgtgtactgcagttgacttcattttaaactaaaggcaatcttcccacttcttgagaagccaggaaagagrggttaggaaagcttctaccactttgttgtctaaaaatcagcataatttgggctcagattttcccaacagagggtatcatttatcatttttatcgctgcta

SEQ ID NO: 9132 - DNA, 201 bp, Homo sapiens
ggtttggtctggttggctgaggcctagggccggagtctagtctaaaacaatggcctcccctaaacttgaacagggttacattgtagaataacataacaggraatgaaaagagaaatgtgatgctcttcaacaattggtttatggggcctttaaaaaagtgtgtatagagtcaatgatgaattaagatgcagtgtgaaagaa

SEQ ID NO: 9133 - DNA, 201 bp, Homo sapiens
gttctataaaatagtatgttctgatgagctgggcaaggtgttgtctgactttatggacagaaaaggactgaagaaagcagaaacaaaatgagaagtagacrggttgtttcaacatttccttctttctaggctttaagcagagggtactttcttatgctggatcaggtaaagggccccttctgcttggttgctatgaatctc

SEQ ID NO: 9134 - DNA, 201 bp, Homo sapiens
ctttcaagtatctcaggtggtattgatagtaaaacagtcttggcattaatgagtgtctgactggagagtgaaatgtaaataagagttgaatagagcacagscaaagcctacaaattaccgctgacaaataacagggcagacaaagagtatttcagccttaccaaacacctctgctacaatcagctaagaacacctgggaat

SEQ ID NO: 9135 - DNA, 201 bp, Homo sapiens
tgaaaaaagtactagagaattgcatattgtcattacagaattgtttgtaaatacaatcaagtaaaagctgtattgaaagaggtaggccttgttcagagccrtgttactaatctcaagtctaggggtttgctctgagtgtcttggtgtcttggtggccacatggatgttcctttactctgcttattttcaacacaagaaagg

SEQ ID NO: 9136 - DNA, 201 bp, Homo sapiens
actatgcaaccaacccagaaaaaattgtcagtagagccctttgctcagaggactcaaaccgtgcagaaatgtgagatattcacagagaattgtcttccaamagggactcttaggtgtgaagtgaggggcttagacaacattagagacttgaaaaatgtggaatgtgtgtaccaccactctccaaatctatgcccaaggcag

SEQ ID NO: 9137 - DNA, 201 bp, Homo sapiens
gacctagagagagacactctatttcatttccaagaatttttactatgcaaccaacccagaaaaaattgtcagtagagccctttgctcagaggactcaaacygtgcagaaatgtgagatattcacagagaattgtcttccaaaagggactcttaggtgtgaagtgaggggcttagacaacattagagacttgaaaaatgtgg

SEQ ID NO: 9138 - DNA, 201 bp, Homo sapiens
tctagaatatgagcaaatcttcagagaaaggagggagacctaactatcctggaatgtctctggggaaggagacagtctctatctttgttatactggtcagraaacaaatctgccttctgacctagagagagacactctatttcatttccaagaatttttactatgcaaccaacccagaaaaaattgtcagtagagcccttt

SEQ ID NO: 9139 - DNA, 201 bp, Homo sapiens
tgcaagccacgaggagtttggattctgccataggcttgtttgtgttgtccaggggcatagccatgaactctcaaggctgatttttgtttccttggccttgrtgctcacccaggtcgagagtagtatcttgcactttttctctttgaagacaaaagcccaaggagggtgtggcattttgatgcccagggctgtaggcccatc

SEQ ID NO: 9140 - DNA, 201 bp, Homo sapiens
aaagatgatggattcattttggacatgttgagttagaggggcccatgagacctccaggagaagaggtgagtctgaagcttgaagatggaataatttgaaakaaaatgaatttgtttctgaaagttgtatcctaacgttggcatattcagaacaccagtcacattgacttgccctgcagaatttccagatgggaattctagc

SEQ ID NO: 9141 - DNA, 201 bp, Homo sapiens
cataggtcagtaagccagtaaaaggcagagttgggatttgaacccaaggctacactctttccgtggccaggattttaaccggggtattcagtactggtgcsattatgggggaggaaaagatgatggattcattttggacatgttgagttagaggggcccatgagacctccaggagaagaggtgagtctgaagcttgaagat

SEQ ID NO: 9142 - DNA, 201 bp, Homo sapiens
aattcatgttcatatggaacaggggttggtacacagaggtctgtgcaaataaagttttattggaacacagtcatgttcatttgtttccatattttttctgrctacttttgctctacgatggtagagttgagtgatggcaataaagactgtggcctgcaaagccttaaatatttactatctaaccctttatagagttagctg

SEQ ID NO: 9143 - DNA, 201 bp, Homo sapiens
gtgacaattgttagaccacagcttaccctttgactcctgtgaaaatcaaggagggtgaggagcaactgaagaaaagtcctctgatttttattccttttttmcttctataaggagctctaaggtattagatttttttttttaactggcaaaacaaaagagcaaaaaaaagtcccattttcagtatctgactgtctccttaaa

SEQ ID NO: 9144 - DNA, 201 bp, Homo sapiens
aataagaactaatgttaattcatgtcagacacagtgccaaagatctttatttgcattattgttattattttttaaaaaataaatagactagcacgtagccyagcttacacacttctcattgtatagatgaggaaactgggaatcagttaaactttataaccacaccaagatcattgagctagtaagtggcaggcttgggat

SEQ ID NO: 9145 - DNA, 201 bp, Homo sapiens
ccttagtgcataaataagtccctagtccgtatccctaaatcatattaacaatactgcttactgggtgccaacaatatgtctggtactggactagatatatstgtatatattgtttagcccccatgacaacagtatgagggtaggtaccattatctccattatatagtaaagaagcaaggctagaaaaattggtgacttgca

SEQ ID NO: 9146 - DNA, 201 bp, Homo sapiens
tggtgagatgggtttttataagctcttcccatctcactttttgaagtgtttttaagctattttaaggctgttttataggtgccttttcttatgtttgtttwgtatgctagaaagtaagtaaagaggatccaggatatgagctattgatactaccaggcacactgaagtaagtattaagtcttttattgagctttctaaatg

SEQ ID NO: 9147 - DNA, 201 bp, Homo sapiens
gaaggcagaggttaatggttttctttttatttgcattattacttgatctctggctttcctggtgagatgggtttttataagctcttcccatctcacttttygaagtgtttttaagctattttaaggctgttttataggtgccttttcttatgtttgttttgtatgctagaaagtaagtaaagaggatccaggatatgagct

SEQ ID NO: 9148 - DNA, 201 bp, Homo sapiens
tcttcttaagaattctaataaggcatttagtttatacaaaggaggagtctgatctatgcagtggacatgagagacaaccaaagttttgttcctctttccartggcatagagaaaaaaataaaatttaggcagaattagaattcagaatgcctgggagttcctccagccttgggaaattccaggtgagaggggaggactctg

SEQ ID NO: 9149 - DNA, 201 bp, Homo sapiens
agcatgacttctcaaaatacaatattgttttagaatgaaaatttgtttcatgaccaatgcaaatcagttctgaaattccaaactccctcagccttgactarctttaaaatgcaaatgctacccataaggaacaaatgtcttttcaattattaaaattgaatttcaagatttggtttcttatgataaaaatgtttgaatata

SEQ ID NO: 9150 - DNA, 201 bp, Homo sapiens
gggagcatgacttctcaaaatacaatattgttttagaatgaaaatttgtttcatgaccaatgcaaatcagttctgaaattccaaactccctcagccttgamtagctttaaaatgcaaatgctacccataaggaacaaatgtcttttcaattattaaaattgaatttcaagatttggtttcttatgataaaaatgtttgaat

SEQ ID NO: 9151 - DNA, 201 bp, Homo sapiens
atatttatttgtaccttgtttgtaactgaagataagcacctctgaaatcaggcctgttggcatatgtctaaatactctttaactgagagacatatattcamagaaacgtttttatatgtccataaactgacacatagattgtcaaatccctaataacaaggttcaaattagaatcctgacactaatgttttcaaatgttct

SEQ ID NO: 9152 - DNA, 201 bp, Homo sapiens
ctgaagataattcagcagtttaccagaggagtacccattctgcctgctccttccctctctaacttcctttctccctccctccacaaatatttatttgtacyttgtttgtaactgaagataagcacctctgaaatcaggcctgttggcatatgtctaaatactctttaactgagagacatatattcacagaaacgtttttat

SEQ ID NO: 9153 - DNA, 201 bp, Homo sapiens
actgaatcactctaggaaaaacgtgtcggaagtcagttgagcccaggtgtgcatggcatcaaagctcatgtttttcaccacaccaggtcctctgtgttttytcagatacagaactattcattaccgtcacctgggaacagcttggaaatgctaattcttggctcagcctacacctatgcattcagaggctacggttaacaa

SEQ ID NO: 9154 - DNA, 201 bp, Homo sapiens
agaatttgtagtccaagacatgggtaatttgaaaaagcctcctagggcaatgcttttcagactctcatgtgtgcaggaatcacctggagattctggtttakaagtttggggtagggcccaagattttccctttctaacaagctcccaggtgatgcccatgctggtccatggaatacaatatgagtaacaagaagctaggtc

SEQ ID NO: 9155 - DNA, 201 bp, Homo sapiens
catttcaaaaaaccctgtggaaaaaatatttcttttagcaaatctcagacattatcttgacttatatgtaagatgtacctctctctttaaatccaagtgcrttgaaacttctggctcataaggtaatttttttttttaaataattaactaaacccttaaaactacatagaagtctactttgttttataaattaaccccatt

SEQ ID NO: 9156 - DNA, 201 bp, Homo sapiens
ttaataacaaagcctggctccacaggtgagagggaagatgtaacttaatctactggaagtcaccaacatagccctctaaaatgagtcattattttgactcraaaatgaacagattaaaaaatgtttcagctaatcctcttagctatttgatgtacatcaagcatccagatgttcacaacatccaagctgcaattttttgtg

SEQ ID NO: 9157 - DNA, 201 bp, Homo sapiens
cagttaagtcaattgcactctcaatattatcagactattttaactaatatgctatagacaaataattcttcagaatggtgtttgctttgtgtgtgtcatargagattcttgtctttagagaattagggaataatattaaaatgaataaatagtaaaggtgggaatatttttaatattattaaaataaataaatgattaaag

SEQ ID NO: 9158 - DNA, 201 bp, Homo sapiens
ataatgactcttcaactaggtttctattcatttccaagtcttccctaccactgagatacttcaaggagatatgagtggatcatgaataaatatcctaaaamtaaagacagttaagtcaattgcactctcaatattatcagactattttaactaatatgctatagacaaataattcttcagaatggtgtttgctttgtgtgt

SEQ ID NO: 9159 - DNA, 201 bp, Homo sapiens
gtctatgttttcatttccaaatagaaaataacccttatcattgctaatggtattcccttaaggaagttacttaatctttctatttctcaatttcttatttktagaatagaatggattatattccctacatcctaggatgggtgtgagatttaaacaaagaatgcatgtaagatgttcagcacagtgtagtaagacgttaat

SEQ ID NO: 9160 - DNA, 201 bp, Homo sapiens
accctcccctatttataattttaaatattttgcctacatgtagttagaaccatgtcacacagtgttataatttttatttcaatcatcagacagaatttagraggctcaaaggagaagaaaagtctatttgtccacatttttgcttactgtgttgttcttcctgatgttttgatttctcttttaaaaagtcattttctttgt

SEQ ID NO: 9161 - DNA, 201 bp, Homo sapiens
gatttagtttctaacactgttaatctagatggaattctttcatccctagctcattactacatttacccttcaacaaacatgtggtgggagtcaactgtgcrcaacgtgctgaatatgaaaagttaaatggggctcagggttcactgggaaagtgctggtaagttcattcacatgcactccagtacaacttggtatgcccag

SEQ ID NO: 9162 - DNA, 201 bp, Homo sapiens
taggacattgtaagacaattaagtctgtagaagaatgagaaggaatcttttatttgaggtctagaggtgtcataactgtgaatcacaaagttgtggcacartgcattcacctcagaaaattttcttcatgaaattaaagtttcattttgtcttaaagaaaaggttccactctcatgcgattttgtgtgttctcatcaaagc

SEQ ID NO: 9163 - DNA, 201 bp, Homo sapiens
atttgtaagatagatacttggagaagtttatactcacttcctaatcccagactatagaaacttctgcattctagaatttcagagaatgtgtctctgtcaaytgtattctgaagataagatacatttgacatttgattgcttcaatcaacattctccaatgcagatcactaggcagaaacatcttgacacggcatatatttg

SEQ ID NO: 9164 - DNA, 201 bp, Homo sapiens
aataccataatttgccttgaaggtagggaagaaagagagtgaagtggggaaaatttcaaaattctgtcttccagggagcatattcctactcatctgtgacrtctaatgtaatagattttgaagaattatttgtaagatagatacttggagaagtttatactcacttcctaatcccagactatagaaacttctgcattctag

SEQ ID NO: 9165 - DNA, 201 bp, Homo sapiens
actctcataataagcaggtgttattgttctttggccctccataaagtcaatgagcaaaatgtcttgaacatcccccaaaactgttgccatgacctttgttsttgactaatctgcttttgctttgatttgaccacttctacctcttggtagccattgctttgattgtgctttgtttttagaatcatagtgatgaagccatgt

SEQ ID NO: 9166 - DNA, 201 bp, Homo sapiens
gacaagcatttcctctttttatttgagagagagaaagagagagaaagaaactcctaggcaatcagagcagaacattcctaaccttacatttgatccacccrttgagctactgaataaatgcttaatatgtcagtgagcccacaagtttcttgtcctgggccctttaaactgatatatctcaatcacctttactgaaatgtt

SEQ ID NO: 9167 - DNA, 201 bp, Homo sapiens
tctattgagaatctcagccatcaaaatatccataagaccatatgatgaagtacatataaagtactgtgtgagcacaatgaaaaagcaatgagattcttttkgggggttcacggaaagcccccaagtgagggtgccatttgaattgagtataaaatgatgaatagagatttgtccattgaaaagggcagacaggccaggcac

SEQ ID NO: 9168 - DNA, 201 bp, Homo sapiens
gccagatatccctgtattttattcttgcctttgttacttagtaaagtgtaggactttgagcaagatgctacatctatctgagattccattttctcatctgyaaagtgaatacactaatcttaacattcagatttgctatgagaattgcatatggttatctttgtaaataaagtgcctggcacacagtaggtgctcagaaaa

SEQ ID NO: 9169 - DNA, 201 bp, Homo sapiens
ttagtaaacttatagagaaaatatgatttgattgcctaacaatatatttataatttacataccaaataagtgaaacgtaaggaaaaaactgctttgagctmccgagaatgctagttgatagcaaacaaggaaggtgctttggtaagaaggttgtttgctttgagcttccatggatgagaagaaatcaagtaatcaaagagg

SEQ ID NO: 9170 - DNA, 201 bp, Homo sapiens
ctaatatttaattataaaattaaaaggaaacaagtttggacttccgtatgaaaagtcttatacttgatctgtaactacaagatgttagatgttcttcatgsagatgacaggcaaaggttacttttacagttctatgaaagtaaaaagcttttaaaacatttgaatgggaattggtaaaagaagcagttcttaattatgtca

SEQ ID NO: 9171 - DNA, 201 bp, Homo sapiens
tgcctcctgcttttgggattatgcctggcacctgcttgagtctagagggttcctggttaaacttgggaaacctggtttcctcttttatctgcagctgttcrttttctgggatggaatcctaagcacttatttgaattgtatttgttgaagtcactgggttatacagtaaaaataaggagtcatgttggtttttgttcgaag

SEQ ID NO: 9172 - DNA, 201 bp, Homo sapiens
ccatatcatagtggtaatttcctcaattcctatatcctacaagagcttgatgaatgaaaagaaggaagcctgtgacaattattttattcaagcctccaaarcagagttttgccaaatgcttgtcctacttctccgtgcgcttgccatggtctttgttttgcctctttttcttttggcagttaccccaactataactggaat

SEQ ID NO: 9173 - DNA, 201 bp, Homo sapiens
acagtgaatggaagtctaaataacgtactccagtgaagaattattagatgttgcccgtctcagctggattttcagttatactattcaagctggtgggaggyttcaggggaagaacaggggagaagacaaagcagaaacagccttaggcagtataaattctgaatacctttaatttgattaacatgttaatactagcaggag

SEQ ID NO: 9174 - DNA, 201 bp, Homo sapiens
atgctcaggccttgttggtctctctgtaccagtgtctatcgtgggacataataattcatgatgaacagtcaggcatctacttagtggcttatacgtagaastggctctcctttcagaagccagaaattaataaatggtctacagtcagaaggagatccttaattgattaattaattcaataagaatttattaagtaccttc

SEQ ID NO: 9175 - DNA, 201 bp, Homo sapiens
agaatccctgagatatatatatatatttttaatattagaatgagagattcttgcactgggtaggactttgacctgagtgaactttgaggttcctcctaatyccaagattctttgattctagacatgagaaaacaaagctagtccctatgctgttgtcataactgtcatggtatgtgatatggtttaactctgtgtccccac

SEQ ID NO: 9176 - DNA, 201 bp, Homo sapiens
agcagctaaggacagataaattggtagcagattgtggtttatgataacgacagtcccgaaggaacttggctttcttggtgacgttgaagtaaattgcattwctcaagatgtatactaagaaggatagataatgaggtgtatgggggaaaggcatgatgactatttttatagtattgttgactaccaaaatgaatggaaggg

SEQ ID NO: 9177 - DNA, 201 bp, Homo sapiens
ctgcatggcaggttagatgcccctcttaaatgcagggttaacctctatcgtacatttcacaccttgtatttacttgtttgcttccctattcttccttctamaatgcatacactttgagggcagaaactcagctctgtttgtctttgcagctctgtcacctggcacagtacctggttcattctctgcagaatgaggaaacct

SEQ ID NO: 9178 - DNA, 201 bp, Homo sapiens
tgcaaatctgcacacatacatgcacatctgcacaagcaatagacacatgttcatatgtgtacacatgtgcacacacatgaatagattcatgtgtacacatrtgcacataaatacccatgcctgcacatgcacagatgtgcacatttcatccagtaattccaactaattcctcagattctcatctgaaacgtttttgttatc

SEQ ID NO: 9179 - DNA, 201 bp, Homo sapiens
gcatgtgttcacaccaacacacatgtgcaaatctgcacacatacatgcacatctgcacaagcaatagacacatgttcatatgtgtacacatgtgcacacayatgaatagattcatgtgtacacatatgcacataaatacccatgcctgcacatgcacagatgtgcacatttcatccagtaattccaactaattcctcagat

SEQ ID NO: 9180 - DNA, 201 bp, Homo sapiens
gtaaggttctttgtttgagtaatgatttgaggatggtgccattaccccaaggtgaattagagacaggaacaacacgttcttgggaaaagataatgagttcrtttttagcttctttaagttttaagcgcctggtagaagatgtccagcagaacattctaaattttggcctggagttcgggagggaagttggggccagagatc

SEQ ID NO: 9181 - DNA, 201 bp, Homo sapiens
caatatttagtcttgctttttcttgttggcacggtgtgccctttaccaaatgatccatccaggtgattgatactaaaacatctcattgatttcaagtttaygtgtctagatattagatcctagaaatgagttgttaataaatatcagctttacatcaagagtttaacagaaacatattcctgaacaaatttccattgcctt

SEQ ID NO: 9182 - DNA, 201 bp, Homo sapiens
gtctgtatgtatctgaaagaatgagaggcataagacacctacacatgttcacatctagggtagtattttcaaaaaatggagttactttgaatccccgatcrtctctttcttttactcaatttcaagttaatatctaatgtaaaacttttataaatagcaaagagacttatacttctctagctttgcaatatttagtcttgc

SEQ ID NO: 9183 - DNA, 201 bp, Homo sapiens
tgacagtctgtatgtatctgaaagaatgagaggcataagacacctacacatgttcacatctagggtagtattttcaaaaaatggagttactttgaatcccygatcgtctctttcttttactcaatttcaagttaatatctaatgtaaaacttttataaatagcaaagagacttatacttctctagctttgcaatatttagt

SEQ ID NO: 9184 - DNA, 201 bp, Homo sapiens
attgatacagttctaagggattagtatcttctgacggcagtctgttcaatatatttgtattttttacccttgaaggaatatgggactgttagggttttaaragaagtctgagtttttgtttgtttgtttgttttgttttgaatgacagtaaatatccattaaaaagctgtagatttgcagccttgatgattagctctctct

SEQ ID NO: 9185 - DNA, 201 bp, Homo sapiens
ctgggctttgcagatcctagagttgcgggttatgagtgtgtccagagaaccagagtatgtcatctggattcactcactcattcacacattcatttattcayactcaacaaatatttataccattattcatagggcagacagtgaacattaaaaatgtgaaacaataacatacagtccattcattgtcaaaggatactacag

SEQ ID NO: 9186 - DNA, 201 bp, Homo sapiens
cgtagaactgaatgtgatttctactgatctagaaaaaaataaagttattattaaaaaggaaatctaaaggatgataaattagctgcatatttttctgttcrtctattgttttctattttctctatcttaaggttgtttataatagacagttctacatcaaacttgagatgaaattaaagttgtgaaagatttatgatgtgt

SEQ ID NO: 9187 - DNA, 201 bp, Homo sapiens
tcattgctgtgtttaattatagcccattcatttctggtgtccttggctagttacttacttaaggtgacggcaataatccacttagagcctattgcttcacrgaagacaatttttgtattaccatgttagtcacatacaggtgcaattccaacatatttttcaacatggacataatttcctatagttatttccacatctaaa

SEQ ID NO: 9188 - DNA, 201 bp, Homo sapiens
taagagaatatgatgatataaagtgtcagtttttagtttttgttctttcttggtagtagagaaatacagttagccaatgttagtttccaaaattgctttaratatattagaggtaaataaactctgttaatctgaagatgactgttgcagatgttagcttcgtttcctttaggagtaaagtatttgtatgattttatccac

SEQ ID NO: 9189 - DNA, 201 bp, Homo sapiens
tgcagccctggacatggggtgtcctctgggtataatctcacttaactttactctgcaaatgcaatgttggtcttgccatccctgtgttgtgttcagtcttrtttgatctcactctccctgttacccatctgtataatcccctgggaagaatgagatctaaacaaaaacaaaggagaaaatgcttaagaaatataatctgac

SEQ ID NO: 9190 - DNA, 201 bp, Homo sapiens
tccactccccaacacctgtcccacaaaggaccaagacttgtgtctttgccctctctgtcactcattctacacaagctcagtactagggccagagtcgtacytaatgaatgcttacaaaattaagtaatggtttaactgaactaaacaactgattttagatatggggggaggggagatagacaggattagattttcaacact

SEQ ID NO: 9191 - DNA, 201 bp, Homo sapiens
atcacccctgccagctcccccatctccaaaagtcccaaagtcactctgcttgcatccacactgcattctcctgcctttggacttttgctaaagctctattytctttcttaaatgtccttgaacatgcttctccctcttatccttgaagatccaagcctcctaagtctgccagactttgtgctgtgttataaggtacctatg

SEQ ID NO: 9192 - DNA, 201 bp, Homo sapiens
ttgctaagtgcttttgcgtatgttagttctttataatgcttacatcagtcctaccaggcaagtagactgtccccattttacagatggggaggttagggctsgaagagattggctaacatgcctgagctcatgtgtgcaagagccaggattgtcatccaagtctacctgactctagaacctgcctcttaacctctatcctat

SEQ ID NO: 9193 - DNA, 201 bp, Homo sapiens
cagagagcggtcccctcacggctcattgagagtttgtcagcaccttgaaatgagtttaaacttgtttatttttaaaacattcttggttatgaatgtgcctrtattgaattactgaacaaccttatggttgtgaagaattgatttggtgctaaggtgtataaatttcaggaccagtgtctctgaagagttcatttagcatga

SEQ ID NO: 9194 - DNA, 201 bp, Homo sapiens
aatctcttggaaacaatctgacagaccttagaattgtgtagtaagatgaggacataaaggaacagagggtcaaggtagtatcttagctcctttctcccaamgtgttgatactggttaagatacacaaaagggaaaacccacctaagaaactgccaggaattcttttttttttttttcattttgttttaatgctaacttaat

SEQ ID NO: 9195 - DNA, 201 bp, Homo sapiens
caaagtgaatattacaacaaagcaagtcacatgaatttcttggtttcccagtgcatataaaagtatgtttataccatactgtgctttgttatatgtgaaayagcactatatcttttaaaaaaatactttgataaaaaatactttactgctaacaaaaatgctagtgatcaacagtattcagcgaatgtttttgctggtaga

SEQ ID NO: 9196 - DNA, 201 bp, Homo sapiens
agaggatgtttgcaagaaatggcgagttttattgtaagagaacttaccggccctatagagaggagaaaacaggttggaatgtccagctgctaccacccaaygggatcccagcacaaagaaaacagtcaaaattatgttcatcatgacagagcaaatgagcttttggggaaaacagaagcaaaataaacctttttgaataat

SEQ ID NO: 9197 - DNA, 201 bp, Homo sapiens
aagtatgaaaacaccttggtggtattgattttatgaaccctgtacattccctgcaatgaagacagattttagggtaaaagaggatgtttgcaagaaatggygagttttattgtaagagaacttaccggccctatagagaggagaaaacaggttggaatgtccagctgctaccacccaatgggatcccagcacaaagaaaac

SEQ ID NO: 9198 - DNA, 201 bp, Homo sapiens
aataagcttatgatgtgtgtctcatccacccaagtacatctgcagggctcctctattgtaaatcagctgcctaaggctcaagttagacacagtcaaagccstgtatatttagggtacataatcttgatgtcaagtgctggagtcttgggcaaacttttcatctttttatgtaaaactgatttccattaagtatgaaaacac

SEQ ID NO: 9199 - DNA, 201 bp, Homo sapiens
acaaagaagagaagcagaacataattcaattcaattcaacatactttgttgatcacccaatctggtatgtgccagaaaagtgagcaaagttgaatgagatrtgttctccacaggcgagatctcctgtaagggaaggagaaagggacatatgcagatttgcattcttggagcagatctgttcggttccagactagagatgca

SEQ ID NO: 9200 - DNA, 201 bp, Homo sapiens
aaacattctttcttatctgttctgcttttttaaaattgcttttacttttcttcctttttttgttattcctaccaggttttgttgttattttttttcttcartgatgtctaattgcaggttaccatttcatctgctactttattttttatgcctcaacatttggtcttctcacctctggttcacttctcatgggattttctt

SEQ ID NO: 9201 - DNA, 201 bp, Homo sapiens
ttgtcaaaggatactacagatcaaggaaagaggcaacttcaagaaagtatgattagtacattgaccagccaaatgtagaagcttctgtgtcagacttgacrgggtgagggaaagcttcctggacaagaagacatctaattggaatatggaaggatgcttagaatctagccaggtgtggggacttaaagggtaaagcaagtg

SEQ ID NO: 9202 - DNA, 201 bp, Homo sapiens
attacgctcagtaagataaggccttcttttgaggtagactttcaacatctatctctgattctttttgagaaaacatgttgcattttaatcttttagtgacygattgtccccaaatgtaaaatagaaagttgagggaggcagtagttatatgcacatattttttgagccagagttccctgagtttgagttaaggtgtcctga

SEQ ID NO: 9203 - DNA, 201 bp, Homo sapiens
ccactgactttttgtcttccacctaattacgctcagtaagataaggccttcttttgaggtagactttcaacatctatctctgattctttttgagaaaacaygttgcattttaatcttttagtgaccgattgtccccaaatgtaaaatagaaagttgagggaggcagtagttatatgcacatattttttgagccagagttcc

SEQ ID NO: 9204 - DNA, 201 bp, Homo sapiens
ttagattagaatagcgactgagaaacaataaccacagcagcaaaccatttcaggcaatatttttgttgtaagggcttcagttcttcatgaattaaatcacsttatcttattgaatttaactccaaattggttaataattttgagactctccccttttgcattgcctagaattttgaggctatttaaagggtatagctgttt

SEQ ID NO: 9205 - DNA, 201 bp, Homo sapiens
gggggtgatgagagaattttaagaaaaacgcttgctttatcaccagctgtgtcattttgttcaaagggacaggaaacttaatactctctctgaagcttaayagaactgcagacctattgccacagttttctcttttgcataatcttgtttagtcacttaagagctagtgagtgacagatttcacatgagaattggtcacgt

SEQ ID NO: 9206 - DNA, 201 bp, Homo sapiens
accttgttctattgtctaccttctctctcactgactccatcaaggcagacttgctcggtaaactattcaggtgactttgtgaacttttatttggtgcaagsctctgttaatagctgtaagtcagctgtttttggtcctccctctcattctcttcacactgattgatgaaatgggaaacaggttgaagaagctcactttttt

SEQ ID NO: 9207 - DNA, 201 bp, Homo sapiens
ttccaaacaaacaaacaaacaaacaaacaaaaaaaccaaaaaagccaccctaggataaatataactagaaggccaagatcagtttagaagtctacttaaaraaagacagaaacttctaaggactgtgtggaaagataattcatgcctataaaaaagtctctgtgctaactctagatttttttcactgtaagccttgtaaca

SEQ ID NO: 9208 - DNA, 201 bp, Homo sapiens
tattttattgaggtcccaggaagttactagtttaagcatccgtcacttagataacaagcattaaggtaatttttaatttcagttaaaaaaatagattaaargcacaaaatagatttccaaacaaacaaacaaacaaacaaacaaaaaaaccaaaaaagccaccctaggataaatataactagaaggccaagatcagtttag

SEQ ID NO: 9209 - DNA, 201 bp, Homo sapiens
tatagcattcttaatcagcaaaataaaggttggcaatggtatgtcagtccttccctacagtttttctttgaagtttttttctcaggcattgaaaacaaacrtccgaaaaagcaaaaaaacaagagttttaaagttttaaagtgttctctatgttgccacattagattgagtagatttcaaagactgaaggcctttttacat

SEQ ID NO: 9210 - DNA, 201 bp, Homo sapiens
cattgacccacttagggctcaaatatacaactctgtattattttagtcacaaagggaactaagagattatagacaagttgtgaagcagttagtggggactrgaagtctcctgtggcacagactcaaatatatgctctagtgatgtgttctcagtcatgttatctgcccacacagaggacagattaagcaacctagagtact

SEQ ID NO: 9211 - DNA, 201 bp, Homo sapiens
gggcaccatatctaggactcctgcctgcattgcgagcaaaagcatgtatttatatcttagccctctgaatgttagaggtagcagattatacagtatggtgyaggaaggagcatcctatgtcctgaggtgaataacgtgttctaccacctggcagcagattagaccagatcaggctatgagaatacaggttcacagccagat

SEQ ID NO: 9212 - DNA, 201 bp, Homo sapiens
tgagctccccacctctgctaggtgtgggctgcattcacccccaattttagacctctttggcagtagcttccttgatctcccgcccacatactgtgtcataycccagtaattcttccccaaaccttggctatgggttattgagctgacaaatgtctaaatgactgagatacgatttcacaacctgctgagagcctcttcttt

SEQ ID NO: 9213 - DNA, 201 bp, Homo sapiens
taaaccagggtcatctccacccagcttgtacactacatatttgggtaggagcttaacgtcttgcccttcgctttgccagtgtgtcttctgagctccccacstctgctaggtgtgggctgcattcacccccaattttagacctctttggcagtagcttccttgatctcccgcccacatactgtgtcatatcccagtaattct

SEQ ID NO: 9214 - DNA, 201 bp, Homo sapiens
ggacatttcccacctttgttttagatatgccactatctcagacatgaaacacaataacaaactaaaccagggtcatctccacccagcttgtacactacatmtttgggtaggagcttaacgtcttgcccttcgctttgccagtgtgtcttctgagctccccacctctgctaggtgtgggctgcattcacccccaattttaga

SEQ ID NO: 9215 - DNA, 201 bp, Homo sapiens
tcatagtttaccccaatctagagaagtcccataggttaaaaatgtgtagtctttttttttgtttttaatagataagaccttcttgcccattttatagtcgwtcccaacatttgttgagttctccactaagtacatgagaccacataggatacaacaggacattaaaagcttttttttttttttttttttgagacggagtct

SEQ ID NO: 9216 - DNA, 201 bp, Homo sapiens
ggtcatagtttaccccaatctagagaagtcccataggttaaaaatgtgtagtctttttttttgtttttaatagataagaccttcttgcccattttatagtygttcccaacatttgttgagttctccactaagtacatgagaccacataggatacaacaggacattaaaagcttttttttttttttttttttgagacggagt

SEQ ID NO: 9217 - DNA, 201 bp, Homo sapiens
gaaaggggagttagactttcatctgaaagacttggttatgtgtctggtagagaaaaaaagaaaagttaaaaatttaggagagagataataactgacagcayggtcttgaagaaggcaggaactgatggtttggtcttaagaaaagaagtgataccaccacatgcagggtaaagagggaaatactggatatggataaggcta

SEQ ID NO: 9218 - DNA, 201 bp, Homo sapiens
ctcaaaaaaaaaaaaaaaaaaaaaaaaaaaaaaagagagagcaagaagagtgaaagttataaatgaaaacaataaaaaaaaatccaagaaactcaaggaayctttgatgggaaaactgggtttttctctgacctcactactttcccttaaccatcatagccctgccacttctacatgcattggaggaagtgatttctccac

SEQ ID NO: 9219 - DNA, 201 bp, Homo sapiens
gtcttggttctctctagtggatctctacagggcttccttaaagtcagaggctggctttgccttaagattcttgagcatgagtagaactcccaacccaaagkaaagagagcaaaatccagagaaggacttttctccattctaaggcccgcctcccaagtccttaatttctgttttaaggtctggctcatctcaagaagaatg

SEQ ID NO: 9220 - DNA, 201 bp, Homo sapiens
tgttgattatactaaattagaatagtgatggctataatcatttgatccctgaggcattaatgaaaaatcagcattattttgtgtggaatatgtattattayccttgagcttaggaatgattattagtaagtctgattaaatctggaagcagtgacacaagctatctttaacccaccaatgacagggctatattgtaaattt

SEQ ID NO: 9221 - DNA, 201 bp, Homo sapiens
ctgaaaaagtgccaacaaatcctaagtaattttgtgttgattatactaaattagaatagtgatggctataatcatttgatccctgaggcattaatgaaaawtcagcattattttgtgtggaatatgtattattatccttgagcttaggaatgattattagtaagtctgattaaatctggaagcagtgacacaagctatctt

SEQ ID NO: 9222 - DNA, 201 bp, Homo sapiens
acagacaaagattaagagatggctgaaagatagtgtatccaaggtcacgttggcacagattactgaagtgagtggggtggcctggaagaacattaagtggrcatttaagatggaacagctaataagacaaaggtaaaatgagtctagaagaatgactagactgagaagagaggaaaggaaagaggcagaaatagtagaatg

SEQ ID NO: 9223 - DNA, 201 bp, Homo sapiens
tcgatcctagtggaattctatttcatggattttgttctgcctttattgacacagttagacattaaagagaataagtataataacaaaatttataagaaatrcttatggaatattttctaattttagctacaatgatgggttgtttatattctgtggtttgatttttatatcaatctttatgcagctattatcattacccaa

SEQ ID NO: 9224 - DNA, 201 bp, Homo sapiens
aaatgcctgtggttggtccacttccttcagccttggagtaaaataaaggcttcttttgcaagatcacgaaataattcagcaaatactgtgggactataagrtattcctgtgttgtcaccttttcttttgaagaatatagagaatatgcttttcttcctctaattcaaatacatagattccttatgcttgtataatgaaaga

SEQ ID NO: 9225 - DNA, 201 bp, Homo sapiens
aacaatgggagggcttcacctgtgattgttctatgacctcttattctggaaaccagtgcaatgatcgtaagtacaacaacctttcatactggaactttgtsaagatgtttggagatttggagaatcttaaaggacaatatgtaaaaggatggctcttctgaaagattcataagtaattctctcctccagaaacttgggaaa

SEQ ID NO: 9226 - DNA, 201 bp, Homo sapiens
actggtatttaatatattttattactatataaatgaatgaactacgtttcccaaacatctttctacgtgtgaagcaaaaaaaaaaaaaaaaaaaaaaaaamaccacacagaaaaaaaacaagcaagcaaacaaaaacagagggaacaagagtttagagaagtcaaagaaatagtattcaattttctgtttagtaccattta

SEQ ID NO: 9227 - DNA, 201 bp, Homo sapiens
cactggtatttaatatattttattactatataaatgaatgaactacgtttcccaaacatctttctacgtgtgaagcaaaaaaaaaaaaaaaaaaaaaaaamaaccacacagaaaaaaaacaagcaagcaaacaaaaacagagggaacaagagtttagagaagtcaaagaaatagtattcaattttctgtttagtaccattt

SEQ ID NO: 9228 - DNA, 201 bp, Homo sapiens
gaagggagtgctgtgttggtatcagcacaagaacggggcagtgcccctgcggtgtgttctctttggtatttgcataggtctgactcttgccagacaagtgmtgattgctttcctcttttcttttcctatagctcgagaggagaatgtggccactttccgaggctcagagtatctgtgctacgacctgtctcagaacccgat

SEQ ID NO: 9229 - DNA, 201 bp, Homo sapiens
tgtacatgaagatcatcatgcccatggtcatgcatactgaggcagaggatgtgtccttccgcttcatgtcccagcgagcttatgggctgctggtggctacracctccagggactctgccgacaccctgcgtctggagctggatggggggcgtgtcaagctcatggttaacttaggtatcgtatgaagtaccctctgccact

SEQ ID NO: 9230 - DNA, 201 bp, Homo sapiens; identical to SEQ ID NO: 1317

SEQ ID NO: 9231 - DNA, 201 bp, Homo sapiens
ttgtcttttccattgtcttgtaacatctaattctcttgcttacattgttctctcctggccagccaatggctgggctcagcactcacctgttaggtttcttwcatttggttaagcaactggcagactcacctgagatctgtcttcccaccccaggtactatatcagtgaacagcaggcgcacgccattcaccgccagtgggg

SEQ ID NO: 9232 - DNA, 201 bp, Homo sapiens
ccagagagttggtagttacataaacaggtcccacggctaccaataatattaacacggtattcttagcccttaagaaacaaaacacagaaatttctaatacygggagtttaaagtgccacaatggaaaagcaaactcaattacaaatgctggattccacctggagcctattctttttcattttcttacttctgtttctgcca

SEQ ID NO: 9233 - DNA, 201 bp, Homo sapiens
acatactcaggttttttaaaatttaaagatccagattggtagctcagccatatagctaaattgaataattatgcaaatgctgcacagtatttaattggacmttttggaatgaaaataacccaggtgtgcacaattctttgcaatctggagcaaccattctaatatatatctgcaagtgacaacatcttgtatgtaaacagg

SEQ ID NO: 9234 - DNA, 201 bp, Homo sapiens
gggttcattttactggtgctgatgaatatcaaactacacaatatctacgcacattatattagaataaaacatgttttacattgaaggcaaattttagattygactcttaataatggtcttttatattaactcagataactagagatagtaaaagaatgaattaaaattccagtgagccaaactacaacattgataatagta

SEQ ID NO: 9235 - DNA, 201 bp, Homo sapiens
gtgttgagcatcatggccgcttcctttacaatggcctggcatggacggttggagaaggccattgttaccatataaatgactgtctatttgcctctggcatsacttgtccagacaagttgcatcattttaaaatgaatgaagttctagggagcatttttaactatagtaccttagttgtaactttgagagtttttaataagc

SEQ ID NO: 9236 - DNA, 201 bp, Homo sapiens
acacacttggagcatttgaaagactagtgatgaaatccattcatgctgtgaaaatgtgttgagcatcatggccgcttcctttacaatggcctggcatggamggttggagaaggccattgttaccatataaatgactgtctatttgcctctggcatgacttgtccagacaagttgcatcattttaaaatgaatgaagttcta

SEQ ID NO: 9237 - DNA, 201 bp, Homo sapiens
ctaagtcatgttttgattgctaacagcattccagtactgggttggaacatatgtattccttctatcaactgaggaacagcaggttttctgttattgcccaygcatggtcactctctgcttataaaaattcatcacttctgctgattgcattgtgtaggattcctactgattaccatttagatttgttaagtgacatagcac

SEQ ID NO: 9238 - DNA, 201 bp, Homo sapiens
aatttacatataacggatgcataaagatttgctttcttattctaagaatgttcttatttgataacatctatgcatagtccagaagattgacatggaaaacwgataatgtacttaggtattaccaatcctataacccaatttgtgaaaaggtcaggcactcctactaaagaacaaacgtttgtatttgtagcatttaaaaat

SEQ ID NO: 9239 - DNA, 201 bp, Homo sapiens
tggtccaagtgcaatgcctggagcatatctattcaaacaaggttgtttaaagataaaagcacccacttctaaatatcagcattagtagtgatttcctcacrtatatttaagagatggaagagcttgtgaagactttttgatttctattttgttttctgagacttctttaactcttttggttttgttagtatttgaatttat

SEQ ID NO: 9240 - DNA, 201 bp, Homo sapiens
ctgtctcaaaaaatgaaacagaacaacaacaaaaatcgatgcagagcatgtattacatttgtaatcagagagaagggatatctgttatttcttaaaatatrgaagagtatactaggagaccagcaagggaaatgttttaatatttagatacggaagcttcgccagacccgtaattttttaaaaatagtgaatcctttttcc

SEQ ID NO: 9241 - DNA, 201 bp, Homo sapiens
aaatattacactaaatttagcctaataaaaattcatgccaaatttactgagtatttattggaaatcagagacttaaggtcctgaatcaggtgtaagaattrtattatcaataacagacttaacagtgattatctctaggtggtgaccgatattttgataatcatactccaaaacatctatgtagaaattgggcatggtggc

SEQ ID NO: 9242 - DNA, 201 bp, Homo sapiens
aaatattgaaaatattacactaaatttagcctaataaaaattcatgccaaatttactgagtatttattggaaatcagagacttaaggtcctgaatcaggtrtaagaattgtattatcaataacagacttaacagtgattatctctaggtggtgaccgatattttgataatcatactccaaaacatctatgtagaaattggg

SEQ ID NO: 9243 - DNA, 201 bp, Homo sapiens
attaaaaaggaaagtgttgcagctttttagtccttctaatttgacaagatagataatttgattgggtttctgatagtgcagtattttgctttaatttggtrtgaagtttagttgcccccataattattattatttttttttggtcactctgtcacccatgctggaatttagtggcatgatctcagctcactacaacctcca

SEQ ID NO: 9244 - DNA, 201 bp, Homo sapiens
gggaattaaaaaggaaagtgttgcagctttttagtccttctaatttgacaagatagataatttgattgggtttctgatagtgcagtattttgctttaattyggtgtgaagtttagttgcccccataattattattatttttttttggtcactctgtcacccatgctggaatttagtggcatgatctcagctcactacaacc

SEQ ID NO: 9245 - DNA, 201 bp, Homo sapiens
catagttaggttttataacttttaaactctaatgaattttatttagttacagtatgtaatgcatgttaattaaccaactgcacagtgaaatatgtcaatgycctttgcttccacattttctaatagagtaagctagtatattaacatttaaaacagcatgagaaccatagtactgcagaaagcaactgcagtttttaaaaa

SEQ ID NO: 9246 - DNA, 201 bp, Homo sapiens
aatgaacaggatatttcttaggttttcatattctgtcccttgagctttggaaagactatcccagatacattttctgagcacatagaatctatagcatgatyccattacatagttaggttttataacttttaaactctaatgaattttatttagttacagtatgtaatgcatgttaattaaccaactgcacagtgaaatatg

SEQ ID NO: 9247 - DNA, 201 bp, Homo sapiens
tttgttgtatcttttatttctgtctggacaagcccaggatcattgtgtggcatgccgtgacaagttttgtagcgcatcaactaaccatggcctccatcacmagtgcatgacaccatcttgtgtttcatccaagtgacacatctaggctaacccagcaagtccagtgtatgagttgtgggaattacattcttttgtagttat

SEQ ID NO: 9248 - DNA, 201 bp, Homo sapiens
caaacaaggcaaaaaaatcttttcttgccatcctaatctcaaattcctcccctttcagcatatccctccagtatttatctcaaaacaaaacaaaccccaaygaaatccaagaaagttgtgtacaaaagaatgaatactgtgttttcctcttcctccttctatgcatatttttccttttaatttccgtttctttccttttga

SEQ ID NO: 9249 - DNA, 201 bp, Homo sapiens
gcttctaataatcaatgtgaattctactctcagtagaagggggttaatacattgttcttaccacccaaagaaagcctggcctctttgcctgaactttttcrccaccgtgtttaaagccttgaaagtattggtaggctctatttggtatcttaaaattgtttccagccagtgggaggcctgtaccctagaagaaaatgagtt

SEQ ID NO: 9250 - DNA, 201 bp, Homo sapiens
tgttatttgctctccttctcccagcttactttggctacgaagttgattttattttctactatataattttgaagactatattttttatttcatttgtgtckatttgctgaattttcactgttatgttttgtgctgaattgcttctaataatcaatgtgaattctactctcagtagaagggggttaatacattgttcttacc

SEQ ID NO: 9251 - DNA, 201 bp, Homo sapiens
gcttctatttttaatttgcttttactttttctttccattcttattatattgtgaatgcctcaatgttatttgctctccttctcccagcttactttggctaygaagttgattttattttctactatataattttgaagactatattttttatttcatttgtgtcgatttgctgaattttcactgttatgttttgtgctgaat

SEQ ID NO: 9252 - DNA, 201 bp, Homo sapiens; identical to SEQ ID NO: 1328

SEQ ID NO: 9253 - DNA, 201 bp, Homo sapiens
attctactgtcatcattgtgctctgtcactttgactaagcccaagaaccctcccacagagcaatgttaattataacccctctatgcccgtaaaatatgccwtctaaaggctttgaataaatttgggataaatttcctgaagcagaactcatgaacccatatgtattttgattccaattcctgtcaatacaggttctagttc

SEQ ID NO: 9254 - DNA, 201 bp, Homo sapiens
ctcagtagaagccttagagaacccaaattgctgatgtatctttttcgaaatgcctctcattatccaggagaatgtgtgtattggaagtatcttattctttmagtctcacacttagaccggttatgtttcctacttttaaaaattgtagaactttattctacagatgtcatttgatgccttttgagaccgaccatatatgca

SEQ ID NO: 9255 - DNA, 201 bp, Homo sapiens
tggtgtcctacttgtaagagttttaaaacaggcaattttggaataggtaaattactcagtagaagccttagagaacccaaattgctgatgtatctttttcraaatgcctctcattatccaggagaatgtgtgtattggaagtatcttattctttaagtctcacacttagaccggttatgtttcctacttttaaaaattgta

SEQ ID NO: 9256 - DNA, 201 bp, Homo sapiens
gcaaatgaattaatataattagttgcttatattttaccccccacactagcctatagctttaaagttgtggtgactacaatgtctagtcacttaacctcacmgggcagatttgctcaactaataagattttgaatgagaaagtgcttaaaaattctaaaagtgcttctctaatatttgttactattgtgttcaaagactgtt

SEQ ID NO: 9257 - DNA, 201 bp, Homo sapiens
aataatttgcttggccctttccttcctactgcctgaagaaaatcaatgtttggcagctctaggttgaattactgtttattttatctttagcctacacaacygcaaaaggaaagcctgagttttccagtgcatattccaatacctgtttatggaagtgagaacgagtcagatagtgatgtattttttcagagagtttcttaa

SEQ ID NO: 9258 - DNA, 201 bp, Homo sapiens
attatgttcatcatgacagagcaaatgagcttttggggaaaacagaagcaaaataaacctttttgaataatttattattctataaacacaatcataaagcrtaatggtatcagttcaggagaaaggtcccactgctcctgtgttctacgtcagtggctgcagggccacagcaggcagagataaccaagcacgctttcactg

SEQ ID NO: 9259 - DNA, 201 bp, Homo sapiens
ctctgtcctcatatttgctagaaaaacactatgtcaaccatttgatcatactcatttgtttctaagcatatatcttaactaatctagagacccatattcaytgagcttttggaatgactggaaaatttctcaaagcttcctcccttatctacggtttagtttacaaaaattaaataagcttatgatgtgtgtctcatccac

SEQ ID NO: 9260 - DNA, 201 bp, Homo sapiens
tattgaaaatgactgtagtctggctgaggagatattaagtgaccagatggcctctggcacttctgttttcaaagctgccttatagcgcctttctcactttrtgataccaagctgctgccatgctagtgtccaccctcgaacaccatgccactcagacatggtgggattcgtgtttctgaaggggcacagtaggaagctcat

SEQ ID NO: 9261 - DNA, 201 bp, Homo sapiens
tagtgttggagaccatattgaaaatgactgtagtctggctgaggagatattaagtgaccagatggcctctggcacttctgttttcaaagctgccttatagygcctttctcactttgtgataccaagctgctgccatgctagtgtccaccctcgaacaccatgccactcagacatggtgggattcgtgtttctgaaggggca

SEQ ID NO: 9262 - DNA, 201 bp, Homo sapiens
aacgttttaattttttatcccttaaaaatgttattttttggctaacagcattgaaataagcgttactatagattaatactatgaaacaggaacaaaactghtgagcagacattctcccagggaaggactgtgtgtgaacacattaaacttacgcataaaagtggagactgtaagtgggttccagggtttccccacgctgac

SEQ ID NO: 9263 - DNA, 201 bp, Homo sapiens
acccgttagccagttccacagggcatattgggaaataccttttattttcaatatttatatttgtcttatagatatttgtcctttcaagtaggacaaagtgktaatgacctgcctctatcaaaaaattctacctagtaatccaagataagcagtgtgttcctagtgagttgcttacataaaagccaatatattttgtactga

SEQ ID NO: 9264 - DNA, 201 bp, Homo sapiens
agaagtccctcttcagaacctgtcctatgcagctgtcactcacttggctttgtaagcctgcagacagtgtcatttaaaatattttcctctgtaccataacrcttttccttttaatgatatataagaataatatttctctctaaatagttatttctttaactttgaaataattcagcatctcatgattttgatttccatttc

SEQ ID NO: 9265 - DNA, 201 bp, Homo sapiens
aacttttgcagtctccaaaaagaagtcaggtcatgtgatatttgtctgtgcgtggtccatttcacttagcataatagggggactaagttcaagagatctaytgcacaacatggtgaccatagcaaataataacatcttgtattttgaaaatcactaagggagtagattttaagtgttcttagcagaaaagaaaatacaatg

SEQ ID NO: 9266 - DNA, 201 bp, Homo sapiens
accctaatagcctctcataaccaccgttctactctacttctatgagttcaacttttgcagtctccaaaaagaagtcaggtcatgtgatatttgtctgtgcrtggtccatttcacttagcataatagggggactaagttcaagagatctactgcacaacatggtgaccatagcaaataataacatcttgtattttgaaaatc

SEQ ID NO: 9267 - DNA, 201 bp, Homo sapiens
tgccacaatggaaaagcaaactcaattacaaatgctggattccacctggagcctattctttttcattttcttacttctgtttctgccaccttcccttcttmcgataacagattttcaagtactgctcttagaattgctaaatgtgttcagagaatgtgtgataagatctgattctcctggaaggccaggttattttaatct

SEQ ID NO: 9268 - DNA, 201 bp, Homo sapiens
cttaaacgcatgttaataaattcttaagttaagcacacaatgtgtgcgtgtacccacacatgccaattttgatagccagccagtatttataacagtatcaytgactgaatgtcatcagcccataagcagatcctggaaagaacatatatagttgaattttatctaaataattacttgagagtatctttaaaaaatctaagc

SEQ ID NO: 9269 - DNA, 201 bp, Homo sapiens
tgcctgaactttttcaccaccgtgtttaaagccttgaaagtattggtaggctctatttggtatcttaaaattgtttccagccagtgggaggcctgtacccyagaagaaaatgagttgagttagctccaagtagtaccagtggtatttgcatctttttaaaattccttaaaaagcatttaggaaattagttcttttccttca

SEQ ID NO: 9270 - DNA, 201 bp, Homo sapiens
ggtggctgtagcactggaagaatatttgcagccccacaaactaatgtctgaattacttaggatacatccctctgtctagagccagcccaaaaaaatatgtkattcctgccctgattcagatagagatatctccaggctacttactatatgtatttattatgaagtacatgaataaatcgccacccaaatacagtaaatgca

SEQ ID NO: 9271 - DNA, 201 bp, Homo sapiens
caaatgaaagagatgcagagtgggaggtaggtggggaggggtttggcgcttccacgccctctccagcacaccaccctccaggaacctcgacatgtccagcygtctggaagatctctgaaccctgtcttttggggtttttgtggaggcttcattacataggcataattgattacatcattgccattggggatcaactcaatc

SEQ ID NO: 9272 - DNA, 201 bp, Homo sapiens
tcactgcaacctctgcctcccggtttcaagcaattctcctgcctcagcctcctgagtagctgggattacaggtgtgcgctaccgcacctggctaatttttktatttttagtagagatggggtttcaccatgttggccaggctcgtttcgaattcctgaccttgtgatctgcctgccttggcctcccaaagtgttgggatta

SEQ ID NO: 9273 - DNA, 201 bp, Homo sapiens
aggtgactactgaatgcgtaacactttcacaccatcgtaaagctgaaaaattgtcagtcaaatcttcccaagtcagggaccgtctgtattggcaagattgrttccttctgagggttgtgagggagggatctgttccaggcctctctttggcttgtagatagatgactgtcttcatatttgtatggtgttttccttgtccaa

SEQ ID NO: 9274 - DNA, 201 bp, Homo sapiens
attgcttactttcataaaatgaagttttatttagatacccaagatgtaaaacatgaaaaatgtagacccactataactgggggagttcttgagggtggaargagagaaccctgctcagccttcctattctgccccctccccagattcccttgcctttgctactggctttcccagccttggaagctactggggtacgttaag

SEQ ID NO: 9275 - DNA, 201 bp, Homo sapiens
attggttgagcctgtcacgtgtctatgccttggctgcttgagcttgggaaaggaagattcttcccaattatgcttctatagcatactcatactccaagatraggagaggctggaatgttggataaccatccccaacccccaatgacagtcatccactaagctctgcattaattagctgtgtgaccatggataaatcatttc

SEQ ID NO: 9276 - DNA, 201 bp, Homo sapiens
ctagatccatcccctagaaagtaactgtgtccagttatcaatgggcagggcttgctgggcgttaagcacaggtaacctctagtcttttactatgtttctgygacagtggcataaaacagctttttaatgagacctactgagatgcactgacagatctcttcctttccttttgtgtctagcccatccaccttcatgtaaatg

SEQ ID NO: 9277 - DNA, 201 bp, Homo sapiens
cctagtctgtgattccaaatctcaagcaccacctgcaattgtccatatttttcacccacaggatgctcatgttaccaggaacttaaaagagtaaacgtggktgctgacattttagcgttcgtgggccagttttctgagatcaacactaggcaaggtactggggagtgtcttctaacacttttcagactttgaacagctaac

SEQ ID NO: 9278 - DNA, 201 bp, Homo sapiens
acagataaaagaaacatacataaaaaagtaaatactatgattttctttctccctggattgctcctttaacacaataattttacagaaacctttttccattstaagtattattatattgctcaattttccagtgccaatcccttcctttatttggaggagcctctgaatgccagtggggagatagttttcctcttactggtc

SEQ ID NO: 9279 - DNA, 201 bp, Homo sapiens
ttttctgtattaaatcacttattcaaacaatgatttattcaacagaaagcattgaacactgtatttcttttctgacaaccacttctccaattctctgacascaactgggtgcccaacaattttattcaattctgatactacctggagttagcacagatcccccaggttaaggactcagtctcacaagacttctgctactct

SEQ ID NO: 9280 - DNA, 201 bp, Homo sapiens
aattcctcaccctttacacctccttgcactagacacactcatttacaaactctatacttctactgtattcctatgactggagggtgtttatgagaaaagcrggtgagccttagagtaccagtatatcaatttttttccacagtaggttaagggattcatggagggaccccccctgccccccaaattgatttgccttttgca

SEQ ID NO: 9281 - DNA, 201 bp, Homo sapiens
taagcccctcttcttattgactccatgtcagatttcatagcttgacctgttacaggatctcacattgtctctgtaataggtgtgccggtccttactcttayctgattttcaactgtgagagtatttgcaccctgggtttgagggagaggaggttttccctgagccttacctcttgctgctatttcaatagaagtcataggg

SEQ ID NO: 9282 - DNA, 201 bp, Homo sapiens
acacacacatttaaaaaattgtcataaggacacacagcaaatggaaaaacatttattcaagacatctattaaataccagttagaaaaatgagaggtgtgayatttaaactgtaaccagctgccatccgctagctcacccctgctccttgttttggaagccaaaaggacaagagctttcttacctgccagttatcagtctag

SEQ ID NO: 9283 - DNA, 201 bp, Homo sapiens
acagggtctcactctgtcacctaggctagagtgcagtagcacaatcatagctcactgcagcctccaggaatcgagacctgttgatattttagtcatgtttrtgtactcagcatatttttttaaaataatatgataaaataccataattaaatgattactcaaaagtggtctactatattaggttttgtgtatattacttaa

SEQ ID NO: 9284 - DNA, 201 bp, Homo sapiens
ccacctctttcaagggtggtgtatctgaatgtcaaggtgattggcataacactaatgcataataaccagaaatcgagtttatcttccaagatcttaatagwggatcctcctcaagagaaaacctttcagacatatcagccttacaactggaatctatttacttttcatttgtttttcaccctatttatgtcattttccttt

SEQ ID NO: 9285 - DNA, 201 bp, Homo sapiens
aattccacctctttcaagggtggtgtatctgaatgtcaaggtgattggcataacactaatgcataataaccagaaatcgagtttatcttccaagatcttamtagaggatcctcctcaagagaaaacctttcagacatatcagccttacaactggaatctatttacttttcatttgtttttcaccctatttatgtcattttc

SEQ ID NO: 9286 - DNA, 201 bp, Homo sapiens
aaaatctaaaaaaaaaattaaaaataatcatttgaggaactctgttaaattttttaaaaagtgcattaggtttagatgtgatgaagcaacaaatgcaacaratgttgcaatgccaatcagatacttgactaagacaaaagtttaatgccaaactgcttcaccagaaatagcttcctacctgacagaggacactgaattgtg

SEQ ID NO: 9287 - DNA, 201 bp, Homo sapiens
cattttaaaatgaaaaaatatatatatatgtaatttatttgaagaaagtctattcatttacgtaacacttatcattgagcacttcgtaggtacctggcgtygttctagacactggaaacagaccactgattctgatgctcaagggccctgttggtggcattgcctttggtgcatccttttctttcacctcttatactttcg

SEQ ID NO: 9288 - DNA, 201 bp, Homo sapiens
tctgaaagaattggaacccgcaattcaaaacaatttaaactgttctggagacaaagctaactctctggtggggtttctttcttctgatgataaatttgggrgtcacttaatccaggacagttcctgcatttatggaaaatgagcatatcgaggtaggattaaagaagtgaattcattcattaggctctatgccatcatggt

SEQ ID NO: 9289 - DNA, 201 bp, Homo sapiens
caaagatacgggtcaaacatttaaggccgttaacaagaagttaaatcagcaacaacatttatatagaggcattaattcagggtgaacgcaaaatgtgttgyagcatcgattctggcatttttctctgctcctaatagctctgagcatttgatctatatgttatatggacctaaatgaagggaaataaacatctggacagat

SEQ ID NO: 9290 - DNA, 201 bp, Homo sapiens
gcataccttaagcactcagtaaattatagccattctattttattccattccatgttaatggttcaacatgaaatagaattgcatccaaacaaatcgtgacrtcaagggtgttacctgaaaaaaaaaggtgtttcttacttaaatatattaagtaaatatagggttgtgtacaaattttaaaattttgctttactgtgggac

SEQ ID NO: 9291 - DNA, 201 bp, Homo sapiens
ttatttttttataaagtgacctcagaaaatgtgcacagggtggggcatctcatgtgaaaagcatctcaatcattgattccagccacatgccatcataagckctttaaggagagatcctatattttatattaccctcattaaatcttactccccaccataggtttctctctgtcctaaatatctgcttttagaaggagtaaa

SEQ ID NO: 9292 - DNA, 201 bp, Homo sapiens
gctgggcacggtggctcacgcctgtaatcccagcactttgggaggccaaggcaggcggatcgcttgaagacaggagttcaagacaagcctggccaacatgrtgaaaacccgtctctactaaaaacacaaaaattagccgggcggatgagggttcctataatcccagctacttgggaggctgaaacacgagaatcgcttgaa

SEQ ID NO: 9293 - DNA, 201 bp, Homo sapiens
tacatggaaatttaatcacttccaaagctgttatcacaatttagtggagagatggaaagtgtttttttggcaaatggtagaaagataaccaaccatccatwtagaagaaaataatgttggtgcctatctcacatcataaacagaaataaattccaagtgaattgaagacttaaagtttaaaaaattattaaaaatattgga

SEQ ID NO: 9294 - DNA, 201 bp, Homo sapiens
atagtcctctccaattagggtacaaaaagattatttttttcttcagaaattgagtggatggtctgctgctgtaggtttcattctcaacatcattttgtccyttcctaaaaatatccatttttaaactgctgatttattttggccatcgtccccacaaactttttgtaaagcatcagtgattttaccattctctcacccaag

SEQ ID NO: 9295 - DNA, 201 bp, Homo sapiens
atgttgatctcacttgtttaaaattttcatttaaagctctggtcttgtcttcagcttatctgagcacagtggtcttgacactgattgagtgaaaagtttgytcaactttaatttttcagtaagcattgttagtgaaccaattgaggtgtctatggcgttggctattgttcatgctgctaattgatagtcctctccaattag

SEQ ID NO: 9296 - DNA, 201 bp, Homo sapiens
tataaatattaaattaataaataaaatattatcctatcatacttagtaacaaaggtataaggctacaatattacacctgtcctgtaacttcacagatatcwaatgaatatctagaaaacatctctgacttgctgcgagtgtgtcactaaagccctacattgaccatatatgtctttattctctatctgataatgttgcaac

SEQ ID NO: 9297 - DNA, 201 bp, Homo sapiens
caagccaatgggctgggtttccagaggcataaatcctaggaattagtaatatcccatataaaatcactgaaggttggtgcctatggttatgtcagtggccyctatgatactccctaaaggcgtaatttattccacagtccctagacacattcgttcatgttctttgaaacagggcacacttgcctttcccagaaatttttc

SEQ ID NO: 9298 - DNA, 201 bp, Homo sapiens
cttcctttgctccagctgcattcatcagcttccatcagggttcacagcaatgaaattaattgacaagaagctcaatcttaagagcactctgaactgtataytcttgccatccacccgctaactccaatcctacatgaatgaatgcaagtgtagttttttgagaaggggccatggctcaagcagtgccatatatgtgccttc

SEQ ID NO: 9299 - DNA, 201 bp, Homo sapiens
tcagcagtctgatttcagtttacagatgcagtcttaaaaaaggaccctgagatcatctataacacttccctgtcttcctttgctccagctgcattcatcarcttccatcagggttcacagcaatgaaattaattgacaagaagctcaatcttaagagcactctgaactgtatactcttgccatccacccgctaactccaat

SEQ ID NO: 9300 - DNA, 201 bp, Homo sapiens
atttatttttagtagcaacaagctctcactatgttgcccaggatggtcttgaacttctgggctcaagtaatcctcttgtcttagtcttccaaagtgctggmattacaggcatgagccaccatgcctgccctaatggtgtttttaaaggaggaattagctgtggtcagtacagatttatttggaagaaatggaatctgtgct

SEQ ID NO: 9301 - DNA, 201 bp, Homo sapiens
tggtggcccacacttgcaatcccattactttgggaggctgacaccagtaaatcacttgaggccaagagttcaaaaccagcctcagcaatatagtgagaacscatcactacaaattcctttttttaaattagctggacatggtgacccatgcctgtagtcccagctacttgggtggctgagtcaggagggttgcttgagcgc

SEQ ID NO: 9302 - DNA, 201 bp, Homo sapiens
ttgtccacgctgcacacagttgccaaattcaactttctgtgttgcaaaccttgttgtggctccccctgtgtaaaaaccttttagtgtttctcatctccatraatcactaatccatggtgcttagtagcatgtcaaaggcccttccgaatctatctctagcctacctctgtggaccttatctcttggctctcccacctgccc

SEQ ID NO: 9303 - DNA, 201 bp, Homo sapiens
aagacaaatattcattaaaacaaatattaattcctcaaagtttaattcttaacaaatattaattctacaaagagctaaaaggctctatgtaggtagataayggcattcagatttacctcctaatctttacagtaattggttttaagggttggagaaagaagtaaaggaggtaaaagaatgtacatagacaataataattat

SEQ ID NO: 9304 - DNA, 201 bp, Homo sapiens
actgctaggtgctgtgtgctatgctaggtgctgctgatacagttatgagcaagacagactcagaatcttataaatctttttgtacaaaagacaaacaattrtttcagtgagttgattaaatttaatattaatatttaataaagcagaagtaattatacctgcaaaggaaaaataaagtgtgtttttagcacctataatttg

SEQ ID NO: 9305 - DNA, 201 bp, Homo sapiens
tgcattcatcagcttccatcagggttcacagcaatgaaattaattgacaagaagctcaatcttaagagcactctgaactgtatactcttgccatccacccsctaactccaatcctacatgaatgaatgcaagtgtagttttttgagaaggggccatggctcaagcagtgccatatatgtgccttctatacaactggcttgg

SEQ ID NO: 9306 - DNA, 201 bp, Homo sapiens
gaattatcccctctgggtccttccaccttttccctgctgccaccagcttgagagaaatgagataaggaatctacacagttttcatctccttgcttttaccrctagacaacagagcctccgggggaagtttatttttaggatcagggctcaactaatattgattaacagccttacataatgtgaggctccagggtttgttct

SEQ ID NO: 9307 - DNA, 201 bp, Homo sapiens
tagagactatggcacccaggagaacccagaccgaagagggcagccactgctcagctgctgccagtcatcacagcacaggagcaatggaccaatattatgawtttatcttcttttgaaagacaatccagaagtcgagacttttataaaaagtctgaattcattacctgtattaaattttctttgatttaaaacactgatcag

SEQ ID NO: 9308 - DNA, 201 bp, Homo sapiens
ggggccaggtggaggtaataggatcatgggggcagtttcccccatactgttctcatggtagtgaataagtctcatgagatctgatggttttataaatgggrgttcccctgcacgagctatcttgcctgctgccatgactttgctcctcattcaccttccatcatgatagtgaggcctcccaagccttgtggaactgtgagt

SEQ ID NO: 9309 - DNA, 201 bp, Homo sapiens
agtggtgctgaaagtgtatatttcatctcaatgacaatctcaaaaaattataatgcaagcatattctgaatgatcttgttgaccacctaataaccaggtayttttatagaattttaatgcttgtgttgagttgtgttcatggggaacaaacctgtcataccttatttggtaaggactattgagaaaagagcagagccaggt

SEQ ID NO: 9310 - DNA, 201 bp, Homo sapiens
gaattagtcatacaataattatttaaagaaagaaatgtttcctccatgttgtgctggagatacaatggtggagaggaagtggagatcaactattgatcgayttataatttacacaattccacactttggagaaaacacattccttcttcctcaccatcaccctcaccattataattattatcaattaacttgttcaatatg

SEQ ID NO: 9311 - DNA, 201 bp, Homo sapiens
tcaacttaatgaagggtagaacattgagatatatacctgttaatagtagaataatatgacatggcacagtatccaggtatggaaaaggtgaatagggatartgttatgagatttttagagtacgttaattttataaagcatgcttatgggaaaagccaaacattgatgacatttcgcagaaaatgttatgttcaggtttgg

SEQ ID NO: 9312 - DNA, 201 bp, Homo sapiens
tgcagacacagtatacctgctgtcctagagtttagactctaatgagggagagagataataaacaaggaaataagtgtatgtaacaatgtacagctagaaaygctgggaaagaaacgaacgtgagagacacttattggaatttaaatgcaagccactccactatatctactaggtgtgtgtgttacaaaatacaaaaaaaga

SEQ ID NO: 9313 - DNA, 201 bp, Homo sapiens
acagtaggtttagaaatcatcaagggtttagtctcactactcacttattactaatgtttaaacagtaaagacatacagagtagctcctatagaagatttaygttaagttatctcacttggagaacatgctctcggggaattgttcctgcctacaaggtctgaatgagtcagctgtgcaccgggatgaatgggtcatctcca

SEQ ID NO: 9314 - DNA, 201 bp, Homo sapiens
ttcctttatctctgtgcctgaacaagccccccttgctataatcttcatgctgacccctcattctctagagtatatgctgttttctgcagcagactacacgkccagtgcccttgcttggagcagatctagacatcatatcgccacggtcttcattctgaagtaaccttagaagtcactttcagttcataacattaaagcaca

SEQ ID NO: 9315 - DNA, 201 bp, Homo sapiens
gttcctttatctctgtgcctgaacaagccccccttgctataatcttcatgctgacccctcattctctagagtatatgctgttttctgcagcagactacackgccagtgcccttgcttggagcagatctagacatcatatcgccacggtcttcattctgaagtaaccttagaagtcactttcagttcataacattaaagcac

SEQ ID NO: 9316 - DNA, 201 bp, Homo sapiens
tttgtcaatattttccacagcatcacaattgtcagaaaacacagtgaagcttaagttaaaacaaatctgcaaagaaaaagtcaaaaagaaaactcttccayagattttcagagagatgatttattagtccaaatttgagcattgaaactagcctatattctaagtttaagaaaactgtaattttcatgtttctttcagttc

SEQ ID NO: 9317 - DNA, 201 bp, Homo sapiens
acctttctttcttttgttaaaaaaaaaaaaaaaaaaaaaaaattatgatagtgctagtcaatactgagttgactgtcaaaaataagcacactttacattasccagttacttctgggacactgttgaagagtatgtcacatgtacccacaaattagtcaaacatctttaggcatcacatgatatctaaattagtctttttct

SEQ ID NO: 9318 - DNA, 201 bp, Homo sapiens
accatgattgtgaggcctccccagcgatgtggaactgtaagtccattaaacctttctttcttttgttaaaaaaaaaaaaaaaaaaaaaaaattatgatagkgctagtcaatactgagttgactgtcaaaaataagcacactttacattagccagttacttctgggacactgttgaagagtatgtcacatgtacccacaaat

SEQ ID NO: 9319 - DNA, 201 bp, Homo sapiens
atgtaatccaatttgaacactgcctcaaacccagtgcccttcatgtggtaagtattcaatacatacctaatattttaactttatttatttttacctcctcygatacaaaaaaatgtaaataaccctcaatgatctgtaaaaaatcacttagttggaacactttgttcatcctctagcaatgtctgataagttagttatcat

SEQ ID NO: 9320 - DNA, 201 bp, Homo sapiens
tctaataacaattcatgtccaattatctgactgccagcacagttatctgctatggttgttagaaactttagaaagaagtaaatcctccaaaattgtcactyttaaaatctgagagaaaacagaatgaatagataagagatgcttcaaggcagttcagctctgtgatggttccgttgagatagaacacacatatacaaagtg

SEQ ID NO: 9321 - DNA, 201 bp, Homo sapiens
attttctaatatcattgatatataaagctgagtataccagacacttgtaaagaaatgatcttttccaatgaaaacacaggtgttaaacagaacctttcttytggcctacaaatcactcttctaacacttggaaaaaattaaagaaatattcagcaatgtgtagaatttcaatcccagagagacaggaagagactgtatagc

SEQ ID NO: 9322 - DNA, 201 bp, Homo sapiens
gtaagtttcacgtgaatgttttcctatgtgtatgtgtgcatgcttatttgcatttgtgtgcacttgtgggtatgtgtatttgtcctgtgtcacaataaaakgtatctatttctggactttgcagtcaaaaacattggaaaactgtctatgtaggtaatggacacaatagaatttagaaagcaacttttacaaacattgcag

SEQ ID NO: 9323 - DNA, 201 bp, Homo sapiens
caggtacttattgagcatctattacgtgccatagaatattctgattattaaggatgtcaaggtatataatccagagtcacggttttcaaggaactcagtcrataattacaagctaatacatgggtaccactgttctaggcacagcgtggcagaaaagaatagcgtggacacacattcaggggatttaactaggagaaaaca

SEQ ID NO: 9324 - DNA, 201 bp, Homo sapiens
tagagtaatttctagttagaagtggctgtgagattcactgtcttctggtgatatttgaaatatactatattcatgcaaatgtttctgattatttaaacacrttatctgtatctataattatcagtagctgctggcattatgtgagcatgcaaaagtgggaacagcagcagtaacctgactcatttcaaccaggatggacca

SEQ ID NO: 9325 - DNA, 201 bp, Homo sapiens
gttttgttacctccggataaatcttcatgatgaaatgtgcagccggtccacctcttcaatcttctctcttcttcttcctcagtggaagctcaattaccatkaaggccaaaataaataaataaataaacaacaaaccaaccaaataaataaataaagcagataaaccgtggttctttgcttaaaaaaagttgcagcaaagaa

SEQ ID NO: 9326 - DNA, 201 bp, Homo sapiens
attagctaatgaggctctctttgtttgaggattggaaagcctccaaaaacccactcaggagggaaattaacaaatgtctgttttgttacctccggataaaycttcatgatgaaatgtgcagccggtccacctcttcaatcttctctcttcttcttcctcagtggaagctcaattaccatgaaggccaaaataaataaataa

SEQ ID NO: 9327 - DNA, 201 bp, Homo sapiens
ggccgatactgcagttttgatggccatcactggtacaacaccctgcgtatgccaagactgtcatgccttgtcagctataataaaaagcaggagacaaatgrccttttgttacctgaaatgatggatcagtatgtatgtgcaaggatgcacgctgtcaagttcttgtgggttaatcatgccaggctgatggaggggctccac

SEQ ID NO: 9328 - DNA, 201 bp, Homo sapiens
gatcacacactattttcatcagaaattttaataaaattatttttttctcagatgacttcccgcatactactaagtgatctgggagaaggagtcttagggtstggatgggattctgccttgggcatattttgctctactgggccctggagtctttgcagatgctgtcaagatactgcacttttttttcttttttgagacaga

SEQ ID NO: 9329 - DNA, 201 bp, Homo sapiens
tttctactctgtgttactatgtatttgactgtttattagtgtcgacttaggagtgagatcaaactctttcactctctctttctttcccgtttttttttttktttgtttttgtttttttttaaacaagatctcacactgttgcccaggctggagtacagtcacatgattccagctcactgcagcctcaacttcccaggctcc

SEQ ID NO: 9330 - DNA, 201 bp, Homo sapiens
atttttttaatattctagaaaccatgaaagaaatcactgagtccttagctcctgttttttttttttttttttttggttgttgttaaattgtagaatattaraatgtttcagttttactgattgtatttgttaatcattcttcttccactaccgttgtcttttcccatcctcttggaagggtgttagagaagactctatatc

SEQ ID NO: 9331 - DNA, 201 bp, Homo sapiens
ctctgtgatggttccgttgagatagaacacacatatacaaagtgtttgaagtaagaatttccttcgaggagaagcacaaagggaatagaagacccagcatytgttactggccttagataagcttactgttcacttatttatcaatgtaaaaacgcccagttagtttttagctcaaggaagagaggacatggccaaagatgg

SEQ ID NO: 9332 - DNA, 201 bp, Homo sapiens
tttctgcttggtgcattaatcgagagttatttggacagaactgaattgccaggggaggaacaagcaaggtggtaactcacccttccctgccctttcatctstctgtaatacggttctatgtcatgggcctccttcacatacacactcccccagttgtccattactcccaccctctccgtcttacccacacctagagatatg

SEQ ID NO: 9333 - DNA, 201 bp, Homo sapiens
tattaactgagtgcctcttctgggctgagataagaaaatcattgtgaaaccaaataagaacaagcattgcaggccccagatatttagagactccagtgacrtttgggcttttcctgaactttagtgtgcaatgtcattttaaaaagtattttaggggaaatgataaattatagccagtttcataaaagaggtatacattat

SEQ ID NO: 9334 - DNA, 201 bp, Homo sapiens
tgagcacagcagtcaataaaaataaggtaacacaaagcagctctcttgaaaacaaaatcagagcctatactcttaagaagttcatagccgtcacaaaaggrccctcgtggcagtagaagctaaatggccaagaatgctggaaatggggctgcaagtcataaatggagaaagtctaaactaagagggtaaacagcaggtgac

SEQ ID NO: 9335 - DNA, 201 bp, Homo sapiens
attagtctgataaaaagtcacatcagagaaggtttacctccaaatgattttggtggcaaagaagcctgtgcatcaacacctgcccttgagcacagcagtcmataaaaataaggtaacacaaagcagctctcttgaaaacaaaatcagagcctatactcttaagaagttcatagccgtcacaaaagggccctcgtggcagta

SEQ ID NO: 9336 - DNA, 201 bp, Homo sapiens
gaaaccgtgtttgatctgacgttttggctcttgtatgaggcagctttaaatagctgtcagatttggtttcattttagtgaagggttaagtaattttaaggsgttaaaaccatgggcaataaataaccatccacagtcatcgaaggaagttgcttcttagacaagagaatgaagctagagctgctagggacattagtctgat

SEQ ID NO: 9337 - DNA, 201 bp, Homo sapiens
tttactgctgtagctgcctcctgaactgctgctgctgctaccatggcttctagatgcttctttgacaatttatttattttccagtggaacccatctgtgargaagcccttcatagcagtaatatcctggggctgggcactactacaataatgatgctttcgttaatcaccccatgtaattttagtttttgctgataaatac

SEQ ID NO: 9338 - DNA, 201 bp, Homo sapiens
ggtcagtattcagttgaaaggtcatcaaccagaaatatggttagccattttttagaagaaaacaaattagaaaaaagtatggataacaactttggacaccraagaatatttctataatatttcctgctcagtctgtagtggaaggcagtagagaatagaacttacaaacatagccttggagtgagaaagatctggaaacta

SEQ ID NO: 9339 - DNA, 201 bp, Homo sapiens
atgcaaacaataccatgtaaatgaagaacattaacgtggcagatgacattttcctgagaataaagctctacttgcaacataaatacaacacaattgctatrttttaggttctttagaatttggcacattttactgctgtatgccttgtgatttctcagttctgttattatttgtctctgtttgaacccatgcaaaaccttc

SEQ ID NO: 9340 - DNA, 201 bp, Homo sapiens
acaaatcaaatgcaaacaataccatgtaaatgaagaacattaacgtggcagatgacattttcctgagaataaagctctacttgcaacataaatacaacacrattgctatgttttaggttctttagaatttggcacattttactgctgtatgccttgtgatttctcagttctgttattatttgtctctgtttgaacccatgc

SEQ ID NO: 9341 - DNA, 201 bp, Homo sapiens
ggatactgaaggataactgttactcaaaagagggattgctggatcatataaagttattttcttaatgcattcatgtatgcactagtgtgtgtatgcctctrtacacccatgcctgtcactctatgacctgttgtcatatctgtacattcatgtaacaatcgccatgtttaagaaatgtagcattgagcctatgtcttaact

SEQ ID NO: 9342 - DNA, 201 bp, Homo sapiens
agcaagttgactattcaaaccaaaaggcctccagttgaagttgtgttttaatttaagcactagtagggcccagcaaatcaaatattgaaagatgctaaaawtagtctgattactttgtgagtcatcaaattgatttgactgtccttgcccttcatataatgtcccaatagacacttaacctgactctacttccttgaattt

SEQ ID NO: 9343 - DNA, 201 bp, Homo sapiens
ggaaggattgctagacaaaggaataaatttttaatatctgaacatcttaaaataggcaaatacccagccaatgtagaaattttatattgttaaatatcagsttaatagaggcagtatatagactcatataactgtttatcaatcacaatttgaactgctgtattatgttaaattagtgtacatggtttagatatataaagt

SEQ ID NO: 9344 - DNA, 201 bp, Homo sapiens
ggtacttttctctgatccttttggaaagagcaagtgtcctttgagaaatacttgttcttggttgttccctgctccccacccccatgcctgtccctgccacytctagagcaggtggaagtcgcctgtgggttcttctggtctcaggctttgactgttcccctccacaaatttgttcttaattcgattttgtattgaagcaca

SEQ ID NO: 9345 - DNA, 201 bp, Homo sapiens
cctagatcacaactggtataattaggatttgaagacaggctgtttgacacctaagctgatacttccaaagactattccaatagcacaaaattcaattgctstggggacatggttctcagaacctggtcttcttgaatcactagaccgatcctcctcagaatttaagacctgggtggaaagggaaagaccatccagctcacc

SEQ ID NO: 9346 - DNA, 201 bp, Homo sapiens
gtctcactctgtcacctaggctagagtgcagtagcacaatcatagctcactgcagcctccaggaatcgagacctgttgatattttagtcatgtttatgtastcagcatatttttttaaaataatatgataaaataccataattaaatgattactcaaaagtggtctactatattaggttttgtgtatattacttaaaataa

SEQ ID NO: 9347 - DNA, 201 bp, Homo sapiens
ctgctagtctgggggatcacaaatcaagagccatgccttgattattctcttcttgagtgcttcagttgacttttacaataccatagtttcctgatcttgaygcttaatgacatttgtagtcacattttctggtttcttctaccctttttctctaaaacagggcaatgttgcccctcagagaacattggtcaatgtctggag

SEQ ID NO: 9348 - DNA, 201 bp, Homo sapiens
agcattcctggttgagaatcattgtactagaccaaggaatggatcatattgaccagaaggaagttgtatattattaaaaaaaattatccaactccagaagwagtatactggggcagtctaacttggggaccttttgaatgtctccaccatgggaacaaaggctaagtaaagcagtggcccattgctcagtccaacagcact

SEQ ID NO: 9349 - DNA, 201 bp, Homo sapiens
cactccagcctgggtgatagagagactccatctcaaaaaaaaaaaaaaaagtttattagcaagtataaatgtatcagaacttaacaggtcaatttcttgtrttattgtgagactaaaaaaaattgggaaaaaaggaaagctttgaagagaaaaaaatgggtagccatcagaatcattttgtgaaaggaacaaatactaata

SEQ ID NO: 9350 - DNA, 201 bp, Homo sapiens
ttgctaagtcccggcctgctcctctcacaatggggccaaggtctgtgcagcatgctggtgtgcctggtgaaaggagaaaatgagcttcataaatacaaackttagagtcaatcttatgttccccagggactgccagtactttacttggcaagaatagaaaaggaattcttaaggatataaaggcaaaaacgaacactgtaa

SEQ ID NO: 9351 - DNA, 201 bp, Homo sapiens
tggattaaaagataataggatttggagaacaggacccagtgaatcacaaattcattacattcacagctgacaattgctaagtcccggcctgctcctctcayaatggggccaaggtctgtgcagcatgctggtgtgcctggtgaaaggagaaaatgagcttcataaatacaaacgttagagtcaatcttatgttccccaggg

SEQ ID NO: 9352 - DNA, 201 bp, Homo sapiens
tttatatacactcaaaatgaataagtgatacggtttgttcttctcctctacttctctgtttcccaaagtaatttgcaagttagaagaggaaatccattagragaagctgaatggattaaaagataataggatttggagaacaggacccagtgaatcacaaattcattacattcacagctgacaattgctaagtcccggcct

SEQ ID NO: 9353 - DNA, 201 bp, Homo sapiens
atttttcaaccaaacaggactaggacatagatcaaggtctgtcagcctatgctcaaagtgtcctctgcagactttgttgccactaaactagaaataatccrtagtttctcctgtttccttttccgttaatgaccaactttatatacactcaaaatgaataagtgatacggtttgttcttctcctctacttctctgtttccc

SEQ ID NO: 9354 - DNA, 201 bp, Homo sapiens
ctcctaaagagttttgaaaaataaacacatagatatgaagaaagatggcccaatataaaccaacagtggtcctactatccctgtcctctatgggcttgctragcaataccccaaggtaactttcaagctgactttgatgtgaatgcccaggttcacgtataggagtaacatagaccactaagaggggtttcttgacaatcc

SEQ ID NO: 9355 - DNA, 201 bp, Homo sapiens
cagcagcgacttgaactctgtgttgcttgtgtccagaaaattccaggcactttgtcaatttttttcttcattttcaaattatccttttgaggaaaatataraggagtaatcccattatctctattttagagataattcagctgagtttcaagaggtttgttgtcttgcttcaagttgtccattagcagaacgaagaacaaa

SEQ ID NO: 9356 - DNA, 201 bp, Homo sapiens
gttaaaagaaagaacaaaggcatgtcaatgttttggactgaggctagccgaggactttcactggcactctttttagagctagaccattggggaagttgcartgttacataatgctatgcttctcattgccatagagaagcagcagctgctttgagactttagaaaatcagcagcgacttgaactctgtgttgcttgtgtcc

SEQ ID NO: 9357 - DNA, 201 bp, Homo sapiens
aagagactatcttctaaatatatccttagttcttcaggcagcaatttaatttcagttaaaagaaagaacaaaggcatgtcaatgttttggactgaggctarccgaggactttcactggcactctttttagagctagaccattggggaagttgcagtgttacataatgctatgcttctcattgccatagagaagcagcagct

SEQ ID NO: 9358 - DNA, 201 bp, Homo sapiens
aaagctaagaaagattaagactttatttttccctatagtctgcctttctgtgttcccaattctttacactgctgtgtaatgttatggaatatgattctcarttaggaaacttgaacgaagacaaaaaaaatggtaagagactatcttctaaatatatccttagttcttcaggcagcaatttaatttcagttaaaagaaaga

SEQ ID NO: 9359 - DNA, 201 bp, Homo sapiens
cttcatctctggcttagctcctttcattaccttcatggcccctctagaagtttatgttaggtttttaaggccagaccagactgacttgagcccagccgtarttggagaccagattcaaggctctctcttggtggcaggtgacattagtcagactttattcttatctatgaaagttcataagtaagtgagcttttgtgtttt

SEQ ID NO: 9360 - DNA, 201 bp, Homo sapiens
ttttttgttgaagatttcccatgaagatattgattattgtctttttcagtttttaatcagatgcattggctaatacctgtttgtagctgaagctaagtctrtcctcttaggccatggtgtgaattgtgtgtttccctttcttccttcatctctggcttagctcctttcattaccttcatggcccctctagaagtttatgtt

SEQ ID NO: 9361 - DNA, 201 bp, Homo sapiens
tggacagcactctttgcagctcaggtcaggcagtaagtctttagttgcagggtgagctgggcagcacattacagtgtctactatactaacattttttgttraagatttcccatgaagatattgattattgtctttttcagtttttaatcagatgcattggctaatacctgtttgtagctgaagctaagtctatcctcttag

SEQ ID NO: 9362 - DNA, 201 bp, Homo sapiens
aataataaaagcaaaacaaaacaagaaaccaccaggtgctaatagtcacaggctgagttccctaggaacagactctgagattgagtttagcatgccacatratttttaaggagttccctggggaaggaagtaggattgagcagagagaagttgagctgcgatgcaggcccaacaatgggctcagctaaccccacgaggagc

SEQ ID NO: 9363 - DNA, 201 bp, Homo sapiens
gggcttggggcactggttaaggaaacagattaatgagcagcaaacaggaattgatgggagtcctctgacattttgaggatatccctacacatcactgcagsctgagggaagcttggctgaaagaaactggccagaggcatgttctgactttggctgacttggaaagaatggcagtgctattaacaatgtacacatagtggg

SEQ ID NO: 9364 - DNA, 201 bp, Homo sapiens
gttagaaggctggagttatgaaccaaaccatagtaactaaaattcatgcatattacaaccaagcaaaatgcagactacctgtgtgtatatgtacatttagyatttttttgtttgtttgtttttaactttgtagcttcagcacaccatgccacaaactttgtgccttataataccttggctgaatatcttctcagaggatga

SEQ ID NO: 9365 - DNA, 201 bp, Homo sapiens
aaacttttaaaacccaaattttgtttttaaaactttataaaagatggtaaattcctcttcaaaatttaaacttcaactccaaatttagtatgggtgatttytcataacatttcaaataccttttaaaatacataccttttatacttaaacttaaatctatagtaaattatgagtttggttcattttatcattatatctcta

SEQ ID NO: 9366 - DNA, 201 bp, Homo sapiens
acatgcaggcaagcctcaagcccgcccacagtagacaaacatatacctttattgttataaaccattttggacttgtttgttactgcagcataatctggctsttatagtggacacatttggttagatacaagtgtaagaagttttattttccttgatgaatagtgggaaagtgtgtatataatattgtaaacctttttcagc

SEQ ID NO: 9367 - DNA, 201 bp, Homo sapiens
atttcataaaagatctcaacatataaatattgcttttagcctgtgatattgtctccatggagggaaggactcagatggaaataaggtatcacagaagggtrcagagtgccttttcttttaaagtaattgcaaaaataggagttatattggttatcagaacatgtttgtatttcattattaagctggtaaaaagaaccatgg

SEQ ID NO: 9368 - DNA, 201 bp, Homo sapiens
catttttattagtgacagggttttgctctgtcacccaggctgaagtatagtagcatggtaatagctcactgcagccttgaccttccaggctcatgatcctwacgcctcatcctcctgagtagctgggaccacaggcatgtgccaccatgcctggctaatgccttttaagtttggtatggacaaggtctcactgtattgccc

SEQ ID NO: 9369 - DNA, 201 bp, Homo sapiens
ggaatcaaacttggatatattgtattttcatcttattttatttcatttttattagtgacagggttttgctctgtcacccaggctgaagtatagtagcatgrtaatagctcactgcagccttgaccttccaggctcatgatcctaacgcctcatcctcctgagtagctgggaccacaggcatgtgccaccatgcctggctaa

SEQ ID NO: 9370 - DNA, 201 bp, Homo sapiens
atattaaaatccagccacttgtaaagagtgagtaataaaataagtttagggttatataaattgagtctaataaaataattcagattcctatggtacattasagttttatagtagtgcctttattttctcttgttcttctacaaatgcctttttgaatatttattcattacccatttcctggataaagatagtaaggcttag

SEQ ID NO: 9371 - DNA, 201 bp, Homo sapiens
tttctatatgtcctggattctgcatgctgcctgctcggagaggagagccttacactggagtttgcaggcatttgctgctgtctcaataggtagatcttcarttaggtcccagcttcatgccatctgttatttctaaagtattttggccttcagctggaggaaggtgacaggagagtgttctgttcctgcagaaaatttgct

SEQ ID NO: 9372 - DNA, 201 bp, Homo sapiens
aaaggcaaaaacgaacactgtaaaacacaaaccacaacaatggaaaactatagagccttgcttccaaagcttagtcatccatacttttctgaaatgccagraattgggatatggaaaagagctcagaaaactacaggaggcatccatggaacaaccacagaattctcattctggaaagctttggcagggctatgttctcat

SEQ ID NO: 9373 - DNA, 201 bp, Homo sapiens
gtatgctctctgaattgaaccttaccttttaacatgaaatttctaattgaaacaaagctgtgatgcctccagctttgttcttttggcttaggattgacttrgcgatgcaggctcttttttggttccatatgaactttaaagtagttttttccaattctgtgaagaaagtcattggtagcttgatggggatggcattgaatc

SEQ ID NO: 9374 - DNA, 201 bp, Homo sapiens
aaggtttgaaaaaggaaagataagaaaagcagcattggatgacccataacttctagaagccagggtgggtgcagtgtgctaaatgtgagaagaatggggcrtggttatgtagaattcaataggtttagaacagctcatactgtcattacctattcactcgagttagaaacctcaaagtgagatgtgatctttctttctcat

SEQ ID NO: 9375 - DNA, 201 bp, Homo sapiens
agtttgttctgtctctgccatttactagttaatctctctatgcctcaatttccccatttgtaaaatggatttaataatggctgtctaccttataaggttgmtatgaggtgccagtgtgataataaacgtaaaagtactttgaatattgcaaaacactgtatgaatgtcaggaattaggcaggcaacaactatttcttgggg

SEQ ID NO: 9376 - DNA, 201 bp, Homo sapiens
gatgctgtatcttgcctgcatccaacagactgggattattctgagctctcaagcaaaacatggttaaatcctgacaacaaaatgaagtgacatttatgctyacatatatccttccttgttttctgcattttcatttgaaaagtaaacatctagtccattttgtttatgtgtctaataatcattttattttactttaatttc

SEQ ID NO: 9377 - DNA, 201 bp, Homo sapiens
ccatatcaaatatcatagaagaaaaaataaacatatgggaacatataagtgagaaaataagtttgtgaattatcaaaaagtggaaatagtaatatctaggmaggttagcatacataagtgatgttctagtggttctcaatctttgtggcagaatataatcatctacagaattcaaatcaaaacaaaacaaaaaaaactctg

SEQ ID NO: 9378 - DNA, 201 bp, Homo sapiens
aaggttttgcaggccagatctggaagtagctatatcacttctgctcatattctattggctagaactcagtcatgagctcattctcaactgcagggaaagcygggacatgttgaccggctatgagtccagtaggtaaagaaaaactgtttggagaacaatttgccagtcttgatcagagtggaagatgaaaaaaatgtggag

SEQ ID NO: 9379 - DNA, 201 bp, Homo sapiens
aaaacagatacaaatttctaccaagaatcttatgtttgagagggtaccccgaatgaaagaggagcaaccaagagtggagaaaagcgtaaaatataatgttygggaaagttgctttgatttgaaccaagtggcttaaaactatgaactcagacagatctggctttatatactggttttgatagtcacctaattgctgtgtga

SEQ ID NO: 9380 - DNA, 201 bp, Homo sapiens
taaaaattccatgggtgtggccacatgctatggatttagacaatattaaactgttgtgaattcttaagtctgtaagaatggatttatgaggttttaagggstcctaagaaagacttacaatatggtcatgagaggtcacatcctgaccactagaactcctagtttagctgagaggcagggttgccgagtgaacaccatttg

SEQ ID NO: 9381 - DNA, 201 bp, Homo sapiens
ttatctacctgtgaaatgaaattgctaaggtttactctatgaacctcagaaggattttaagcatcagtcttcatctccattttataaatgagaaaaataasgctcagagagattaaatcatatatccaatgcaagtggtggaaataccagatgcagtagtgctttgccaataaaggtttttgcaaaaaaaaaaaaagatgc

SEQ ID NO: 9382 - DNA, 201 bp, Homo sapiens
gattttccaagagcttatatgtatctgggaagcaatatttaccaaaatgatgaatacttgtgatatgggtaggaggcagggaaatactgggtagaagaggrcagttccccagccaaggccccactctcaaacctggaaactgctgccctaaatgagaacagttatccccgttttccttcccaaatgctacctttttggcct

SEQ ID NO: 9383 - DNA, 201 bp, Homo sapiens
aaaatgatgaatacttgtgatatgggtaggaggcagggaaatactgggtagaagagggcagttccccagccaaggccccactctcaaacctggaaactgcygccctaaatgagaacagttatccccgttttccttcccaaatgctacctttttggcctgccctgcctcctatcctgtgcccctataaaccccagacctcag

SEQ ID NO: 9384 - DNA, 201 bp, Homo sapiens
ccaaggctgtgaggtggggatgatgtgacaatttataataaattaaggtccccagcttttccccttctcatgactcccaaggaaccctaaaaaggataaayctacatggttcagtgttagtgaaaattctttttttaaaaatttttgctggttcaacttcttcctccttgatacacacacacacacacacacacacacaca

SEQ ID NO: 9385 - DNA, 201 bp, Homo sapiens
aaaaggataaacctacatggttcagtgttagtgaaaattctttttttaaaaatttttgctggttcaacttcttcctccttgatacacacacacacacacayacacacacacacacactcattctcctaaagataatatcatctctgctagatccattctttgagatttgtgatacagcactgaaagactgagaagaaagag

SEQ ID NO: 9386 - DNA, 201 bp, Homo sapiens
agcagatctaggaatagaaaggccagtaaagctttataaaccatgaggggctggggtctggttagaataattaagaagagaaataattttttgtttttcayatatatgacctggggaacaaatataaatcctacaaaactatctttctttccatttaaatattgtctagttctttcatcagagacaggtgtaatatttaag

SEQ ID NO: 9387 - DNA, 201 bp, Homo sapiens
caagccctgttctttattaactctggataatttgctttctttgtttgatccctggcctttaagtgaatgtcaatctcttgcttttttcctgaagacctatraggcttgctgactaaatttcatggaaattctttgagattcttagctagaagaggctgtaaaggccaagtgctataggtactaacgtctcattgctaacac

SEQ ID NO: 9388 - DNA, 201 bp, Homo sapiens
attagaggtgtgagccactgtggttggcctaagtaatacagccacacaatttaaaaccttgaactgtgcctagatatcccctttggggaaaaggcatcacyttagttgctagagtgctggctgatggctgttggctaaatccttcacgaagaactgcctttgactattgaagccaccttgcccaaccaaggtcaagcccct

SEQ ID NO: 9389 - DNA, 201 bp, Homo sapiens
atcgcatttcgattaaataaatgttcagagtttgttattatgactttgtaatatcgcctattgaaaacaatgtaagatcatacatgaactgacttgttccrcaactattcaccagctgcatagaatgtgccagacactgttctagagactgaggatacagcagtgaaaaacaacagactatatttctacctctgacaaaac

SEQ ID NO: 9390 - DNA, 201 bp, Homo sapiens
gtacacaattccaataggaattatatatacacacactgaaaatagaatttgattaaataattacactaggtacaagctacattttacttccattgaaggasagctaagtggaaactagtgtgagacaatcatgaatagaaaagtgcagaaggaatttgatgaggatgttcccagggctatttctagccagaaaacgaagct

SEQ ID NO: 9391 - DNA, 201 bp, Homo sapiens
taaagataggtcattccaagagtgagcctcccattattatgactcatgacaaaggggtgtgggactggttggaaaagagtttccaaagctggactgcatcrcatggtcatgtggaatgggctgcctgctctcccagtctgaaccctacctctgtgctatgccaaaggtgcagatccccttagtgaaaattggagacatgaa

SEQ ID NO: 9392 - DNA, 201 bp, Homo sapiens
ctatcatatgttgtaatatcaagaaaccttttagcatgtacatttgtctaggtttctggactttacagccttctggtatttcacttgcttgtgtctttcaytgaacactaataaccagaaatcagcaacgtgaaaatttgattcttcttcctatttttctcatgccttcctttggtctttctttctgcttggtggaaactg

SEQ ID NO: 9393 - DNA, 201 bp, Homo sapiens
ccttctggtatttcacttgcttgtgtctttcactgaacactaataaccagaaatcagcaacgtgaaaatttgattcttcttcctatttttctcatgccttmctttggtctttctttctgcttggtggaaactgtggagttcagtggaagttttcctgcagtctaattagcccctctgtttaattttgtaataaaaacgctg

SEQ ID NO: 9394 - DNA, 201 bp, Homo sapiens
tgaacactaataaccagaaatcagcaacgtgaaaatttgattcttcttcctatttttctcatgccttcctttggtctttctttctgcttggtggaaactgyggagttcagtggaagttttcctgcagtctaattagcccctctgtttaattttgtaataaaaacgctgaaccagaagctggagataatgtgcccaattcaa

SEQ ID NO: 9395 - DNA, 201 bp, Homo sapiens
caaatatcctgaattttatactctcactgattttactttctaaacaaggaatatatacgtattgtagaaaaaaatcactgtgaagtaaattccacccgtgmtccaaccctccagagaaaatcgtgcataaaaggtcccgcagattcccacctgtctttctttccttccttatctaccaatattttttcacatgcatgcaac

SEQ ID NO: 9396 - DNA, 201 bp, Homo sapiens
cattatgcagttcctaaagagaatgcattccacagcattcattaattatgccagcctgtagatgcacaactaccacggcatacacttgagaccacacaccrtaaggattgaaactctctcaaagccacaatgtatgtctgtgttgctttgcactcttacattgcccatcctttacaacagcccttctcctgtccttctgat

SEQ ID NO: 9397 - DNA, 201 bp, Homo sapiens
tcctcaaagattcctcaagggaccctgtggaaaaatgaaaacaagagaggctatcaaggggtgcaagtaagaggtgcagtgttgagttataataatctaartgtccttcctaaatggctgaaagtatattgcagtagaaaagtattaaaatgtgtatgtgtcccaaaaaagaggcaaaatgtaatggagatcatgtcctct

SEQ ID NO: 9398 - DNA, 201 bp, Homo sapiens
attgaaaataagtaagtcaaaaccaaaaccaggaaagtttgcattcattcccaatcatactttaacagaacttgcagctgccacagattcagacatcttcrtcttcctgtggagcatttgtcttttcatagcagaggacaatctctgtgactttcttatatcactgagaccatcttgtacagtttatttcaacagcaagag

SEQ ID NO: 9399 - DNA, 201 bp, Homo sapiens
atttgtcttttcatagcagaggacaatctctgtgactttcttatatcactgagaccatcttgtacagtttatttcaacagcaagagtgttctttttcgttycatgccaccagtgacaatacgaaaccagatctaactgaaacttcactcaacacattcccgacccgccaccccaaccctaatagcctctcataaccaccgt

SEQ ID NO: 9400 - DNA, 201 bp, Homo sapiens
caaactcacccaggtggtgatggctgccatttgccgaacatttatgacatactccccacttcatgggcagcatcctacttagtcttgaaaccacccattargacagcgttggtcttattcccatttttttagattaggaacagtctatgggagtgtagcttagtttgggaaatgctggtattcaacccagaaccatctgac

SEQ ID NO: 9401 - DNA, 201 bp, Homo sapiens
ggagcttggactaatgctaaaattaaacataaccacccagaagacaaagagaccagatagaaatacataaaacatttgaggtggtgggaacacatggacayagggcacatagaaacttgcccccaaaacattaggttaatacatagctcaaggttatttataaaggaattaacatacacaaaggagctttttataattata

SEQ ID NO: 9402 - DNA, 201 bp, Homo sapiens
tttagataggccctgttgatacgaccaagctaaccttcatcctgaaatcaattcatactcaggatgacaggaaatgagttgtcattaaggctcatattctrtttttgagtccttagttaacctcttataattcagtttatttttcctcctccatttctgtaaaatggcaggtaatttaatgacatagattattacttccta

SEQ ID NO: 9403 - DNA, 201 bp, Homo sapiens
catcttacattgataccattactatcactttccgctaatattgattgacaaaataccaggtaccagacactgtgcaagaactttgtttacactgtcttatratgagctcatgaccactcagtgaggtagtcactattaatatcctcattttataattggggcaactaaagtttgaagaagctaaagcattttcccaagata

SEQ ID NO: 9404 - DNA, 201 bp, Homo sapiens
atcccccaacctgctccttacagagtgatccttgtctcagtaattccaacatccatcagttgtgtgatccaaaaacttagaactcatacctccctttcctyatgcccacagtttgttcatacaaagttctatagaatctacctcccgaatacattcaaaattagaccacttctcactgcaactcaataccatgctcctcac

SEQ ID NO: 9405 - DNA, 201 bp, Homo sapiens
cttgtctcagtaattccaacatccatcagttgtgtgatccaaaaacttagaactcatacctccctttcctcatgcccacagtttgttcatacaaagttctrtagaatctacctcccgaatacattcaaaattagaccacttctcactgcaactcaataccatgctcctcacttccatctctactactcgaagccactcgag

SEQ ID NO: 9406 - DNA, 201 bp, Homo sapiens
gttttgaccagcacatcaagagtggctttacctcccaggcattgatccagcattagtcaagctacaagacactgatgtagaaaaccataatgtcagtttamtaatgtagaataagaaataaaatctcagaagacctgagctctcctgtcagcatgacttgcacttgtacttttcctttttgtagagaagctaaattataat

SEQ ID NO: 9407 - DNA, 201 bp, Homo sapiens
aggcctggcacagataagcactgagcaaatgttagttttctttcacatgggtcattaaagtccgtctgtaaagtctcagggactttctcatcattttcccyaaacctaatgcaagatattcacatttctttttgtgcaaagaacaatcttaattcagctgataatcggggcctcccttaccttcccactgctcactataac

SEQ ID NO: 9408 - DNA, 201 bp, Homo sapiens
tgtaaagtctcagggactttctcatcattttccctaaacctaatgcaagatattcacatttctttttgtgcaaagaacaatcttaattcagctgataatcrgggcctcccttaccttcccactgctcactataacagagaacaagtactagctcataactttttatgactttgtattgaattaaaattataatgctttatt

SEQ ID NO: 9409 - DNA, 201 bp, Homo sapiens
taaaaacaagcagatacacacagtaatatcgtatagtcatagaactatgaaatgttaaagcaaggaaacacaatagtgactataagggtcaaacaccattrtagagaggaaaatcagggaggaccacttgggttgggtgatatttaagctgagatttgaatgaagaatggaagccattcttgtgaaagatctgggtgattg

SEQ ID NO: 9410 - DNA, 201 bp, Homo sapiens
catccctgatagtgatacgaattattgcttttttaaattgtgccagctgagaagtgtaaagtgatatttcattgttattttaatttgcatttctcggactrttagtgaatctgagcatttttgcatttgtttgtaggccatttagctgagcacttctgtaaatgggctattcatgacttcttgtttctacaatggagatat

SEQ ID NO: 9411 - DNA, 201 bp, Homo sapiens
gaattattgcttttttaaattgtgccagctgagaagtgtaaagtgatatttcattgttattttaatttgcatttctcggactattagtgaatctgagcatytttgcatttgtttgtaggccatttagctgagcacttctgtaaatgggctattcatgacttcttgtttctacaatggagatatttgtctttttcttgtctt

SEQ ID NO: 9412 - DNA, 201 bp, Homo sapiens
ggtcacagaggaggtcaagtggtgaatgtgggatttgaactctgggaatctggcactgaaatccactcttattatagttcctcttatttgttaggccaggmctatttatgaaaaaagccactcttttcccactgaattacattacttttcttgtcatttattaaattctcacatataccagagtttatttctcgattgtct

SEQ ID NO: 9413 - DNA, 201 bp, Homo sapiens
ggatttgaactctgggaatctggcactgaaatccactcttattatagttcctcttatttgttaggccaggactatttatgaaaaaagccactcttttcccmctgaattacattacttttcttgtcatttattaaattctcacatataccagagtttatttctcgattgtctgtctgctccctgatcttttcatctattcct

SEQ ID NO: 9414 - DNA, 201 bp, Homo sapiens
gtcactgctgtaagatccctgagcatggtccagtaaaggcttttcaggtcctatctaggcttcctgggacatgcagactgatacacagcttcaatctttgyatgtcagggggtgctgaggagagcagggcataccaactcagttcaagtgctcttcacagaattcctcttcttcagtctttaaaatgcacacggatgacct

SEQ ID NO: 9415 - DNA, 201 bp, Homo sapiens
atgcctccaacaccctgcaatgctatgtctttccaagagcttaagagaggctgattatatttgaatagtaaggttacatttatttcatgtctcattgtgamtactagttccaacttttagtcataaccaattattagagaagagtcagagttttaatagcattattatgtatgctttgtgttttagtgcacttcccaggag

SEQ ID NO: 9416 - DNA, 201 bp, Homo sapiens
ggacaataatattagctatgggcatgaaaagtacaaaaagaacccataatcaggttcatttatatatgcatgcatattttaaagctaggtgcttttcctastgcagagatgtagatagcggtttcaacaaacagatttacgaaatcatgagtgtgtttagtcacaattttgggaggtacctggaactcttttcccagagaa

SEQ ID NO: 9417 - DNA, 201 bp, Homo sapiens
cagtggttgacaacaaatgagagaactctcgtgggtctcacaccagcaactaaatgcatggctcaggaatgatactcaatttatcagttaacactgttctyttggcccaacccatcacaacgagacccaaaagtcctctcttactacaaccctataatggaggagaactaggaaagtgtggtaaacagtgccgctcattat

SEQ ID NO: 9418 - DNA, 201 bp, Homo sapiens
agcctcaaacacttggtgctataaagcaaccaagctttgtttctcagccatctgcatgtccgtagcaagttggcttattgccatcctcactcaatgacccrgaatgacaaagaagccgctaccaggagtttgctgggtgcagtggttgacaacaaatgagagaactctcgtgggtctcacaccagcaactaaatgcatggc

SEQ ID NO: 9419 - DNA, 201 bp, Homo sapiens
ttaaaatactcacaattaggctaagtggacagataagttaggcctacataaaatatgtaatatgtaacacatgtatttctgttatagaaataactcaattrtaacatgtaaaagctgtgattgtcgaaaatgcatggattttagagtcagacctggattctatttttccataagtctcttattgtgtgaattctcttgtaa

SEQ ID NO: 9420 - DNA, 201 bp, Homo sapiens
taaaccagcatgacattggggtctgtgaatgagaagtggatgttccgagtagatttgaaggacgtgatgactcaggatgccagttgtgactggtgacttasagccgtggtagctttgacttgcatcttatttacttgcatcggctgtcttgtccttccttgcttctcgccttttcaggtcatggttcctgatgtcctaagc

SEQ ID NO: 9421 - DNA, 201 bp, Homo sapiens
atcaaatatttaaaaattcacacgtgcgtgctcatggctgtgcactcatgtgcatgtgtgcctgttgtgtgcgtgcatatataccatacagaaaagtactstctggagaatacattagactatgcatgtaaatgtgtgtagaatgtttttcttttttttcatgcaatacatgctctatggatatttgttaagtgactgaag

SEQ ID NO: 9422 - DNA, 201 bp, Homo sapiens
acgtgtgtaaagttgttttcagctctgtacacctgtgcacactggccaggaaagctggaccttctgcagagaaaactgtcttctccagataggaaagtgtrcctcattgagctttgggctaggccagagctagaagatctttcctgtgtttgggtcattcctagatcagtgatccctaatgaccagttccattccctaaag

SEQ ID NO: 9423 - DNA, 201 bp, Homo sapiens
tgaggttcagagaggttgctacttatatggtagcaaaagtatttcccttccctacttaccctactatacaaaacaaacaaacaaacaaacaaacaaaaaamcagaaaacttgatgataaatgtcaatcaacactcagcctctgcatctgatgagcaacagaaattagcggggactgtggtgaattggaaaacctgtgcctt

SEQ ID NO: 9424 - DNA, 201 bp, Homo sapiens
aaaatttaaagagatattggacagattagcaattatgacttttttaaacttttattttaggttcatgtgaagttttgatatataggtaaactcatgtcacygggctttgctctacagatattttatcacctgtgtatgtaagccttgtacccaatagttatttttttctgctcctctccttcctcctaccctctaccctca

SEQ ID NO: 9425 - DNA, 201 bp, Homo sapiens
actaagctacttattggaaggtgggtgattaggatgtagcataggggtaagactgtgtaaccagctgacactgctttaaatgataaagcattgagttgttytgttttaatggtacacaagtcaaaattgttcaaggattgagagtggagccagaaagcctgggtgtaaatcctggctccttcacttacaagctgcgtgatt

SEQ ID NO: 9426 - DNA, 201 bp, Homo sapiens
ttcactagtgagaaagctaaagctcagaaaggataaatgacttgactaagctacttattggaaggtgggtgattaggatgtagcataggggtaagactgtrtaaccagctgacactgctttaaatgataaagcattgagttgttctgttttaatggtacacaagtcaaaattgttcaaggattgagagtggagccagaaag

SEQ ID NO: 9427 - DNA, 201 bp, Homo sapiens
gggatgagccaactggcctgttttaacctatattacttgagttttggctaccaaaactctaagcattcacatgggcccccacgaagctctgccatctgacmctttcagcaccttcaactctatccagtctcactcctgctgtactaacaaacattccataaacacaaaaccaaaaccacttaaaaaaaaaaatcttaggct

SEQ ID NO: 9428 - DNA, 201 bp, Homo sapiens
tgatgtcaccactgggtggacctctatggcacctgtctcactctgccttggttccagttatttttgtatatgcttcattgattatttctactcacttcccrgaaatgttccctttccctgagaaatggagttgtatctccctcattgatgcatcctctgtaacatctagctgtttaatgtgtcactcagaataagtgctca

SEQ ID NO: 9429 - DNA, 201 bp, Homo sapiens
agggaattcaggacagagggagcagaaggctctaacgtggaaacaagaaggccagagtacccagagcagaatgagaaggggattcctaatcaggaaggaaycatatgtggttgttcactgagagcaatcattgacagtctcacccatgttctacaaaatttcacttcatgattaaaacaaattatatctctgtctttgcct

SEQ ID NO: 9430 - DNA, 201 bp, Homo sapiens
cttgctaaaaattacaaagtgtttatggcagttctggcaaatatcctctagatcaccagataatgccaagtcagcaatattatcaataatgagttgcctaytaagaaccaggggaatgggggcatggactgaaactttaccatagacatctttgctattctggactgttggtttgcttcctagtgtacttctgcttatcct

SEQ ID NO: 9431 - DNA, 201 bp, Homo sapiens
gccttagttaaatcctctatcaatatgacaggttaaaaaaaagacatatgagttagttaaaagcacctctcccttggtaactctaagtgttttagtttttmagatggcaatttgtgactttctatagctttttcttgagatgaatttgtggaccagttgaatagtgatagaaatacaggacttgctaaaaattacaaagtg

SEQ ID NO: 9432 - DNA, 201 bp, Homo sapiens
tacagtattatttctatcccaatcatgtttaaggattattattttacatagaaataaataaagaaaggggaaccaatacaaagtgttagaaagacagctaygattaatatattggactggcccattatcagaccctctagattttacaggtagctttctgatcagaaatctcgggtgagaaatagtaagaatgatggcctt

SEQ ID NO: 9433 - DNA, 201 bp, Homo sapiens
agcagcatatgaacacatgtttaccctccttggccacactttgtcttactctatgttttctaggaacacattttggggtggaaatgcctttattccatttmtatttagtcaattatctggtttagcttccattcttacaacctaattaaattcagcccatcaactcagtttaaggcatagcagctgtagacacttcgttta

SEQ ID NO: 9434 - DNA, 201 bp, Homo sapiens
tttgagaagtgtccgttcatattctttgcctatttttaatggagttatttgatttttgtgttgaattgtttaagtttcttacggattctagatattaggtrtattttaaatgcatagtttacaaatattttctcccattctctaggttatctgcttactctattgatagtttcttttgctgtgcaaaaagtctttagttta

SEQ ID NO: 9435 - DNA, 201 bp, Homo sapiens
ggctgcatgtatgtcttcttttgagaagtgtccgttcatattctttgcctatttttaatggagttatttgatttttgtgttgaattgtttaagtttcttayggattctagatattaggtgtattttaaatgcatagtttacaaatattttctcccattctctaggttatctgcttactctattgatagtttcttttgctgt

SEQ ID NO: 9436 - DNA, 201 bp, Homo sapiens
tgatcactttttcatgtaattgttggctgcatgtatgtcttcttttgagaagtgtccgttcatattctttgcctatttttaatggagttatttgatttttktgttgaattgtttaagtttcttacggattctagatattaggtgtattttaaatgcatagtttacaaatattttctcccattctctaggttatctgcttac

SEQ ID NO: 9437 - DNA, 201 bp, Homo sapiens
ctaatgtacattctcaccaacagtgtagctttccctttcctctgcaacctttccaacatctgtttttttgtttgtttgtttttcactttttagtaatagcygttctgactggtgtgagatgatatctcattgcagttttggtttgcatttctctaactagtgatattgatcactttttcatgtaattgttggctgcatgta

SEQ ID NO: 9438 - DNA, 201 bp, Homo sapiens
ctgatgagtctttccctaacgagaatgtgactaaaaccagttgagtttgcgaaagggatgtagaaagagacaattaggtaaaggtgaaaaatgagactgaygaagtgacgttggtcaatctcctgtttactgagtgcaggttaggaaataacatcaactaggttttctggaatttgagaactgagtattataaaaacactg

SEQ ID NO: 9439 - DNA, 201 bp, Homo sapiens
aagtcaacctttcattttagcttagcaggaaacacactaaaccacggctgaaatatgccaggaagttggtagctggtgatgcctctaccacaccgcagtgyggttaatccagcattcgacttagtcgaaatcacttttttcttccaatactggcatttttatggatggatggatggatagatgaatatcagtatcaaaagg

SEQ ID NO: 9440 - DNA, 201 bp, Homo sapiens
gaagtctcagatgaaatttctgaatcagccttaaactataatgcttaaactgtttaaatgtgaagggataaaatttggggcatttatgccactattttatkttatcgttgttacagtgagtacaatttttaattggtatgtgtgtaagatttgctcagatctcaatcaatggttctaagaggaaaaagcttaattccaagc

SEQ ID NO: 9441 - DNA, 201 bp, Homo sapiens
agttgtgtgagattgggaaagttgcacttgtttaatctgtaaaatggaaaatatctgaggattaaattaaaatatagctggatcatgcatagcataatacwtggaatatactaagtcatgaataaatagtactgttgtcatttctttgacattaattattaaggcaattaggaaattttccatctagttaacatatagcaa

SEQ ID NO: 9442 - DNA, 201 bp, Homo sapiens
tcattacttgttagaaagtaatgtgaagcacttaataaacttcaggtggtggtattaggtaattaacatgtgaaattcctcatatggttatttaaatttcrtggtagtatttaacagttttcatgtttatggccttttcctgcaactaagttgtaaaatccttaagggaaaggatgaggaaaggaagacaagagagaaact

SEQ ID NO: 9443 - DNA, 201 bp, Homo sapiens
tccaaaagcggtaggattacaggcatgagccactgctcccggactttttttttttttaatccttctactttactcatactctccaaagttaattcacacamaacctccccaataaaatggaagtgaggtttaaaatcagaccataatttaaccagctgaccaaatgccattttgtataagaagataaaaagctaccattgt

SEQ ID NO: 9444 - DNA, 201 bp, Homo sapiens
tacgtgcccacacaatctctttactgtggtatttggtagctaatacatctttcaagcctcatctacttcatcgcctcctgcaccccaagctggaattacaygtgtcttattgccctgtccctgcatatcttctggccttatagacctctgtgcctttatctatgtcgttccttctacctcaacaggtttctgtcctaccat

SEQ ID NO: 9445 - DNA, 201 bp, Homo sapiens
cgagacttttataaaaagtctgaattcattacctgtattaaattttctttgatttaaaacactgatcaggctaaatacaacatacctgtaagatattacayacctactgcaagaaccctgcctctgcatataaaggagaaagataagcacagttgattctcttcacaagccctgtgtcatgcaaacaggattaatagccca

SEQ ID NO: 9446 - DNA, 201 bp, Homo sapiens
cacggtcttcattctgaagtaaccttagaagtcactttcagttcataacattaaagcacaggttacaactcatatgactacatgggccatataaaataaaygagtcaatgtgccgaagatcaggaaagtgatagctcaggcaagactgacactaattcttggcctctctgtctaagagacagaagagagtgctagagacta

SEQ ID NO: 9447 - DNA, 201 bp, Homo sapiens
tactttggctagaagcctaagcagaatctcttctacttccctcaaaatctatttcttagcaccagcaagactgggtctgtccagtgggttgtgggtttggrgagaagcagaggaaagattgacatcatgtggaatctggaagagacagaacacatctcttggtgcttttgaaggtacagtgactccatctagtagtaaaag

SEQ ID NO: 9448 - DNA, 201 bp, Homo sapiens
actatcgtctttgcagtatagtatcgttggtgcagaggatttgggatagaaatccagtctgggggccgagatgtgatcattatgtgcaatatcatcttcaraaagtcaggtcatggttatcagtttgctacaaagaacatcttagtctcatttcctgtccaaggcaggaattttcccctgaacattcctgacagaagataa

SEQ ID NO: 9449 - DNA, 201 bp, Homo sapiens
aagtgtgacactgatttcagtacaatacatctagagggaataatttttctctaaattcccaggtggctaaaaagagggctctgtggatagatgtggaaagsgtgagacagatgcttctctgagcctcgggtttctcatcttaaaatagagataattacagtacctacctcacaaggttgtggggatttgttgggaggatct

SEQ ID NO: 9450 - DNA, 201 bp, Homo sapiens
aggaatgaccaaattgaataactcaagttttctttcttttgtcattacaatcagtgtgctatcactttttattttaaatgttggtttaagcaaatgtgtaygtatgtgtgagatatatatatatttcatatatatatatatatataatatatatataatttcagcattaaggagacattgtgcccacataaagtgataatg

SEQ ID NO: 9451 - DNA, 201 bp, Homo sapiens
tgagtcctgaggatggttatattatcatgacaaatcttgcttattgtttttaattagacaaaattttcaaataactgtgagttattacatatctcttttaktatagtgttctatagattgtattttgtttcattacccacactacacacacaaaccacatatacacatgcacaacacacacacattctttctatacttcat

SEQ ID NO: 9452 - DNA, 201 bp, Homo sapiens
taacccattttatcagttgtgctgtcttccactgctgttctctatattccatcagaggaaacaaatggcttctattgtgcataagaatgccatttagtccmaagcaccatttgaaatggaaatgaggagtaacagtaacagaagaacattggctaataattgtgctctgaatagccatttggccatgtgggcagggtaaag

SEQ ID NO: 9453 - DNA, 201 bp, Homo sapiens
tttcaattcttcataaaacatggaaaaaactttggagactgaataagatctatggtaatccacaatagatgaggccctgaacacaacatagggaaaacatrtaacccacccccaataagctcaacttactgtaaactcttgaggagtaattagggacttcagcagtctctctgaaaaagccaacgcattgtaaaacccttt

SEQ ID NO: 9454 - DNA, 201 bp, Homo sapiens
tcccaggttcaagggattctcctgcctcagcctcccgaatagctgggactacatgcacaccccaccacaccaagctaatttttttattttttagtagagaygaggtttcaccatattggccaggatggtcttgatctcttgacctcatgatccacccgcctcagccttccaaagtgctgggattacaggcatgagccacca

SEQ ID NO: 9455 - DNA, 201 bp, Homo sapiens
gtaaaatggggggaattcctgaaggacagtgttaggatgaaatcacattacttataatgtcgaattcctctgtcaatgcttatatgcttctcattcattawttctaagtcaagcatttttaaagcatttaacatgcaattattcatttttgtttataaagtgaccctgtgaacttatccctattttacagttgatgaatct

SEQ ID NO: 9456 - DNA, 201 bp, Homo sapiens
ggattatggaaggttttgtctaccatgcaaagaagctaggattttattctgaaggtgaaggtgaagggtctatattaagacagttagatttgcattttttmaacaatttaaaaaagatttatgtttcagaaaaatcaccctggtaacaatgtagaggtggaaacatgaggcagggagctcattaatgacctgtatgagaag

SEQ ID NO: 9457 - DNA, 201 bp, Homo sapiens
actgcagcctggacaacaagagcggaacttcatctcaaaaaaaaaaaaaaattgttagaaaagggttctctgggaggctggagaaagagccctgaatgcargctaggatgaccaggaaagattgctgagcccaatgctgaaggacaaatagtaaggggagggggaaagggcacccccacaaaagcatgtaggagttggggc

SEQ ID NO: 9458 - DNA, 201 bp, Homo sapiens
tactgagcactaattatggcatggggaaagtgccttaggacacctagctcctgccaacttgaagctccaaatctccctagggagaaggcagttagagagtrgtatggtaactattgaaattgttagaagagggatggggcatggtggctcacgcctgtaatcccaatactttgggaagctgaggcaggtggatcacctgat

SEQ ID NO: 9459 - DNA, 201 bp, Homo sapiens
aaggctgcgtatcattctttggggccatgcttctcaaagtgtggtccccggaccaacagcatctgtatcacttgggaacctactggaaatgcagaatctcrggccagcaccctagacctgttgaattagaaactctgggggcggaatccacctctctgtgttttcatgagctctgtgggtgactgtagcaccacgacttta

SEQ ID NO: 9460 - DNA, 201 bp, Homo sapiens
aatcaggagtccttggttgtattttgagagctgctgcaggctggctgtgtacttagtatatcagaagctcgtgatttcctcaccattgaaagggagataarattgcccaacctccctggctcaaaaggttggataataagaagtgagagaagggaaatacaaagaagagtggagtcgttgcagaagggtttgtggaggggg

SEQ ID NO: 9461 - DNA, 201 bp, Homo sapiens
gagagccttgcactgtagagaattgtgttgggagggtatgaatcaggtaagtcaggagaaaagggaattgtgagatgtctagggaatgggataagggaggrcatgcacatgcgcatgtgtgtgtgtacatgtgtgtgcctgtgtgtgggtacatgcctgtggcccacacttggggggcagctgttacatttgctgcttagg

SEQ ID NO: 9462 - DNA, 201 bp, Homo sapiens
tgggcatgcccactgactcacaacacatgctcattaatacagctgagcaggcatcctcccttcctcctgcacgtgaggcacatacacagaaagccgggctrccactggcattcaggatgggggagctgctgctctgacgtggctgctttcgtttgagacttcttgggggcactttgataaccaaatctgaaatggacactg

SEQ ID NO: 9463 - DNA, 201 bp, Homo sapiens
aggtctctctcacacatccagggccttagtgttgactggaggctgagacccttggttctcctccatgtggcttctcgtcttccagggtctcttcttgcggytcctcaaaccagaaagatggcctgggtttcctgatagcatgttggctgggttctaaaagaatgaaaatagaaattgttaggcttcttcagggcaagacct

SEQ ID NO: 9464 - DNA, 201 bp, Homo sapiens
aaatatctttaggcagccatgttgaccccagaaattagtgccagggactttcttaaagaggattctaagattttctggaattcctgaagaaaagtagatgrggagcactgagaagaagaagtacgtctcaggtcacccagttaaatttgaatttcagtgctccttctccttttcagtgacacaaagggagacagaaagaga

SEQ ID NO: 9465 - DNA, 201 bp, Homo sapiens
tatatactccacaggtcttaagtggacatcctctgctcattgtttgatagatgaggagagtaagtgcctctagaggttgagtgactcatctgagatgattsttagtaacagaggtgcaatgggtggggtgtcttttcagctcccagcatgttcaaagggtcagtatccacatatgaccacccccagggttccctcttatct

SEQ ID NO: 9466 - DNA, 201 bp, Homo sapiens
tgtgatataattttctggacctaggttctggccctactgtgtatcagtctcttgagctatggggggcctctccctggttccagggctcagcttcttcatcygtgaaatgaggctggatttggagctcttgaaggtccctcctcggggtgacactccatggttctcagagatgtcccaaggaaaggccatggttacatcatg

SEQ ID NO: 9467 - DNA, 201 bp, Homo sapiens
gagaaggattagacattctagacaagtatgaatgtgtgttttttttttcaggggtggggtggggccagagaaaattggattctgagaagcaaggaagtctyacctttagccaagaccttgaagcagagcatgaatgcatttctgcatgaccttgagatggtgtagccagacgccctggtgtggggagacagtgtctgttta

SEQ ID NO: 9468 - DNA, 201 bp, Homo sapiens
gtttgtcgattggaggaaagaaccacatgggtttagtgttggagttttcttctctagcacttggggcctgtcttctgggaagggtggactttgcctctggytgtcttagccctgcctgaatgtctagatctgctggaggaattgcaacatgctcaacttcagtagtttagtagaaagggcttctctatccctggctcagat

SEQ ID NO: 9469 - DNA, 201 bp, Homo sapiens
tctagtgaaataataatttaaaaaaaattgcttcttgagaagaggagggggcagaaattaaagggattctagattttgagagacagctacgtctttgcttstctggtagttccctattattaattattggggttttgacggcgttctggcctccgtttttgttgatttcattttagtgctgcgtttctcctgactatgttg

SEQ ID NO: 9470 - DNA, 201 bp, Homo sapiens
agccaggctttctgcccagcagcaggaaggctggggtgtccatgtttgttgcatgtcccagggtatgtgcatgtggagtctgacatgtgagcaagcgtgcrgcccctgtcactcctttttccactcaaggattaagattgtattgcatttgggattttaactttgtcttctttctttttttccttacccttccccactcct

SEQ ID NO: 9471 - DNA, 201 bp, Homo sapiens
aggctttctgcccagcagcaggaaggctggggtgtccatgtttgttgcatgtcccagggtatgtgcatgtggagtctgacatgtgagcaagcgtgcggccyctgtcactcctttttccactcaaggattaagattgtattgcatttgggattttaactttgtcttctttctttttttccttacccttccccactcctcttc

SEQ ID NO: 9472 - DNA, 201 bp, Homo sapiens; identical to SEQ ID NO: 1316

SEQ ID NO: 9473 - DNA, 201 bp, Homo sapiens; identical to SEQ ID NO: 1318

SEQ ID NO: 9474 - DNA, 201 bp, Homo sapiens
ccaccccacctgtgactgttctaccactggctatggtggcaagctctgctcagaaggtaagaccctctccctctcttgctagagacccacccacgggatgrctgaggctggggctcctgatacaaaccagttctatatggatgcatatctttagctgcatgttagatcactgggccccttgccctaaggaggcagtggaaa

SEQ ID NO: 9475 - DNA, 201 bp, Homo sapiens; identical to SEQ ID NO: 1326

SEQ ID NO: 9476 - DNA, 201 bp, Homo sapiens
tcacttttcagtggtgatttttctcatgactgtcaccaaattccagaacactgagtgaagtacacattcatgatttttttgtatgagaagataagtcatcyctttaggacttgatccagtatagggagcttctggagactttaccaactatgcactggacactttttgtcaacctttgactgatacagcctgactggctca

SEQ ID NO: 9477 - DNA, 201 bp, Homo sapiens
atcttctccattcttctttggcagaggcatccatcctgagctatgatggtagcatgtacatgaagatcatcatgcccatggtcatgcatactgaggcagargatgtgtccttccgcttcatgtcccagcgagcttatgggctgctggtggctacgacctccagggactctgccgacaccctgcgtctggagctggatgggg

SEQ ID NO: 9478 - DNA, 201 bp, Homo sapiens
tagtggtgatggcaatgacttcattgcagtcgagcttgtcaaggggtaagtagaagggatcacgacttatgttggacacctttaatctactgaagctctaygtaaaatatggacataaaaataacttgtctattctactccctaccctccattcctgacacattctcgcatcttccttgattaaatggatccataaaatta

SEQ ID NO: 9479 - DNA, 201 bp, Homo sapiens
ccaatattaaaatcaatggaagtgttcggctggttggagaagtcccatcaattttgggaacaacacagacgacctccatgccaccagaaatgtctactacygtcatggaaaccactactacaatggcgactaccacaacccgtaagaatcgctctacagccagcattcaggtaggcctttttccaagtattaattgcgtct

SEQ ID NO: 9480 - DNA, 201 bp, Homo sapiens
cttacattgttctctcctggccagccaatggctgggctcagcactcacctgttaggtttctttcatttggttaagcaactggcagactcacctgagatctrtcttcccaccccaggtactatatcagtgaacagcaggcgcacgccattcaccgccagtggggagagcgagatcctggacctggaaggagacatgtacctg

SEQ ID NO: 9481 - DNA, 201 bp, Homo sapiens
tttgggcttgtcttccctttcttttctgattttcattggtttgattgaattctttgtttgtttcttgaaagttagctgctcacctcttgtttaacagaccyaggataaaacccaacagcagcgatcaccttctccttgtttctgcatgaggttttgatgtcaatttctggtttctgacagtggtgatttctttactagatt

SEQ ID NO: 9482 - DNA, 201 bp, Homo sapiens
ccaggacttggtgacttcctccagcttcacatagtgagtacagggccttggcctggattttcttatgttactggtggtctgagttagtgattcaggtagaygcagcagaacattctagatcaatatggcaaaggtgcacatgcttataaaaattgttttcagatgtgaaccatcatatttacagggttcctgggggaaaaa

SEQ ID NO: 9483 - DNA, 201 bp, Homo sapiens
aaaacaatacatacatatatgtgattatacatgtgttttatatatagattatagtgtgttaatgtgtgtatatttttatatctatatatgtataagtatayatatataaatattatatcaatgaaagcatcaaatcccatggaaagagcaataagatcctacaaaaattaagtcagtctcttgatagctaacaaaaaatca

SEQ ID NO: 9484 - DNA, 201 bp, Homo sapiens
ctttcttttttcttttgcaaaaaacaatacatacatatatgtgattatacatgtgttttatatatagattatagtgtgttaatgtgtgtatatttttatayctatatatgtataagtatacatatataaatattatatcaatgaaagcatcaaatcccatggaaagagcaataagatcctacaaaaattaagtcagtctct

SEQ ID NO: 9485 - DNA, 201 bp, Homo sapiens
ctggggctaagaagatggggggctgggtgagggtgaagggctgagtgtggttttgggtgtggtttctgaagtgagggcaggtcctctcttctttccttgcmtttgctctatatgaagaaaagaaggcaagggcacatgaataatgaaataatgaaaaatcaagttgaaatgatgatttattgtttttgggaggtaactctg

SEQ ID NO: 9486 - DNA, 201 bp, Homo sapiens
tatgagctgttttttatttgaattattttttcttttaacaatggagtgggggggacctggggctaagaagatggggggctgggtgagggtgaagggctgaktgtggttttgggtgtggtttctgaagtgagggcaggtcctctcttctttccttgcatttgctctatatgaagaaaagaaggcaagggcacatgaataatg

SEQ ID NO: 9487 - DNA, 201 bp, Homo sapiens
atgatcttgtttcatctgctgaatgttcaagtgatgatgaagactttgttgaatgtgagccgagtacaggtaggtcaggtcagtcttattttgcttgcttkcttttttcttttgcaaaaaacaatacatacatatatgtgattatacatgtgttttatatatagattatagtgtgttaatgtgtgtatatttttatatcta

SEQ ID NO: 9488 - DNA, 201 bp, Homo sapiens; identical to SEQ ID NO: 1319

SEQ ID NO: 9489 - DNA, 201 bp, Homo sapiens
atgagcactactttcagaattgattctaactttggcacttactaccatccttaggcaaaggaccagagaccttgtatgcagggcagaagctcaatgacaaygagtggcacaccgttcgggtggtgcggagaggaaaaagccttaagttaaccgtggatgatgatgtggctgagggtgagtatgactatggtgaaattcgtc

SEQ ID NO: 9490 - DNA, 201 bp, Homo sapiens
aacgtcagtactgaggttttgttgtctattttttcctccccttcaattgctcaaggaagcctgttatgatgcctggtccattcagaccaggtaaggcaaasaaggaaaacgtatgagaataataatgtttcctccacccaacccactaggccggcagttaaccatcttcaacactcaggcgcaaatagccattggtggaaa

SEQ ID NO: 9491 - DNA, 201 bp, Homo sapiens
cagcatgtaatttgggcaatgcctgattgaggccaagtaaggtatctaccatattgaatatttggttttcttgaactcacccaagaaagctgaatattctktgtggaaacaggttacacccaaaaaatatacttgagggtgctgtgataaatgatggtaacttttctgtttgtacctcatttacaattttcacaggtacaa

SEQ ID NO: 9492 - DNA, 201 bp, Homo sapiens
cagagctgtttctgtttgggaagtcaaggttacattgagtatagtcagtttataagccggtgtagcttctggtagagaagagggtctcactttgctgcagrgcttaattaaatgttattaatgatgtaatgagactgggtcaaagaagaagaatgtgtaagcaaaagccaaagacactgtggaaaaagtgaaactcaataa

SEQ ID NO: 9493 - DNA, 201 bp, Homo sapiens
tttttaatctttatgaaattgatttttgcataaagtactaaacaaaattacttatatttgctttccaaagtataaacttttccagcataagtaattcatcwtatccctcactgattttcaaggattcctgtattacacaagcttttgtatatatgaggttctctactatgttcagttaatctttcactgatgcttgtgtca

SEQ ID NO: 9494 - DNA, 201 bp, Homo sapiens
ggtgggagcaaagaaatgacaggttcaatccaaaatatctttgagttgttcagctaaccgtgggattgggtgaaggatttaggaaggctatgttttggatytgaaataaggggatttcaagactcctgtatttactacagaatattccaaacttttgcagctaccttgaaactatgaatcagccaataggaagaaggggcc

SEQ ID NO: 9495 - DNA, 201 bp, Homo sapiens
gtcaaattgatctagagttgtcagatgggataatttaaccctcaaatgaaggtgatttatcctatgtattgtaatcaaatagtcatctaagtcactccccrtgagctctggtaaatcacttttagtacatattgaaagtgaccgtattgtattttattgcagaattgcgtcttatagtaataactaatgcatgccattggc

SEQ ID NO: 9496 - DNA, 201 bp, Homo sapiens
ttagttgggaagttgggaccacaataagagtgctattgtaacacgtgtctactgataaaatggcaaattcattagcctagacaaggagtactatgatctgrtttcaaaaatgctgtatacttccacagtccagtttatgagggcatgagatatataactgaggtgcccccatgttacttcaattttagtttgactttgaat

SEQ ID NO: 9497 - DNA, 201 bp, Homo sapiens
tgctttcagataattttgatgagtctgattttacgcttttcagtttgtatgtctcatgatttgtccttaatagactgaagaagtcctagcccttataattraccagtgcctggtaggggaagggcagcagaaaaggactggattagaaccatctcaaatgcttctattctgattagtacttagggttggttggagagtaag

SEQ ID NO: 9498 - DNA, 201 bp, Homo sapiens
tttcagataattttgatgagtctgattttacgcttttcagtttgtatgtctcatgatttgtccttaatagactgaagaagtcctagcccttataattgacsagtgcctggtaggggaagggcagcagaaaaggactggattagaaccatctcaaatgcttctattctgattagtacttagggttggttggagagtaagaat

SEQ ID NO: 9499 - DNA, 201 bp, Homo sapiens
tacgcttttcagtttgtatgtctcatgatttgtccttaatagactgaagaagtcctagcccttataattgaccagtgcctggtaggggaagggcagcagaraaggactggattagaaccatctcaaatgcttctattctgattagtacttagggttggttggagagtaagaatagggactcagcctagttgaaggaaagcc

SEQ ID NO: 9500 - DNA, 201 bp, Homo sapiens
ggaaagcctgtatagtggtgagtctgagtgacaaaccagggagaagtaataagacaatttatttctatttttttatcctacacctgaaatgtaaacaaggrcacattaaatttttactggttagcattttttaagtaattatgtgctcaactatgtccttatatttgcattcttaccaatgtagactctgttatggaagta

SEQ ID NO: 9501 - DNA, 201 bp, Homo sapiens
cttagataggacagctaatctcttgcttctagagaaaggtatgaaaatatactgtgcttattatggggatgatggtatgctctctgaattgaaccttaccytttaacatgaaatttctaattgaaacaaagctgtgatgcctccagctttgttcttttggcttaggattgacttggcgatgcaggctcttttttggttcca

SEQ ID NO: 9502 - DNA, 201 bp, Homo sapiens
tgttgaattttgtcaaaggccttttctgcatctattgagataatcatgtggtttttgtctttggttctgtttatatgctggattacattgattgatttgcrtatattgaaccagccttgcatcccagggatgaagcccactcgatcatggtggataagctttttgatgcgctgctggattcggtttgccagtattttattg

SEQ ID NO: 9503 - DNA, 201 bp, Homo sapiens
atctgttttatctcatatatttatgtaatgttttattacttataaagtaccatcatgttcatcatattatatcatccttacaacagccctatgaagtacgwaatgctgatatcctgtccttatagtgtattatcaagaagtggcttcagaaaaatcaagtaatttgcccaaggtcagtcaggtctgacaccaaagccaatg

SEQ ID NO: 9504 - DNA, 201 bp, Homo sapiens
taccaatagtttcaatcttctaaacttctcccattcctctttactttctcaactgcatccacttaaatacatcttattgtttcagtcagccttggctgctrtaacagaatggcatagattgggtgacttaaaaacaacaaatatttattgctccccattctggagactaggaagtccaaggtcaaggtgccagtcaatttg

SEQ ID NO: 9505 - DNA, 201 bp, Homo sapiens
tatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacg

SEQ ID NO: 9506 - DNA, 201 bp, Homo sapiens
gatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatc

SEQ ID NO: 9507 - DNA, 201 bp, Homo sapiens
tctggacttttctcacattcttctttttcttttcctccttctggttttcctccttctcttccttttacttcttcttgaataaaaaaataatagaagataasaaaggatcgtgaactagtactgtgactcagtcttgtagaatgtcagaattactactgatatggtttggctgtgttcccacgcaaatctcatcttgaatta

SEQ ID NO: 9508 - DNA, 201 bp, Homo sapiens
accaagggaatggtactaaaacgttcatgagaaattgtccccatgatccaatcacctcccaccaggccccatctccaacactggagattacaactgaacakgagatttgggtggggacacatccacaccatatcaccgtcttcactgccatagtgttactcttatctaattcattgcaatttcccttctgacaagtctttg

SEQ ID NO: 9509 - DNA, 201 bp, Homo sapiens
tgcctatttgtaggccaagactttgaatggcttgaaggctgttgtatctccacacctaactcagcattaattttctttaaaagcctatcagaagtatctgygctgttgggttgttccctaactgctagagtcccgctatatctgtttaagaattgtaagagcatctggaaacagcatgcaagacccccaaggtattgaggc

SEQ ID NO: 9510 - DNA, 201 bp, Homo sapiens
ttaaaagctgttcataggctcatagaaaaaaatcaatctctctctccatatgtgttatcattggccttgctagtgttgctgaagggtttgttgtgtttctrttaggaatttcaaagatttctaaattgatgttaaccacttgccttgagccaatatagaatctacaagtttgctgccagcaatgagcaggctctttaatgg

SEQ ID NO: 9511 - DNA, 201 bp, Homo sapiens
ggaggtagaactgaaaagcaacttctttctttgaacctgaaaatagaaaagctaagaaacaggagagggaaataaaagaagaatcagcccagagctatcayccaggcactgacaaatgttccttataaagtctctgattgttgtccctatacaatgcggtggtaggaacaagggagggggggtgaaaggtgacttgagtat

SEQ ID NO: 9512 - DNA, 201 bp, Homo sapiens
ccccatcagcgatctatatttttttaaattgttattagaaacatctcttatttaatctccatcatcacccaacaagctcagcaatgtgactttgtcttacrgatgaggaaactgggtgcagagtatttgtggctttccccaaaacctgcagtaagtgaacaactagaattatatccaagccttctgattcaaatgcagttg

SEQ ID NO: 9513 - DNA, 201 bp, Homo sapiens
aaatctctgcctggagtagtctagttagtaaggtttttcaacctattgacatttggggctggacacatctttgctgttggtgtgtaaggaagggggcgggktactgttttgcacattgcaggatgtttagcagcatccatgacttttaccccctggatgccactctcatgtttccacaagtgccaaataccctctggtcag

SEQ ID NO: 9514 - DNA, 201 bp, Homo sapiens
caggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtct

SEQ ID NO: 9515 - DNA, 201 bp, Homo sapiens
cttcaatttaaattttgcacaaggttgcagagtctctctagttatttaaagtctaaaaagaacactgagcttctttgagaaaggtggtacataaatatccwataataataatatatattcacatacagtatgtcatttatacttctataaagcagagaaggtaatgaaaggtgctctatactgtaaatcactcaatcgatt

SEQ ID NO: 9516 - DNA, 201 bp, Homo sapiens
tgatcatgggctagcaaaaaatttatattgcactttcaaacagcagaaacactgtaaaaacctttttactaactgctgttgcctttaatgtaatagaagtrttcccctatcctcatcaccggggtagctctgagtggagccatttctttatgcacttattcattcaccttcattcactattcaacaaacatttgttccaca

SEQ ID NO: 9517 - DNA, 201 bp, Homo sapiens
ctttattttttgaattgtcttatctgtttggaataaagagagcaagagtatctctaagtggatgggttaaatccctagagagacagagaatagtactaccrtgtagggtgacatagacctactggtgaggttaattcaggataaagaaataaagagatacaatatgtaagaaggacaggcactccatttacgtatagttaa

SEQ ID NO: 9518 - DNA, 201 bp, Homo sapiens
ggcactggatctctagaatcggtaaaaataaaggcaatatattgttctcagggagcaattgagctctcctagaggaggcaaaccaagtgaaatctaatagytttgcttcattctgtgactttcccccgctatgacctcagaattttgagctacaagtaggtctataaagggaattttggaatactcttaatagatctgttc

SEQ ID NO: 9519 - DNA, 201 bp, Homo sapiens
aaagtgtgcctcattgagctttgggctaggccagagctagaagatctttcctgtgtttgggtcattcctagatcagtgatccctaatgaccagttccattycctaaagctaatgttgactctagatctttctgacatttgattcatgctggaatccatagtttgttttgagtcaggtctataatagattcatattcctgag

SEQ ID NO: 9520 - DNA, 201 bp, Homo sapiens
ttcgctcagaaataattaacaggagccagtcagaatagaaaactagtctgggaaaagtgtcctaaattttacactgtataataggatggatctcttaaackcgggactgatatataaaacttctccagtgtttcatttgaccaaaaattggcacacatttagctagatttaaaaaagaatatggtgatggctgagaactaa

SEQ ID NO: 9521 - DNA, 201 bp, Homo sapiens
gggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaag

SEQ ID NO: 9522 - DNA, 201 bp, Homo sapiens
ttttcagaattaaatgtatgtgagctaggtaatggtaagtgtattatctgttgccttcctttttccttttccttgagcagaagtatccagacagctctttrcatggctccacagtaacaatttggagttatatatgctgacagtgtcataagggcaattttatcgttttcaaaaggcttctaaaaacctggttagcatagt

SEQ ID NO: 9523 - DNA, 201 bp, Homo sapiens
tagatgaggaggattcataaagttctgatctctgggagatacttcagaagtgagtggggaaaaaaaggtagggaagactggatttcatattcaccaggccyattattcacttttttatctatatgtgaaatcatacatagaacattttccaaatgataccactgttctgtcctcttttgctaaatttaataacattgtcaa

SEQ ID NO: 9524 - DNA, 201 bp, Homo sapiens
tgagaaaagaacacaaaccaggttggtccgaggctacctagagaactttcttccaataggtgaatgagcaggtatgttacaggttcctcatttgatcctcycaccctatttgagttattctgaccacttgtacatcaactattgattaaaatctgaaaaaagaaaatcataggtgaccttaaattaaacttaaattaaact

SEQ ID NO: 9525 - DNA, 201 bp, Homo sapiens
aaatttacctaaactgccattgctatagattaggtgtatgacacaccgcccccctttcaccgtttcacccctgaacatctgcttcttagagctaagtgatygtactcaacaaatagtgtggagaccagagcttggcgcctttgcagcctccattttacacttggccccctggcactccactctttatgcactcttaacctg

SEQ ID NO: 9526 - DNA, 201 bp, Homo sapiens
tctattctcattcgtttgtcgccaccggacttcgggtaccctacgggtggtgctgaggctggtccccaacattggtctaatggctgagtatattgtgtgarcaccatttattcatgtctgaaaccctataatttgactagccccatatttacccatttttagtgataatttgaaaaaacattgatgattgagagaaggaac

SEQ ID NO: 9527 - DNA, 201 bp, Homo sapiens
gctcatgactggagaagttcttaaaaccatgactctaggcagaccttcatttctagctgtagaattttggccagggtcctttgtggagctatgtttttttwttatctgaaatatggggatgatttccaacttcaagggtaggttaagataatataagtcaagggcttaaatgggtgcggctcaaagattattattgctgct

SEQ ID NO: 9528 - DNA, 201 bp, Homo sapiens
acagggacagttaaatgtaggaaacaatgaattagaagaagtaaaagaaaggagaagaagtaaaagaaaggaaaaattgagaaggagagaaagacagcagmgatgctctgtaattattgctataagaattacgtgcccatttcatggatttgtatggcttaggttgagagagatgaataaaatatctttgatataattaaa

SEQ ID NO: 9529 - DNA, 201 bp, Homo sapiens
gctgaaagctgttgggtgagacatcacaatgaccacttctatgtaaaaggtagattatagatggccctctgcatatgtgggattgcatctgcattcaacchactgtgaatcaaaaatatttttaaaaaattgtgtctgtactgaacatgtacagacttttttcttactattattccctaaacaatacagtataacaactat

SEQ ID NO: 9530 - DNA, 201 bp, Homo sapiens
tttcttttttttcttttcttttcttgagacggtgtctcactccgtcacccaggctggagggcagtggcgtgatcggggctcactgcaacctctgcctcccrggttcacgccattctcctgcctcagcctcctgagtagctgggactacaggtgcccaccaccgcacctggccaattttttgtatttttagtagagatgggg

SEQ ID NO: 9531 - DNA, 201 bp, Homo sapiens
ggactacaggtgcccaccaccgcacctggccaattttttgtatttttagtagagatggggtttcaccgtgttagccaggatggtctcgatctcctgacctygtgatccacccacctcagcctcccaaagagctgggattacaggcgtgagccaccgtgcccagcctcttaaatcctgttgtgtcctaaagagtccactaaa

SEQ ID NO: 9532 - DNA, 201 bp, Homo sapiens
atggggtttcaccgtgttagccaggatggtctcgatctcctgaccttgtgatccacccacctcagcctcccaaagagctgggattacaggcgtgagccacygtgcccagcctcttaaatcctgttgtgtcctaaagagtccactaaacgaggttgagggtatgatttgacaattgaacaaggcctcagccagctctcctag

SEQ ID NO: 9533 - DNA, 201 bp, Homo sapiens
acaattgaacaaggcctcagccagctctcctagactgccccaaaactccctgagcagagagacccaggtggtgatggaagtatttttcctctaaaagactrtggagattctggcaaacctatattttgggtttagctttcaaggaagaggtggcatttgaaaagccaggggcctttgtagccattttattcactacctaat

SEQ ID NO: 9534 - DNA, 201 bp, Homo sapiens
tagtgttgtcatctggggaagctttcttgtagaagcagtatagaagctgtcctgtgcaggatgagatattagattgcaaaagaggacaagggccagtgttsccgccaaaggaaatagcctatgctgaggccctgctgtagggatcatactgtatcgcgttcctctggctttggactacgcattgatgctaaagtctggaag

SEQ ID NO: 9535 - DNA, 200 bp, Homo sapiens
accagatggagaaaatggcataggacatgtgtattagacctgccactttctggctctgtgagcatgcatttcaaagtttatacctgcaaagtgggcatttacagagtaggggacagtcggagagcttatcgatacatacttattgctctccttgtgttctgtttgctggaacacaattttagatcaaatatttaaaaatt

SEQ ID NO: 9536 - DNA, 201 bp, Homo sapiens
tctgtgaagtctgggggaagaacatttacagcagagggaacggttagtgtaaaggcctttaggctggaacatgttgagcagtgtttgaaagatgatgaatrtggctgtagcagaagaaatctggtgtgaggtaagatctgagaagtggcagggactgaaacagacagggcctgtttggctgtggaaagcagtttaggtttt

SEQ ID NO: 9537 - DNA, 201 bp, Homo sapiens
tgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagc

SEQ ID NO: 9538 - DNA, 201 bp, Homo sapiens
ctttccttggagttttgagattaagaaatgcacttcgttgtcccgaataagcatagtcttgagtgggctttagtcagagttatttgtgtgcatttatgtcratactacccactccattctatcatattgggaaaataatgcaatctcgaaggaataggagtctaggaaacctaggatataagtgagcacataccggagaaa

SEQ ID NO: 9539 - DNA, 201 bp, Homo sapiens
ttagtcagagttatttgtgtgcatttatgtcgatactacccactccattctatcatattgggaaaataatgcaatctcgaaggaataggagtctaggaaamctaggatataagtgagcacataccggagaaaaatatgccaacatagtagcttggaggaaatacttggaaatatcttgcctttatagctagatatagaact

SEQ ID NO: 9540 - DNA, 201 bp, Homo sapiens
ggaaaaattccagatgagttaaaatgtgtttcctcatttcaaggactgtaatgtttgttgttagtgtgagcacagggcttaaggtttctttatgaagaccrctgggtggttcctcacagctgtggttgagatttagcggggaaaccggacgtttatgggagacgttcagtctgtactggattttagtcagcactgccctgc

SEQ ID NO: 9541 - DNA, 201 bp, Homo sapiens
tctccctgattgcttcctctcatgaggagaaggtcattggcgctcaccacttccagggcaaccctttatgcaagcagtgggtgcctttgaaaggcaaaccrcagcaggaagactttgaaggcaagaagagactttttcatctttgcaggccccagccagaacattggttctcagtgcagtacaagcagtttcaaagttatc

SEQ ID NO: 9542 - DNA, 201 bp, Homo sapiens
gattcctgtgctacagtagatcataatcccttgagggtcacagcttatttcaaaatccttgtcaccttgacaaaatgctcaagaccaccatggtgacatgkgtgccaccatcattattattatctaaagagttttaccaagtgtctgtatcattaatatttattgtaaaggctcaacttttataagaaagaatccttgtct

SEQ ID NO: 9543 - DNA, 201 bp, Homo sapiens
gtgtctgtatcattaatatttattgtaaaggctcaacttttataagaaagaatccttgtctcccacaccaccagtgcaaagtagattaacaaagttggcayttatttattttattttttctttaggggaaaatcaagaagttagtgatctagggctaatggggatattgtgttactcccaatatgtggttcccatatttgg

SEQ ID NO: 9544 - DNA, 201 bp, Homo sapiens
gttctcaggatcccactgtatgtctgataaactaagtcaagctaaggtcattattaccaataagtaatcaataaactcaatgtttaccctaagtttgatayggtaacttagttattttaagaggaaattttaagttcttgtgtgtgtgagtaagaaggagcatgagaatagggaaagggccgtttcacagaagcggtccta

SEQ ID NO: 9545 - DNA, 201 bp, Homo sapiens
tcccactgtatgtctgataaactaagtcaagctaaggtcattattaccaataagtaatcaataaactcaatgtttaccctaagtttgatacggtaacttakttattttaagaggaaattttaagttcttgtgtgtgtgagtaagaaggagcatgagaatagggaaagggccgtttcacagaagcggtcctatctggttggc

SEQ ID NO: 9546 - DNA, 201 bp, Homo sapiens
ctcaattaaaaaaagaaagcctgaggaaattaaatgatttctaaaatcacccagctaattagtggcagaaatgagaccagattccagtctcttgctttccygaataccttattctggaattcaattataagtacaaggcatcccactcttggcttcctttctgaataaatgcttgcaccaaatccccagtggcttcttgag

SEQ ID NO: 9547 - DNA, 201 bp, Homo sapiens
cagcaaaaaataaagctattttaaaatattttggaagcaagtcatggttgaagagaagcatcccttgaaaaattagacttaaagctgcaaacttcccgggrttgacattagcttgaacttgatgaaaaaggaaaaattttaggaggatttgttcagctgtcttctgagttatgaaagcaggaagaaatgagttttacatat

SEQ ID NO: 9548 - DNA, 201 bp, Homo sapiens
cccatcagaccaggatttcagttactaggtatcctaccttgttccattgatctgagaccctcattaataccctagctgacagtcttaactcagcactgtcytctattttctaccaaatagaatacaataatcagatacattttactctctcttctgaataaagatattaacaaaatttccatgagtacttataagggtgag

SEQ ID NO: 9549 - DNA, 201 bp, Homo sapiens
acttataagggtgagtttccagaccaacctagatgagttaccaggatatatagtttgaaatattaactttaaacatttcttgatttttctgaccccatcargtattttttggaaactggtattaggcttgtagaaatggacaaggagctctaccatgcttgaagatggtttaagccttcagcaaaataattgagagcttcc

SEQ ID NO: 9550 - DNA, 201 bp, Homo sapiens
aatattccgaatacacaggtctatcagttagtgtatcatgttatgtgtagatgtgtgttggggtgatcagatccaacaccaggtcgtgggggtgacaaagkccggcaattcaaaggaatgagaaaaagacagtttgagagagaaagtgggaccagggggccatcgcgagtgtggaggctgtgaaggccccaagttctggga

SEQ ID NO: 9551 - DNA, 201 bp, Homo sapiens
aatgagaaaaagacagtttgagagagaaagtgggaccagggggccatcgcgagtgtggaggctgtgaaggccccaagttctgggagcccatgttatttatkggtgctcaaacaggtggtgaggatgtcgagtgaatgagaaacatatggctgtttgacataatgggagtactagaagcaagaagccagcaagtctagcaga

SEQ ID NO: 9552 - DNA, 201 bp, Homo sapiens
ccttgagatgaggaaataatcctggattatctgagtgggccctaaatatcctcaaaagtgtccttataagagtgaggcagagggggcatttcccccgccamacacacacacacacacacacacacacacacacacacacagaggagaaggtgatggaggcagatactggagtgaagcagccacaagccaaggaatgctgac

SEQ ID NO: 9553 - DNA, 201 bp, Homo sapiens
tcttaagctcttttctttacaaattctgaaactatcattgcctgtgggttgggttgaaatgaaggcacgtgggtgtttcaagggtatgttctgtgacaaaragacagaatagaaaaatccaaagtcatagcctggagctaatacagtaatatgaatacataaaacaggaaggacaagaatataaaagtgaatttggggacc

SEQ ID NO: 9554 - DNA, 201 bp, Homo sapiens
ggtggctcacgcctgtaatctcagcattttgggaggctgaggcaggtggatcacctgaggtcaggagtttgagaccagcctggccaacatggtgaaacccrtctctactaaaagtacaaaaattagccaggcatggtggtgggcatctgtaacgccagctactcgggaggctgaggcaggagaatcactggaacccaggag

SEQ ID NO: 9555 - DNA, 201 bp, Homo sapiens
gagtttgagaccagcctggccaacatggtgaaacccgtctctactaaaagtacaaaaattagccaggcatggtggtgggcatctgtaacgccagctactcrggaggctgaggcaggagaatcactggaacccaggaggcggaggttgcagtgagctgagatcatgccactgcactgcactgcagcctgggtgacagaacga

SEQ ID NO: 9556 - DNA, 201 bp, Homo sapiens
caggagaatcactggaacccaggaggcggaggttgcagtgagctgagatcatgccactgcactgcactgcagcctgggtgacagaacgagactctgcctcaaaaaaaaaaaaaaaaaaaaaaaaaaaaaagaacccaggcctccaatggtgcgatcaggtgccaggtactcttgtctactgtgctgaccatatgctgttga

SEQ ID NO: 9557 - DNA, 201 bp, Homo sapiens
tatctccttacctttactcatattgtggtttaactatgtggttgtcttctccaccctgacaatagatacatctattgtccatcagcccaatttacaacttwtgcatctcttctgatttctatcctctgctaatgacacttattaactactgcctttccactggactttgcatttagttttatatatatatatatataacct

SEQ ID NO: 9558 - DNA, 201 bp, Homo sapiens
gcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgtta

SEQ ID NO: 9559 - DNA, 201 bp, Homo sapiens
cattctttatgctaatcctaatgcatagattggtaaattgagattaatgagattcttcctttactaccacctgtttttaaccaaatgcctacatgctgcakgagcaggaaatgaggtgactactgttgttggccacagagcttcaatatgtcgtgaacaagggttagatgtgaatgtcagaaaaaatgttatgatcaattt

SEQ ID NO: 9560 - DNA, 201 bp, Homo sapiens
tgactactgttgttggccacagagcttcaatatgtcgtgaacaagggttagatgtgaatgtcagaaaaaatgttatgatcaatttctgcctccaacaaggractacaaatatgggtcacaaaagttctactagtagccccaaatacattttttgaaaggagacaatataaataaagctgaaaagcagtcacaacgctttaa

SEQ ID NO: 9561 - DNA, 201 bp, Homo sapiens
ggaactacaaatatgggtcacaaaagttctactagtagccccaaatacattttttgaaaggagacaatataaataaagctgaaaagcagtcacaacgcttyaatgtgtcattctcttcttcacctttctatccacttagatgtttcctaccccccaaaaatgaacttatgtcacatcacacttgtgactcccactgacatc

SEQ ID NO: 9562 - DNA, 201 bp, Homo sapiens
ttttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaa

SEQ ID NO: 9563 - DNA, 201 bp, Homo sapiens
ttttgtatgaaatctcatctacccataacaagtcttggaagctgctcttgtcatcctcatcacagacctgcagaaatggaggttaggtaagagtggggctkgaaatggagctaggtccaatctcaaaatacatactttttcaatcatactaactcatcatgttagtagtaagttaaagaatcttgaatcatatggtccact

SEQ ID NO: 9564 - DNA, 201 bp, Homo sapiens
ggagggagagcatcaggataaacagctaatgcatgtggggcttaatacctaggtgatgggttgatagctgcaacaaatcaccatggcacttgtttacctaygtaacaaaccttcacgtcctgcacatgtagcctggaacttaaaattaaattaagtcaaaaaaagctaaaagcaagctttatgccaaaaaaaattttaaaa

SEQ ID NO: 9565 - DNA, 201 bp, Homo sapiens
tgtctacttacgacgtacatccagactgcacgccctttttattttttcaaagcaaagccaaaaaataaagaaaacgtaaaattagtttttaaagaaaatgmacaatctgtttttaattttggctatcacgaaaaggggaattaaccagccaaaaaagcaaagcaaaaaaaacgtgtcccctgactgctctgtctgtgcctt

SEQ ID NO: 9566 - DNA, 201 bp, Homo sapiens
ttttttcaatttaataaattttttttcttaaaaggtaaaattgccaatgagttaaatgttgatgctctgatgttagcaagactgagttcatatgtccatcrcttattaactccattttcttatcaatatgtttggcttctgtaagtcttattttcttgtttgtgaaaggaagatctaataatagaactggccttatagaat

SEQ ID NO: 9567 - DNA, 201 bp, Homo sapiens
ttgttgaaaaatataatctgtagcctttccaaatcaaacctatttcagacaaaccctttgctggggtggaagggtggtggggaagcgagggagaatgcccyacctagaaattctcatcctgttaaaatacaagttaagcctctttgagacacttgagtttttctactgtcttctccccaggtacttgccctgtttgtccat

SEQ ID NO: 9568 - DNA, 201 bp, Homo sapiens
tggaagggtggtggggaagcgagggagaatgccctacctagaaattctcatcctgttaaaatacaagttaagcctctttgagacacttgagtttttctackgtcttctccccaggtacttgccctgtttgtccatgactattttttcccgaaggttgatagagagcaatttcatggttacaagctttatgatatttatgtg

SEQ ID NO: 9569 - DNA, 201 bp, Homo sapiens
gggatagcataggaaattaggattttgatggattacaggttttgtattactctgctcataaccctttatgactttgggttatttgcttccatgaatacttytgtaggcatgggacacatagttgatcactgacttcatgatctctgggaagtgaagaaaatattatcagctacttgaacatttctcagggtagtcactttt

SEQ ID NO: 9570 - DNA, 201 bp, Homo sapiens
aaatattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgcca

SEQ ID NO: 9571 - DNA, 201 bp, Homo sapiens
aatattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgccat

SEQ ID NO: 9572 - DNA, 201 bp, Homo sapiens
tattatcagctacttgaacatttctcagggtagtcacttttgattaaaataaacaagaagctttgaatagcttcccaccaaactacttttttgtttgtttgcttgctttttgagacagagtctcgctctgtcgcccaggctggagtgcagtggcgtgatctcggctcactgcaagctctgcctcccaggttcacgccattc

SEQ ID NO: 9573 - DNA, 201 bp, Homo sapiens
gcctcccaggttcacgccattctcctgcctcagcctccccagtagctgggactacaggtgccagccactatgcctggctaatttttttgtatttttagtascgatggggtttcaccgtgttagccaggatggtttcgatctcctgacctcatgatccgcctgcctcggcctcccaaagtgctgggattacaggcgtgagcc

SEQ ID NO: 9574 - DNA, 201 bp, Homo sapiens
cctcccaggttcacgccattctcctgcctcagcctccccagtagctgggactacaggtgccagccactatgcctggctaatttttttgtatttttagtagvgatggggtttcaccgtgttagccaggatggtttcgatctcctgacctcatgatccgcctgcctcggcctcccaaagtgctgggattacaggcgtgagcca

SEQ ID NO: 9575 - DNA, 201 bp, Homo sapiens
agtaaagtaattcaactgcagagtgaacagtttgtagattttgaaacaacaagtacactgtggaaactttagctggtattgaaaggagaaaaaacaaaccraaaaaacaaaaaggcaaatttaagactccggttgggtgtcacagatggtacactaaaattgcaaatgaatgccactctgtaatcatgaagatggtgatct

SEQ ID NO: 9576 - DNA, 201 bp, Homo sapiens
tgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaa

SEQ ID NO: 9577 - DNA, 201 bp, Homo sapiens
attaggtatttttcctaatgctatccctcccctagcctcccaccccctgacaggccctggtatgtgatgttcccccctccctgtgtccatgcgttctcatkgttcaactcccacttatgagtgagaacatacggtgtttggttttctgttcctgtgttagtttgctgaaaatgatggtttccagcttcatccatgtccctg

SEQ ID NO: 9578 - DNA, 201 bp, Homo sapiens; identical to SEQ ID NO: 1321

SEQ ID NO: 9579 - DNA, 201 bp, Homo sapiens; identical to SEQ ID NO: 1322

SEQ ID NO: 9580 - DNA, 201 bp, Homo sapiens; identical to SEQ ID NO: 1323

SEQ ID NO: 9581 - DNA, 201 bp, Homo sapiens
tatgaggtctctgccatcatgacctaatcacttccccaaaactccacctcctgataccattacactggtgattagctttcaatatataaatttgggtggcrgggtggggcacacacattcagatcatagcaatggcagctaggaggaagtaaattttgaatcctcatttccatgtaaagacttcatttgctttaaacaatt

SEQ ID NO: 9582 - DNA, 201 bp, Homo sapiens
tggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgca

SEQ ID NO: 9583 - DNA, 201 bp, Homo sapiens
ggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcag

SEQ ID NO: 9584 - DNA, 201 bp, Homo sapiens
gcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagc

SEQ ID NO: 9585 - DNA, 201 bp, Homo sapiens
atctgccctcattttcaaccttatttctttagtaccaattgcagccatgttataatctttgttttcatccaggtaaagctgagggaagggaaggagaatcyactgagaaaaagattttccccaaagagtgactcagcctttgaaaagaaaatcagctatatgaaaagggaagagtatttaatcattcggagcaataattgc

SEQ ID NO: 9586 - DNA, 201 bp, Homo sapiens
tgcagggtcattctgtccaggaactcatcttctctggcggtgtgagaccatatgtttaacatgaccagtaaggaagtagaaggaatcttccactacttttyacattcttttttctttcaaaaagttttgtaaacttcaagtatgtaaaaaaacagttcttatatgttcatacagtttgctttcaacaataactccacacat

SEQ ID NO: 9587 - DNA, 201 bp, Homo sapiens
catgtaaagatgtttccagtataaagtagaaaaaaatgggttttaaacatcatatataaaattaatcaattttttaacatatagcatacctgtattcaggwacatgttctttggttattctcatttaaacagtcccctattgttgaatacttgatctgtttctattgtttcattttatatataatatatcctataccaaat

SEQ ID NO: 9588 - DNA, 201 bp, Homo sapiens
gaggagccaagatggctgaacaggaacagctctggtctacagctcccagcgggagcaacgcagaagatgggtgatttctgcatttccatctgaggtaccgrgttcatctcactagggagtgcaagacagtgggcgcaggtcactgggtgcatgcaccgtgcgcgagccaaagcagggtgaggaattgcctcactcgggaag

SEQ ID NO: 9589 - DNA, 201 bp, Homo sapiens
aagtggtgacagacggcacctggaaaattgggtcactcccacctgaatactgtgcttttccgacgggcttaaaaaatggcgcaccaggagattatatccckcacctggctcggagggtcctacgcccacggagtctccctgattgctagcacagcagtctgagatcaaactgcaaggcagcagccagactgggggaggggc

SEQ ID NO: 9590 - DNA, 201 bp, Homo sapiens
gagattatatccctcacctggctcggagggtcctacgcccacggagtctccctgattgctagcacagcagtctgagatcaaactgcaaggcagcagccagrctgggggaggggcgcctgccattgcccaggcttgcttaggtaaacaaagcagccaggaagctccaactgggtggagcccaccacagctcaaggaggcctg

SEQ ID NO: 9591 - DNA, 201 bp, Homo sapiens
ggtggagcccaccacagctcaaggaggcctgcctgcctctgtaggctccacctctgggggcagggcacacacaaacaaaaagacagcagtaacctctgcakacttaagtatccctgtctgacagctttgaagagagcagtggttctcccagcacgcagctggagatctgagaacgggcagactgcctcctcaagtgggtcc

SEQ ID NO: 9592 - DNA, 201 bp, Homo sapiens
tgggggcagggcacacacaaacaaaaagacagcagtaacctctgcagacttaagtatccctgtctgacagctttgaagagagcagtggttctcccagcacrcagctggagatctgagaacgggcagactgcctcctcaagtgggtccctgacccctgacccccgagcagcctaactgggaggcaccccccagcaggggcag

SEQ ID NO: 9593 - DNA, 201 bp, Homo sapiens
gctctcctcagcaaatgtaaaagaacagaaattataacaaactatctctcagaccacagtgcaatcaaactagaactcaggattaagaatctcactcaaarccgctcaactacatggaaactgaacaacctgctcctgaatgactactgggtacataacgaaatgaaggcagaaataaagatgttctttgaaaccaacgag

SEQ ID NO: 9594 - DNA, 201 bp, Homo sapiens
accaaagccgggcagagacacaaccaaaaaagagaattttagaccagtatccttgatgaacattgatgcaagaatcctcagtaaaatactggcaaaccgamtccagcagcacatcaaaaagcttatccaccatgatcaagtgggcttcatccctgggatgcaaggctggttcaatatacgcaaatcaatcaatgtaatcca

SEQ ID NO: 9595 - DNA, 201 bp, Homo sapiens
agtaaaatactggcaaaccgactccagcagcacatcaaaaagcttatccaccatgatcaagtgggcttcatccctgggatgcaaggctggttcaatatacrcaaatcaatcaatgtaatccagcatataaacagaaccaaagacaaaaaccacatgattatctcaatagatgcagaaaaggcctttgacaaaattcaacag

SEQ ID NO: 9596 - DNA, 201 bp, Homo sapiens
tactgaatgggcaaaaactggaagcattccctttgaaaactggcacaagacagggatgccctctctcaccactcctattcaacatagtgttggaagttctrgccagggcaattaggcaggagaaggaaataaagggtattcaattaggaaaagaggaagtcaaattgtccctgtttgcagatgacatgattgtatatctag

SEQ ID NO: 9597 - DNA, 201 bp, Homo sapiens
agctgataagcaacttcagcaaagtctcaggatacaaaatcaatgtacaaaaatcacaagcattcttatacaccaacaacagacaaacagagagccaaatsatgagtgaactcccagtcacaattgcttcaaagagaataaaatacctaggaatccaccttacaagggatgtgaaggacctcttcaaggagaactacaaac

SEQ ID NO: 9598 - DNA, 201 bp, Homo sapiens
aagcattcttatacaccaacaacagacaaacagagagccaaatcatgagtgaactcccagtcacaattgcttcaaagagaataaaatacctaggaatccamcttacaagggatgtgaaggacctcttcaaggagaactacaaaccactgctcaagggaataaaagaggatacaaacaaatggaagaacattccatgctcat

SEQ ID NO: 9599 - DNA, 201 bp, Homo sapiens
aactatactacaaggctacagtaagcaaaacagcatggtactggtaccaaaacagagatatagatcaatggaacagaacagagccctcagaaataatgccrcatatctacaactacctgatctttgacaaacctgagaaaaacaagtaatggggaaaggattccctatttaataaatggtgctgggaaaactggctagcca

SEQ ID NO: 9600 - DNA, 201 bp, Homo sapiens
ctaaaaccataaaaaccctggaagaaaacctaggcattaccattcaggacataggcatgggcaaggacttcatgtctaaaacaccaaaagcaatggcaacmaaagccaaaattgacaaatgggatctaattaaactaaagagcttctgcacagcagaagaaactaccatcagagtgaacaggcaacctacaaaatgggaga

SEQ ID NO: 9601 - DNA, 201 bp, Homo sapiens
gcatgggcaaggacttcatgtctaaaacaccaaaagcaatggcaaccaaagccaaaattgacaaatgggatctaattaaactaaagagcttctgcacagcmgaagaaactaccatcagagtgaacaggcaacctacaaaatgggagaaaattttcacaacctacttatctgacaaagggctaatatccagaatctacaatg

SEQ ID NO: 9602 - DNA, 201 bp, Homo sapiens
caggggtcctggaatcaatccccttgatggatacagagggaagactcactctcactctctcttgatatatatatatatatatatatatatatatatatatrtatatatgcacacatacacacacacacacacacatatatatacacacacatacacacacacgtatgtatatttacatgtatttataaactgatattttat

SEQ ID NO: 9603 - DNA, 201 bp, Homo sapiens
aggggtcctggaatcaatccccttgatggatacagagggaagactcactctcactctctcttgatatatatatatatatatatatatatatatatatatayatatatgcacacatacacacacacacacacacatatatatacacacacatacacacacacgtatgtatatttacatgtatttataaactgatattttatt

SEQ ID NO: 9604 - DNA, 201 bp, Homo sapiens
gggtcctggaatcaatccccttgatggatacagagggaagactcactctcactctctcttgatatatatatatatatatatatatatatatatatatatayatatgcacacatacacacacacacacacacatatatatacacacacatacacacacacgtatgtatatttacatgtatttataaactgatattttattca

SEQ ID NO: 9605 - DNA, 201 bp, Homo sapiens
gtcctggaatcaatccccttgatggatacagagggaagactcactctcactctctcttgatatatatatatatatatatatatatatatatatatatatayatgcacacatacacacacacacacacacatatatatacacacacatacacacacacgtatgtatatttacatgtatttataaactgatattttattcaaa

SEQ ID NO: 9606 - DNA, 201 bp, Homo sapiens
ctggaatcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgt

SEQ ID NO: 9607 - DNA, 201 bp, Homo sapiens
tggaatcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtt

SEQ ID NO: 9608 - DNA, 201 bp, Homo sapiens
tcaatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtttcaac

SEQ ID NO: 9609 - DNA, 201 bp, Homo sapiens
caatccccttgatggatacagagggaagactcactctcactctctcttgatatatatatatatatatatatatatatatatatatatatatatgcacacatacacacacacacacacacatatatatacacacacatacacacacacgtatgtatatttacatgtatttataaactgatattttattcaaatgtttcaact

SEQ ID NO: 9610 - DNA, 201 bp, Homo sapiens
tacagagggaagactcactctcactctctcttgatatatatatatatatatatatatatatatatatatatatatatgcacacatacacacacacacacayacatatatatacacacacatacacacacacgtatgtatatttacatgtatttataaactgatattttattcaaatgtttcaactggcccctaggaagaaa

SEQ ID NO: 9611 - DNA, 201 bp, Homo sapiens
agattctagatattattttctatttatcaactgcattcaggcagtgctaagtagatgactgatgctgaaattttactagataatctttgctctctattttrttatatgacacatggggcaaatacgtgagatgagcaattagtgaaattctggaagggacagatttatgtcatactattgaaagggacaggaagtggatta

SEQ ID NO: 9612 - DNA, 201 bp, Homo sapiens
tgtaatccctgtttgttgtgggagggacctctcgggaggtgattggattatggaacggtttccgcatgctgttcttgtggtagtgggtgagttctcacaaratctgatggtttcataagaggctcttcccccttcgctctgctcttcccttctttaagctgccatgcgaagaaggtctttgctttcccttcatcttctgcc

SEQ ID NO: 9613 - DNA, 201 bp, Homo sapiens
agctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaatta

SEQ ID NO: 9614 - DNA, 201 bp, Homo sapiens
tatcacaaggcaaaaattactttttagactgatgaagagatggatggatggatgtgaattttttttatctatttcttattttgaaggttatttatttattyacaaacactggaaaattcagtgtttttcactgagcaaaatagcttgtctggtccaaagccagtaaaataagaattttgtgggtggggtatctactccatt

SEQ ID NO: 9615 - DNA, 201 bp, Homo sapiens
atagagtgagactctgtctcaaaacaaaaaaacaaaacaaaacaaaacaaaaaaagatgagcagcatggaacatgatgttggcatgaggccctactacccrgcagcagactatcagggaataaactagataaacctggaaaatgttttaacttcagtttattttattcacattaagtaatggagtagcatgttgtttgttt

SEQ ID NO: 9616 - DNA, 201 bp, Homo sapiens
aacttcagtttattttattcacattaagtaatggagtagcatgttgtttgtttgtttgtttgttttacctctaaacctcctgtatagcccccttttaaaakaagggcaggggaagaggcttaaaatatggtagtattgactcccaggcctgttcagtctatacgaattttcaggctgtatagtttaaaaaaaacattgttc

SEQ ID NO: 9617 - DNA, 201 bp, Homo sapiens
tttgttttacctctaaacctcctgtatagcccccttttaaaagaagggcaggggaagaggcttaaaatatggtagtattgactcccaggcctgttcagtcwatacgaattttcaggctgtatagtttaaaaaaaacattgttcaatttcttatacgtttttactagtgatattactttagaaatgggcctcgaaagactca

SEQ ID NO: 9618 - DNA, 201 bp, Homo sapiens
ttttacctctaaacctcctgtatagcccccttttaaaagaagggcaggggaagaggcttaaaatatggtagtattgactcccaggcctgttcagtctataygaattttcaggctgtatagtttaaaaaaaacattgttcaatttcttatacgtttttactagtgatattactttagaaatgggcctcgaaagactcaggtt

SEQ ID NO: 9619 - DNA, 201 bp, Homo sapiens
gcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgc

SEQ ID NO: 9620 - DNA, 201 bp, Homo sapiens
ctgaaggagataggctgcagtttgaaggcaagagcatctgatctccaaagaatcagaaaatctcttcttttgttgcatttgtaggtactttttgttgtgtwgcttttttttttttttttttttttttaatacaggtaaagttcaaacgagcacagcatggtccaaatggtgtttaaagctgtctaagtttcctttatgtaa

SEQ ID NO: 9621 - DNA, 201 bp, Homo sapiens
ttttctgtcttgaaagcaaatgtactcttccagagaaactcctgttctttttttaaagttttatttttaactgacaaattaataattgtatatataggtaygacgtgatgtttcaatgtctatattcattgtggaatgatcaacccaggataattaacatactcatcacctcaaattctttgtagcaagaacatttacaat

SEQ ID NO: 9622 - DNA, 201 bp, Homo sapiens
cctttataaaaccatccgatctcatgaaacttattcactaccacaagaacagcatgggaaaaacccacccccatgattcaattacttcccaccgggttccmtcccatgacacgtggggattatcgcaattcaaggtgagatttgggcaggacacagagccaaaccatatcacccgtcttacccaattctgttgaaataaac

SEQ ID NO: 9623 - DNA, 201 bp, Homo sapiens
aagctttcactcatggtgaatggcaaacagggagcaggcatgtcacatggtgagagagggagagagggagcaagggagacaggaggaggaggcgccaccctttttttattatttaattttttgagagggtggcacgatcatggctcactggagcctcaacctcccatgctcgagcaatcctgctgccttagcttcctgagt

SEQ ID NO: 9624 - DNA, 201 bp, Homo sapiens
ttttttgagagggtggcacgatcatggctcactggagcctcaacctcccatgctcgagcaatcctgctgccttagcttcctgagtggctgggactacgggyctgcaccaccacacctaatgtttaatttttttttaattttttgttgagatgggatttcattattttccccaggctggtctcaaacttctgagttcaagta

SEQ ID NO: 9625 - DNA, 201 bp, Homo sapiens
ccaagtctttttcgttttatcaagaatagaacaagcatttctagagcctctagaggatttccttgtttagctctttgtccagagctaccacatggccactkttagttgcaaaggaggcttggttaggccggtcacattgccagctctcgcaaggaggaagaggggaatggatattgacaatgtctgcaatagtcatcttcc

SEQ ID NO: 9626 - DNA, 201 bp, Homo sapiens
aatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccac

SEQ ID NO: 9627 - DNA, 201 bp, Homo sapiens
atgcaaaataaaactaagggcccccttgcccaaaaatccagaaaaaaaagtgttaaaagtgctagaatagaatttcttttctctttcttcaatagtctatytgttatgttttttatttgctattgaatgacatttaagtaaataaaaatgtaaattagcatgaatattaccattcgtccttatattgtgtgcaatgccagt

SEQ ID NO: 9628 - DNA, 201 bp, Homo sapiens
ctcaaatgcagaatcattgaaataacacaatttgtatgtcatagcccatatatgcatgtgtcttttgttcttattggaagagtggaaatgccatccaaaaktaacttactgctttttgtttcacttcttgatgcacgcacattctaccaacgctttttaacttcagcctaccgatgcatcaggtagaaccaaaaacaagag

SEQ ID NO: 9629 - DNA, 201 bp, Homo sapiens
gctttttaacttcagcctaccgatgcatcaggtagaaccaaaaacaagaggtctcttgccctgtgcaagccaagcctttctgattagcaatcctagagagracaggtggctcacgcctgtaatcccagcactttgggaggatgaggcaggtgaattacgaggtcaggagtttgagaccagcctagccaacatggtgaaacc

SEQ ID NO: 9630 - DNA, 201 bp, Homo sapiens
acagccaagcctttctaattagcaatcctagagaggacagcaccaataagaaagaagagcagccatcaaagccaggcctttatatgtatgtaatcaacagrcatctgatctagattcttaaagatggtgtggtttgggtgggtgattttatttattttatttttctgtctcctaaataatatgtaatttcttcaggccaag

SEQ ID NO: 9631 - DNA, 201 bp, Homo sapiens
aaaatcattggcaagacatagtggctcatgcctgtagtcccagcactttgggagcccaaggtgggtgactcgcttcagcccaggggttagagaccagcctyggcaacatggcaaaaccctgtctctacaaaaaaataaaaataaataaattattcaggtgtggtggcgtgtacctatagtcctagatacctaggaggctga

SEQ ID NO: 9632 - DNA, 201 bp, Homo sapiens
gaataacttatagagaatattggtatttgacataggggaaccatcatacgtcagcactttaagcatagccattgaaagttatgagagctttagacaatcaytgtgaggggaaaaaatgtgaagatgacattgaacgcaacttgataaacattcccaacgtaactatgaatagaagagtttcctaaagcaacactgtttcct

SEQ ID NO: 9633 - DNA, 201 bp, Homo sapiens
catgagtctagatagtctagatatccatttctttgcaggcatactaactgctctttcttctaagtaattaaaagtaattacagacaatggttgtgattatrggaaaatacacagacatgcagcctaaggctaccacattttattaaaaggcagagatccaccaatttgttctacttatagcaattctattctgagtctgag

SEQ ID NO: 9634 - DNA, 201 bp, Homo sapiens
gattttcattaactcaccagctttcactcaatactagggaccaaagtcctaccgggccattctgcaaggcccttacagtcaaatcattaataatttccagytgaacacacttcagcagtgtattctcagcctctttattaccaccatcctaaggagttttttcagataagttttccccctaattgcccttttcccacaaca

SEQ ID NO: 9635 - DNA, 201 bp, Homo sapiens
taactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtat

SEQ ID NO: 9636 - DNA, 201 bp, Homo sapiens
aactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatg

SEQ ID NO: 9637 - DNA, 201 bp, Homo sapiens
agacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgc

SEQ ID NO: 9638 - DNA, 201 bp, Homo sapiens
gacggttgtgagaatcacgtctaattaataactgtaactaaaaagtgtgtgtgtatatatatatatgtatatatatatatgtgtgtgtatatatatatgtrtatatatatacatatatatgtatgtatgtatgtgtatatatatatgtatgtatgtatgtatatgtatgtctaggacagcatctggcttgtagtaattgct

SEQ ID NO: 9639 - DNA, 201 bp, Homo sapiens
attggtaagtggagccataaagattggtaaatgacttaaaactcatgaattattctgagctaagagaaccaaaaatatatgtatatatatattttccatgrgatttcaacagcagttaacatggtattatctttgtactaattttgttaactgtgtgtctagaaaacttgtgcaacaatatagtaaacacaaaattagtgc

SEQ ID NO: 9640 - DNA, 201 bp, Homo sapiens
tcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatat

SEQ ID NO: 9641 - DNA, 201 bp, Homo sapiens
aggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagcctta

SEQ ID NO: 9642 - DNA, 201 bp, Homo sapiens
gtcacaatcctcaatacgtacattaaattagcttgttttgtggcaaaccctttaagaaatctaggctttaattttatatatatatatatatatatatattwttttttttttttttttttttttttttttttgagatagggtctcactctgtcacctaggctggagtgcagtggcgtgtttatagctcgctgcagccttaaa

SEQ ID NO: 9643 - DNA, 201 bp, Homo sapiens
cagtggcgtgtttatagctcgctgcagccttaaactcccgggctcaagtggtcctcctgcctgagcttcccaagtagctagaactacatgcaccactatgycagctaatttgttttattttgtgtacaaatgcggttctcaccatgttgctcaggctggtctcgagttccaggcctcaagaaatcctctcgctttgacctc

SEQ ID NO: 9644 - DNA, 201 bp, Homo sapiens
taataaggcagtgggcttttccagatctcagcttcagattctctagctctgtagctccccagtttatgggtatatattgctatttgttatgagacttgaayagcgtaaacctgaatggccccaaactaaatccatttgttttctagaggccacgcaggtattttctctgattcagaagcagaggacagaaattcaacacca

SEQ ID NO: 9645 - DNA, 201 bp, Homo sapiens
caatctgttgtgttctgtaagggagcatgagaggagataaagtgagtgacagaacccctacctttaaagagtgaacatgtagctctaggaggctgatattsatttcctccacctgtgattattcaactcatcacatttgaagaatgagcattgcatttttctaattttatttactccataaagtattcctggtgagtgatt

SEQ ID NO: 9646 - DNA, 201 bp, Homo sapiens
ggtagagaagtgcttgaacccgggaggcagaggttgcagggagccaagatcatgccactgctctccagcttgggcaacagagtgagactctctctcaattaaaaaaaaaaaaaaatatatatatatatatatatatgtatgtatgtatgtatgtatctcaggcttcacattttccaaaaacaatacagattaaaatcagaa

SEQ ID NO: 9647 - DNA, 201 bp, Homo sapiens
ctgtggaacaaaatagaattaccttcatggagcaagtttaacaaattgtcttcatttttggtcagcaggttgatttctaattccctcttattccctttatrtgtatttttggcttcctgtctttgttttgcgttgctataaagaaacatgtgagactgagtaatttacaaagaaaagaggtttattagggctcatagtttt

SEQ ID NO: 9648 - DNA, 201 bp, Homo sapiens
tatgttcatgggagtataatgttccagattaatgatacagtttttgtctttgttaacccaccaagttatttcactttcttttcttttttcttttttctttkttttttttttttttgagatggagtgtcactctgtcgcccaggctggagtgcaatggcatgatctcggctcactgcaagctccgcctcgtgggttcacgcc

SEQ ID NO: 9649 - DNA, 201 bp, Homo sapiens
ttttcttttttcttttttcttttttttttttttttttgagatggagtgtcactctgtcgcccaggctggagtgcaatggcatgatctcggctcactgcaasctccgcctcgtgggttcacgccattgtcctgcctcagtctcctgagtagctgggactacagacgcccgccaccacgcccggctaatttttttctattttt

SEQ ID NO: 9650 - DNA, 201 bp, Homo sapiens
tttttttttttttttgagacggagtctcgctgtcacccaggctggagtgcagtggcgcgatctcggctcactgcaagctccgcctcccgggttcacgccaytctcctgcctcagcctcccgagtagctgggactacaggtgcccgccaccacgcctggctaattttttgtgtttttagtagagacggggtttcaccgtggt

SEQ ID NO: 9651 - DNA, 201 bp, Homo sapiens
ggcctcccaaagtgctgggattacaggcatcagccaccgcacccggccctaaaagttcatctttaaggacatttcccacctttgttttagatatgccactrtctcagacatgaaacacaataacaaactaaaccagggtcatctccacccagcttgtacactacatatttgggtaggagcttaacgtcttgcccttcgctt

SEQ ID NO: 9652 - DNA, 201 bp, Homo sapiens
tgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagc

SEQ ID NO: 9653 - DNA, 201 bp, Homo sapiens
gtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcc

SEQ ID NO: 9654 - DNA, 201 bp, Homo sapiens
tgatctcccgcccacatactgtgtcatatcccagtaattcttccccaaaccttggctatgggttattgagctgacaaatgtctaaatgactgagatacgayttcacaacctgctgagagcctcttctttccctgtactctttgatttgtagctttgtaagttttgtgaggaaagtgggaaaaacattcttggtgacacagg

SEQ ID NO: 9655 - DNA, 201 bp, Homo sapiens
gcaggatgtgctctcagtaaaatttctggttgagtaaactcttggtgacattatcaaattaaacagcaatcccttccaaattcccctaaagctaagaccttttttttttttttttttgcatgtctttttttctctgataatcccagagtttatataacctcaaactataagcttgatgaattttagagttcattgtaatgc

SEQ ID NO: 9656 - DNA, 201 bp, Homo sapiens
atccatctttgtgtcaagagaaagtcaaatattatagtccccagccaaaataaggcatgtgatctacatcaaaggcaattcctgaatgtgtatctacagtyctcatcccctctcctcttttttgtctcttgggtaatctataccaataacctcctgattcatgaaatttattatctaaatattgaaaatattacactaaat

SEQ ID NO: 9657 - DNA, 201 bp, Homo sapiens
tgctttattatgtgacattcaaaggaaaaacttgaagtcatatttctagtaaagtatttaatttcagaaataatttaaactgttacttcaaagcaaatatytgctattcctgacataaagtttttacccaagcttggtaataaagttatcataagaataatatggattattctcaggatggaatagaatgtcttgattagg

SEQ ID NO: 9658 - DNA, 201 bp, Homo sapiens
tttttagtagaggggtttcgccatagtggccaggctggtctcaaactcctggcctcaggtgatctgcctgccttgacctcccaaagtgctgagattacagrcatgagccgctgtgcccaacctgagattttttttttaaaccttggattttcaaataactttatagttggagaaaagttgcaagaatagtatatggaattc

SEQ ID NO: 9659 - DNA, 201 bp, Homo sapiens
tgatgagttcactggaggaaggttggctagaaaaaaagtgacatggctgggcatggtggctcacgcctgtaatcccagcactttgggaggctgaggtgggyggatcacctgaggtcagaagttcaagactagcctggcaaacatggtgaaaccccatctctgctaaaaattcaaaaattagccaggcatggtggcaggcac

SEQ ID NO: 9660 - DNA, 201 bp, Homo sapiens
cgggaggtggaggttacagtgagccgagatcacgctctgcactccagcctgggcaacagaggaagactccatctcaaaaaaaaaaaaaaaaaaaagtaaarttgtctttttttttttttgcgtaccaaatcctatcaatgaaagagacaggaatagattcgactggaatagtcatgggagccatttccaggctctcatagt

SEQ ID NO: 9661 - DNA, 201 bp, Homo sapiens
ccatctcaaaaaaaaaaaaaaaaaaaagtaaaattgtctttttttttttttgcgtaccaaatcctatcaatgaaagagacaggaatagattcgactggaayagtcatgggagccatttccaggctctcatagtcttagagatgacacttggtagttcagtgtcttattgtgcttcttcaagcacatacagcctgattgaga

SEQ ID NO: 9662 - DNA, 201 bp, Homo sapiens
gttctattgtctaccttctctctcactgactccatcaaggcagacttgctcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatg

SEQ ID NO: 9663 - DNA, 201 bp, Homo sapiens
tcaagagacacactaaaggaattacagtatggagtgtctcctaagttgcattgtggaactaaacactagagacaagagtcgagccctggctcaatagagcsagtaataactcagtgtctttatgaccctgagccggtgccttaaattctctgcagcgtagtttctttaaacggtggttctaaactaaggggacttttgtcc

SEQ ID NO: 9664 - DNA, 201 bp, Homo sapiens
gatagtaaaagaatgaattaaaattccagtgagccaaactacaacattgataatagtaatgagaattaattctgtgttgattttatggtgcccttgcctcrtaagtatatataactctggagtttatgaggcatgtttatagatcttaacttcttaattttgtaatgctgtcctcttaaaatttttgcttgagacggacaa

SEQ ID NO: 9665 - DNA, 201 bp, Homo sapiens
atcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgc

SEQ ID NO: 9666 - DNA, 201 bp, Homo sapiens
aaagaaaatacaatgaggtaatgccggtataatttagcttgattcagccatttcacaacttgtatacatttcaaaacattatgttgcacatgataaatatrtacaatttttatttgccaatttgaaaaacagagaagtccctcttcagaacctgtcctatgcagctgtcactcacttggctttgtaagcctgcagacagtg

SEQ ID NO: 9667 - DNA, 201 bp, Homo sapiens
atttcacaacttgtatacatttcaaaacattatgttgcacatgataaatatatacaatttttatttgccaatttgaaaaacagagaagtccctcttcagawcctgtcctatgcagctgtcactcacttggctttgtaagcctgcagacagtgtcatttaaaatattttcctctgtaccataacacttttccttttaatgat

SEQ ID NO: 9668 - DNA, 201 bp, Homo sapiens
gtgagccacagctattgttttgatagcccactctgcttttctagttaactttcttagaaccgtcagttccatatttaagactagaggatcagttctgatgrtgctcattcaaactcttgccaactgacatttaatgcactttaaagttgttaaaaccaagagcaggaaatgttacacttgtagtatcaagcctggctcatg

SEQ ID NO: 9669 - DNA, 201 bp, Homo sapiens
cttgtagtatcaagcctggctcatgagaaagttccatccactattctggaaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggata

SEQ ID NO: 9670 - DNA, 201 bp, Homo sapiens
cactttctcagctcaatattccatgtgtccaaagtaatactgttagtatcctacattattccaggatcttgtcatgccacttcaagaaacaaattatcacygctttctaagacttaccaagctaggggtgttgtaaagtatgtatgcaattgacttttgacttttgattcttatgttgaaaggcaacataaaaaataagct

SEQ ID NO: 9671 - DNA, 201 bp, Homo sapiens
cccatctctttctccatcgtgggtttttcctttgggccacaaatagtgaacgccactgctttacaaagttattcttttcaccactaatagttctttgatgycattttttgtacaagtgtcaaagtttttctctagaggcttccacacagttaagttcttgcttttggattctttctaaaccaaataaataaatcttcgaga

SEQ ID NO: 9672 - DNA, 201 bp, Homo sapiens
tatgttctgatgagctgggcaaggtgttgtctgactttatggacagaaaaggactgaagaaagcagaaacaaaatgagaagtagacaggttgtttcaacayttccttctttctaggctttaagcagagggtactttcttatgctggatcaggtaaagggccccttctgcttggttgctatgaatctcctgtttaaaaagaa

SEQ ID NO: 9673 - DNA, 201 bp, Homo sapiens
agttgtttttgtgcctaaagattagcttgtttgtaagttcccatactcagtgagaactgaatattttaaaaaactggtgaagggtggcactgtattttaaygtaaaacatgcaggactagatacagtcacggccattcaattttttaagttgtatatctttgggtgagttacttagcttatttcagcccagatttactgct

SEQ ID NO: 9674 - DNA, 201 bp, Homo sapiens
gagggtcccgtcttgatgttgatggctgctgacagatcaggatgtgggtgctgaaggttgggatggctgtggtaacttcctaagacaaaaatgatgtttgytgcactgactgatttttcttatcacaaaagatttctctgtagcatgcaatgctgtttcatagcattttaatcagagtacaacctctttcaaaattggagt

SEQ ID NO: 9675 - DNA, 201 bp, Homo sapiens
tgtacctttgtgtcctcatagcttatctcccacctataagagagagcatacaatatttacttttccattcctgagttacttcacttagtataaatggcctygcactccatccaagttgctgcaaaagacattattttgttcccttttatggctgaatagtattccatggtggatatatataccactattaaagttttatca

SEQ ID NO: 9676 - DNA, 201 bp, Homo sapiens
cttcacttagtataaatggcctcgcactccatccaagttgctgcaaaagacattattttgttcccttttatggctgaatagtattccatggtggatatatwtaccactattaaagttttatcataacattacagcaattcagtcacatcttcaggtcttacttctaattatcttgctatttccaccatatcttcagttact

SEQ ID NO: 9677 - DNA, 201 bp, Homo sapiens
cgcctgtagtctcagctactcgggaggctgaggcaggagaatggcgtgaacccgggaggcggagcttgccaagatggcaccactgcactccagcctggcarcaaagcgagactctgtctcaaaaaaaaaaaaaaaaaaaaaaaaatagatctcactagaagtattctcaattcagcagtagtgtccagttttgaatcaaat

SEQ ID NO: 9678 - DNA, 201 bp, Homo sapiens
atatttagtaaaccatgctgtaaacaactgtcatctaggctttgctagtccacttaaagactacaggcatagtacatttagcataattcttaagaaccctrggaattttgaagtggcaaataagtattgactttaagtcaccagctacattagcccttaactagagaatctgcctgttctttgaagctttgaagccaagca

SEQ ID NO: 9679 - DNA, 201 bp, Homo sapiens
ctacattagaactcgctgcttcactttgtgcttttatattatgaagatggcttttttttttcttaaacctcatgaaccaacccctggtagcttccaacttyacttctgtagcttcctcacctgcctcagccttcatagaattgaagagttagggcctttctctgcattagggtttggttaacaggaatgttgtggctagtt

SEQ ID NO: 9680 - DNA, 201 bp, Homo sapiens
tgccaacagagttcctggatgccgagttgccagaaacgttcaatttattaaaaatgtatctgtgaagcacagtaaagcaaagcacaataaaacaagatatmcctgtatttgtttttaaatataaaaataatttgctttaatgctgaacaaaaatgtcccatgtaaaaaattcatgtgctatctgttcccaaactcagtttc

SEQ ID NO: 9681 - DNA, 201 bp, Homo sapiens
ccacagcacacagggcgcatgcagcccaggacagctttgagtgtggcccaacacaaatttgtaaactttcttaaaacattgagtttttgcaatgttttttsgtctcataagctattgttagtgttagtgtttttttatgtgtggcccaagacaattcttcttccactgtggcccagggaagccaaaagattgaacacctct

SEQ ID NO: 9682 - DNA, 201 bp, Homo sapiens
gacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattatagg

SEQ ID NO: 9683 - DNA, 201 bp, Homo sapiens
ttacaacataaaaaaatcatctgtgtaccagtcagaaatgaaggttttgtatgaaacattttcattcttcagtatcaacagcccaagattctcctgacttyatttctccagccctggcccctcacctcaccatctcttagctggccccagatatggcccaggtgttttaatcttctgggtgatctgatccagcctcttgac

SEQ ID NO: 9684 - DNA, 201 bp, Homo sapiens
cttgcatgtcctccaaattttctcatctcttaaatttgattcaggtgtacaaactccacatttgtcatcattcttgggcccctgtcccaactctcttcccyacacccagtcaagaagtcctgttgactctgcctcgataacaaattgctcacacatttcctttgctccagctacccatgctgtagtgtaagtcaccatcat

SEQ ID NO: 9685 - DNA, 201 bp, Homo sapiens
caacttctttctcagccctcccggtttgtaactttttaaatctttacccagtgttgcacgaagactgttgagatggttccctctgccttcctctctctagkattctccctgggaagtttaaaatatataatgttatgtaaagtaactcactggggccttcctcttgggcctcacctctatacactgaagacaatgctttct

SEQ ID NO: 9686 - DNA, 201 bp, Homo sapiens
ttgaataaatttgggataaatttcctgaagcagaactcatgaacccatatgtattttgattccaattcctgtcaatacaggttctagttcaactcccaacmcacacacacacacacacacacacacacacacacacacacacacacctctcacatgctttccttctaattggcaagaagccttcagatgtccttcacccct

SEQ ID NO: 9687 - DNA, 201 bp, Homo sapiens
gggaagaggttgctcctgagagggtagaagttttcagttgggagcaaccaacctagattttcttttttgaatactgtatccatgagccttggctgactgtsgaaatggcttttcaactgcctttcttttccttcagtttctcctggaagttgggtccttttcctccagatgttggaaaagtcagagaatgttttagatttt

SEQ ID NO: 9688 - DNA, 201 bp, Homo sapiens
ctgcctttcttttccttcagtttctcctggaagttgggtccttttcctccagatgttggaaaagtcagagaatgttttagatttttatcttcttcttcttyttttttttttttttttgagtctttctcctatttgcttgaattgttagtctgaaatgatgtgtgctcatcacttcattttgggcagatactttttttttga

SEQ ID NO: 9689 - DNA, 201 bp, Homo sapiens
ggggtgtgaggaggtggtcctagagtctaaaaattcaggttggactcctgtcttgtgaaggtgggcatacttggagaaggtgaaaagggagtgtgtgtgtragtgtgtgtgtgtgtgtgtgcgcgggtgtgtgctcctgtttggatcggttacaagggaatcttcctccactgccttccatttgtttatattaatgattta

SEQ ID NO: 9690 - DNA, 201 bp, Homo sapiens
gctgtacccagagtttcagctctttccctctctcttttttaaccacaaaacttaactgctttagaaacatcatcctgatgacaaggaaaaaaatgtgtccscccaccccccatcccttcttaggccagtgatgtaataccaacctaagggctcggctgctttgcaggtgacttaccctgtgattacttgttaaaaaaaaat

SEQ ID NO: 9691 - DNA, 201 bp, Homo sapiens
aatgtgtccccccaccccccatcccttcttaggccagtgatgtaataccaacctaagggctcggctgctttgcaggtgacttaccctgtgattacttgttaaaaaaaaataaaattttcccttcctccattaaatgtctgcctcttttaatttggatgtagaaatatcatcatgcaatgagaacatcatatttttgctaac

SEQ ID NO: 9692 - DNA, 201 bp, Homo sapiens
aaagtgagcaacagggctgggtttattttttaaaaacaaccggactgtgcgaatgcccttttctggagctttctggccctttctagtgaaataataatttwaaaaaaattgcttcttgagaagaggagggggcagaaattaaagggattctagattttgagagacagctacgtctttgcttctctggtagttccctattat

SEQ ID NO: 9693 - DNA, 201 bp, Homo sapiens
attattcttcaattggccttttagagaaaaaaaagagagagggaagggaggggttaatttggtgagggggcttggtcgtaattagcccactgctgcaaaastgagatacagaaatccatcggcaccagctttgggggcatggagaggcagcggagagatgggggacgggttgtcagtcttggatgaacagtggagcggtcg

SEQ ID NO: 9694 - DNA, 201 bp, Homo sapiens
tttgtgttttgtcaagcaccagcgtgcctccaattggacaacataggattgtcaacactgtgcgtgtggttcaagcaggaggctgcctgcctctttgtgtrgtgtggctgtgtttgttggatatgtgcgtatccagcctcatacggtggctctggacaggtgtggtagtgacggggaaggaaggcaagaagcagggatggt

SEQ ID NO: 9695 - DNA, 201 bp, Homo sapiens
gctcatggatgactggtgggcggatacagattgaagggggagaaggggatgaggtgggtgaaattgagggttttccctgctgccttgacagagcctggggmtgagctcgggagggtggtcttgctcccctggcatcagccacctcttgggcggctcggccttgttggaggctgcagcctgaaggagctgaaatcaccctcg

SEQ ID NO: 9696 - DNA, 201 bp, Homo sapiens
gactggtgggcggatacagattgaagggggagaaggggatgaggtgggtgaaattgagggttttccctgctgccttgacagagcctggggctgagctcggragggtggtcttgctcccctggcatcagccacctcttgggcggctcggccttgttggaggctgcagcctgaaggagctgaaatcaccctcggccgtgagag

SEQ ID NO: 9697 - DNA, 201 bp, Homo sapiens
gttagggagacagggttacgtcattgccagagaaaggggataaatggggagtaggatgccttgggggtaaattattgtgcccaatgcagagaagagattgytcttggtatcccccggccgtgttctccttacatgacccctcaggtgtggataggagacttgcaaaagaagaagcattccttctaaaacctcactgcctag

SEQ ID NO: 9698 - DNA, 201 bp, Homo sapiens
ggatggggcccactcccagccctttcctgcaggttgttcctcaaattatactcctcagagagacctttcctgaccagctttctaaaatagtccccttaccycaacctcctggctgctttccagcccatgacactgtctttaattttaattggtgaatcattatttaatattatattatacgatgatatattgaaacattta

SEQ ID NO: 9699 - DNA, 201 bp, Homo sapiens
ccactcccagccctttcctgcaggttgttcctcaaattatactcctcagagagacctttcctgaccagctttctaaaatagtccccttacctcaacctccyggctgctttccagcccatgacactgtctttaattttaattggtgaatcattatttaatattatattatacgatgatatattgaaacatttaagatggatc

SEQ ID NO: 9700 - DNA, 201 bp, Homo sapiens
actcctcagagagacctttcctgaccagctttctaaaatagtccccttacctcaacctcctggctgctttccagcccatgacactgtctttaattttaatyggtgaatcattatttaatattatattatacgatgatatattgaaacatttaagatggatctcgtctctttacccctctagaatgcaagctctgagaggtc

SEQ ID NO: 9701 - DNA, 201 bp, Homo sapiens
aggttgtcttctgaccttcctgggggaggagaaactggaatggaggaggacccccattccagtggggtgctcaaggttctcaatcccatatagccctgccygtcaagggtactttcaggtccagcagaggctccattcagagagccaagcagctggtatctggatgctgacgactctgggagcctgtcacttctcctagac

SEQ ID NO: 9702 - DNA, 201 bp, Homo sapiens
ggctgtaaacccaactacttttactaaagcttcgattggccaatatttgagacctgactatgggccagatactatgctaagcacttgacatgcattatctyacataatcctccaacaatcctgtgaggtgggtactgttatcatctctgtcttacaaatgaagtaactgaagcctaaggaggttaagtaacatgtccaagg

SEQ ID NO: 9703 - DNA, 201 bp, Homo sapiens
attctaagagctggcccatttgccaggcagtcagctgactcacagctctgggacttgctgaaggtgctgctgtcagttagaggcatttcaggcttaggagragggggctgctggttgtagcactgctgcttaggagtaatgctgctggttgtcttttgcatggcactaaggaaactctgtttcccaaggtgtccccgttac

SEQ ID NO: 9704 - DNA, 201 bp, Homo sapiens
aactagggctgcctcttcccctggctccaaatttggaattgtcaactctcccagagccttcaggaggcacctttcctacttcttgggtgccagggcaggtggagagggctctttgctgaaccccagttcaaggagggaggaacaattattctccaccttcctcagcatctttggtttatagagactgtgtacccagtctcg

SEQ ID NO: 9705 - DNA, 201 bp, Homo sapiens
tcagcatctttggtttatagagactgtgtacccagtctcgtgttcagcatgtgacatatatttgttctttgtttttttttttttttgtttctgtttttttktttttttttttttcttgttttagacagaatcctgctcttgttacccaggttggagtgcagtggcttgatcttggctcactgcaatctttgcctcctgggt

SEQ ID NO: 9706 - DNA, 201 bp, Homo sapiens
cccaagcccctttaaagggaaaaaaagaaaaaaaatgaagcatccagtagtaacaaaaagaaccatttgatattttctcattggctaagattggctgagckgccgctgcattaagttaagtgctttgcatatgaagttgggaggattcagtgaataagtgttaggcaatcattctcgttgtacaggtgaggaaagtggagc

SEQ ID NO: 9707 - DNA, 201 bp, Homo sapiens
cacaagtatgtctataattacacattatgatgagtgttctgaaggcaaagtattggggggcactgagaattagagagacctaatttagaatgatggggccgggggggacaatgatagctaaaattcgttgagcactcaccgtctgcaggccctgctgcaagggcttcacaagtatcacctcatttaattttcacaatgggt

SEQ ID NO: 9708 - DNA, 201 bp, Homo sapiens
ccgggggggacaatgatagctaaaattcgttgagcactcaccgtctgcaggccctgctgcaagggcttcacaagtatcacctcatttaattttcacaatgrgtcttggagaagagctaatgttattattgttgccttgttacggaagagggaactgatacatggaaaggtgcccagtctggaactaaaaccaaagcttgta

SEQ ID NO: 9709 - DNA, 201 bp, Homo sapiens
cttggctcaccgcaacctctgcctgccgggttcaagcgattctcctgcctcagcctcccgagtagctgggattacaggcagtgccaccaagcccagctgattttttttgtagttttagtagagacggggttgctccatgttagtcaggctggtctcgaactcccaacctcagatgatccacctgcctcggcctcccaaagt

SEQ ID NO: 9710 - DNA, 201 bp, Homo sapiens
tgagccactgcgcctggcctatcaaaattatctcaccacatcctttcagcagctaggataagtaggaattcttatccctttttttgcaggtgagaaaaaawaagtttttgggaggttcagtgactttcgataggaagcagctgggtgtggcagagctgagtctggagccagggcctcttgtctctgggcttctgtctgtgc

SEQ ID NO: 9711 - DNA, 201 bp, Homo sapiens
ttatctcaccacatcctttcagcagctaggataagtaggaattcttatccctttttttgcaggtgagaaaaaataagtttttgggaggttcagtgactttygataggaagcagctgggtgtggcagagctgagtctggagccagggcctcttgtctctgggcttctgtctgtgcgatggcacagttcccaggcggcggaca

SEQ ID NO: 9712 - DNA, 201 bp, Homo sapiens
tgggtgtggcagagctgagtctggagccagggcctcttgtctctgggcttctgtctgtgcgatggcacagttcccaggcggcggacatctctgcatcctgyctggacatcacctgctgggtaatgctaacaatggcaggttgggaggcaaggaggatcccccacagtccattggcctcttgttctgggcctgggagaaccc

SEQ ID NO: 9713 - DNA, 201 bp, Homo sapiens
ccattggcctcttgttctgggcctgggagaacccagaataaggatgaaacaagggacgtctttagggcatgccggcccctctgtgctgaaaggaagctccrtttttcttccttctggcaagaaccatcaggccagccctcttcctggtctgctggccctggaaaccacagtaaatgactttttcaggtaataccctccatt

SEQ ID NO: 9714 - DNA, 201 bp, Homo sapiens
gcatgccggcccctctgtgctgaaaggaagctccatttttcttccttctggcaagaaccatcaggccagccctcttcctggtctgctggccctggaaaccmcagtaaatgactttttcaggtaataccctccattgccttttttctctcctcttccctttcatccctagttgctaattagtgagatgcttgttacttgcag

SEQ ID NO: 9715 - DNA, 201 bp, Homo sapiens
catgccggcccctctgtgctgaaaggaagctccatttttcttccttctggcaagaaccatcaggccagccctcttcctggtctgctggccctggaaaccayagtaaatgactttttcaggtaataccctccattgccttttttctctcctcttccctttcatccctagttgctaattagtgagatgcttgttacttgcagt

SEQ ID NO: 9716 - DNA, 201 bp, Homo sapiens
gttttgtgtcccaccctctgcgtggtgcctactggaacactgtccctgcctgctcacccaagttgtgtggtcccctggcccaactgagctgaccagtagawatgagtgtaggtaggaagaagtacagggacttagttatgaattctgtctagagccaggagaaggaggcaagaaggtgaagaaagagaaaggagatgtgtc

SEQ ID NO: 9717 - DNA, 201 bp, Homo sapiens
cttctggggttgaagggctggttctggcaaggggagaagctagaagtgggcaggctggctttctgtctgtttttcttcaggtcttggggtaaagggagctscctccatactgggctctgattctgatgagactaacatttgaaagcaatagcttgactctacagatttctgaaatcaagatagaaaagggaaggtggggaa

SEQ ID NO: 9718 - DNA, 201 bp, Homo sapiens
ctggagagaatgacttgtccaccagccactgaacaaaattctcaggctttattttggttggaccaacatggatcaaatatctgtctttggaccaatcacartgggacgctcctgtagctagaccatgggtggggactagagtggacttggggagatgcaagagagtgaacacaagcatttggactttagtctgtgtgtcct

SEQ ID NO: 9719 - DNA, 201 bp, Homo sapiens
ctctactgtctcagcagaagccactaagctgggccatagagccaattctagaatctagtccatggaggtacatttgacacatcttggcattgggcaggaargaggagaggcagagtgaaagggtgacagtaaaggacccagccagtcttcgttggtcaatgttgttctcctatggttttcatcactcttcagagaaaagag

SEQ ID NO: 9720 - DNA, 201 bp, Homo sapiens
cccatgaggcaggtattagtgtcttcactttacaaatgacaaaaacagaggctctgacaggttaagtaatttgcccaagatctcttagcaagtatgtgagrtgtaaatctgagagatgttttggtggtgtgtgtgtgtttttttttttttttcctcaaagcttgcaatgctctgggtttcaagatgtggagggaaaagcat

SEQ ID NO: 9721 - DNA, 201 bp, Homo sapiens
gacaaaaacagaggctctgacaggttaagtaatttgcccaagatctcttagcaagtatgtgaggtgtaaatctgagagatgttttggtggtgtgtgtgtgtttttttttttttttcctcaaagcttgcaatgctctgggtttcaagatgtggagggaaaagcatgagctttggggtcactcatgcagacttgggtaggtaa

SEQ ID NO: 9722 - DNA, 201 bp, Homo sapiens
acaaaaacagaggctctgacaggttaagtaatttgcccaagatctcttagcaagtatgtgaggtgtaaatctgagagatgttttggtggtgtgtgtgtgtttttttttttttttcctcaaagcttgcaatgctctgggtttcaagatgtggagggaaaagcatgagctttggggtcactcatgcagacttgggtaggtaac

SEQ ID NO: 9723 - DNA, 201 bp, Homo sapiens
caaggtcatctaatctagtagttggtgcagccaggattggtacccacatggtctgatgttagaatccacactcaacacttcacatcactctggttctggtwtataggagctgtggccacagtaataacgatggccaaattctgctaataggaagtcttcgcttctggtgatggatggagcaggcatggagattttcttttc

SEQ ID NO: 9724 - DNA, 201 bp, Homo sapiens
aggaaggggagtccctatgtagagttgggaaatttgagctctaattacaacttcactaccaattcactgtatgctctttaacttttctaaaatgagtattyggtaaattaacacatagggagcactcgggccatgtgactgtcctccacatactcctgcacagctaatattgtcaccctggctttagagatggagaaacag

SEQ ID NO: 9725 - DNA, 201 bp, Homo sapiens
ttgagctctaattacaacttcactaccaattcactgtatgctctttaacttttctaaaatgagtattcggtaaattaacacatagggagcactcgggccawgtgactgtcctccacatactcctgcacagctaatattgtcaccctggctttagagatggagaaacaggatggattaaatggctcatggctccccagctag

SEQ ID NO: 9726 - DNA, 201 bp, Homo sapiens
tcctgcacagctaatattgtcaccctggctttagagatggagaaacaggatggattaaatggctcatggctccccagctagtaagtgttacatccgggacsaaaaacaggactgcaggattcaaggtttttcccctataggatacttgtgtttagaaaaagattgtagtctaactccttttccaccccatgacagttgggg

SEQ ID NO: 9727 - DNA, 201 bp, Homo sapiens
ctgtgtgtgcaaacttgggcaagtaatttcccttctcagagtctcagatttgtcatttacaaaatagcaatggcgtcatacctaccctacggattcctacrggttggttgggaatattgaggagttgtcagtaaattatctactttagtgctctcagaatgatgtctggcctggacctctcgccagactcactttgtgtat

SEQ ID NO: 9728 - DNA, 201 bp, Homo sapiens
tttcccttctcagagtctcagatttgtcatttacaaaatagcaatggcgtcatacctaccctacggattcctacaggttggttgggaatattgaggagttrtcagtaaattatctactttagtgctctcagaatgatgtctggcctggacctctcgccagactcactttgtgtatgcatctgcttgatcaccatctctact

SEQ ID NO: 9729 - DNA, 201 bp, Homo sapiens
atcattgaggaagctggtgacagaatgacaatgacaaccagcagtgttgtctgataatggtgggactgggaattggaagaatgcagcttgtgtcagtaacwtttatttatttatttatttatttatttatttatttatttacttacttacttacttaattacttacttacttgcttacttactgagtctcactctgttgcc

SEQ ID NO: 9730 - DNA, 201 bp, Homo sapiens
cagcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgca

SEQ ID NO: 9731 - DNA, 201 bp, Homo sapiens
agcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgcaa

SEQ ID NO: 9732 - DNA, 201 bp, Homo sapiens
gcagtgttgtctgataatggtgggactgggaattggaagaatgcagcttgtgtcagtaacatttatttatttatttatttatttatttatttatttatttacttacttacttacttaattacttacttacttgcttacttactgagtctcactctgttgcccaggctggagtgcagtggtgcgatcttggctcactgcaac

SEQ ID NO: 9733 - DNA, 201 bp, Homo sapiens
cagtgttgtctgataatggtgggactgggaattggaagaatgcagcttgtgtcagtaacatttatttatttatttatttatttatttatttatttatttayttacttacttacttaattacttacttacttgcttacttactgagtctcactctgttgcccaggctggagtgcagtggtgcgatcttggctcactgcaacc

SEQ ID NO: 9734 - DNA, 201 bp, Homo sapiens
ctgggaattggaagaatgcagcttgtgtcagtaacatttatttatttatttatttatttatttatttatttatttacttacttacttacttaattacttayttacttgcttacttactgagtctcactctgttgcccaggctggagtgcagtggtgcgatcttggctcactgcaacctctgcctcccgggttcaggtgatt

SEQ ID NO: 9735 - DNA, 201 bp, Homo sapiens
tcccgagtagctgggattacaggtgcccaccaccacacctggctaatttttgtatttttagtagagatggggtttcaccatgttggccaggctagtctcgratgcctggcctcaagtgatccacctaccttagcctcccaaagtgctgggattacaggcatgagctgctgcccccacccagtgactctcttttatatatga

SEQ ID NO: 9736 - DNA, 201 bp, Homo sapiens
gaggctgagaccttcccagggaggacccctgcaggcattggcctccgctgcaatagtccctttcccatagctccccaccctgatctagagttgcttggctrtgtggccagatagactgggaaagcctggtttcatctctttggcttggaagtttccttccagacatgtctagggctggtgtgatggaggtgggaatgtggg

SEQ ID NO: 9737 - DNA, 201 bp, Homo sapiens
gctgccacgaggcccctttggagagatctgagctatatccctgccccctttggctgcccgaaagtgtgtgtgtgtgtgtgtgtgtgtgtgtgtgtgtgtgwgtgtgagagagagagcatacatgtgtgcaagtgtgtaagtgcagggtgtgtgttgtcaggatattgttacactgcctaagggcaggagatggctcctggc

SEQ ID NO: 9738 - DNA, 201 bp, Homo sapiens
tgccacgaggcccctttggagagatctgagctatatccctgccccctttggctgcccgaaagtgtgtgtgtgtgtgtgtgtgtgtgtgtgtgtgtgtgtgwgtgagagagagagcatacatgtgtgcaagtgtgtaagtgcagggtgtgtgttgtcaggatattgttacactgcctaagggcaggagatggctcctggcta

SEQ ID NO: 9739 - DNA, 201 bp, Homo sapiens
ccacgaggcccctttggagagatctgagctatatccctgccccctttggctgcccgaaagtgtgtgtgtgtgtgtgtgtgtgtgtgtgtgtgtgtgtgtgwgagagagagagcatacatgtgtgcaagtgtgtaagtgcagggtgtgtgttgtcaggatattgttacactgcctaagggcaggagatggctcctggctatt

SEQ ID NO: 9740 - DNA, 201 bp, Homo sapiens
gggggctgtgtctatactccatctagtccagtggaggtaacgcacgctgggtttggagcgaggacatgatgtgcgacccacatcggtcccttccatctgcrtgaaaaggattttctagatgcagtgggctgagcacaatcatgagaaaccacagattcatcccattgcagccttgctttggcgttttgataggcaacgtgg

SEQ ID NO: 9741 - DNA, 201 bp, Homo sapiens
ctagaatgtgtgatctaggtgaggtcattgccaccttgaccctttatagtcagggcctggcctgccgggcctggctgcatctggcagaagaagggaggacmcgctcatctaccatggttgcctagggccttgggaagagtgggagagctacctatgctgcgggtgggttagaaggagaagggtggggtgagccagaatgag

SEQ ID NO: 9742 - DNA, 201 bp, Homo sapiens
ttttgagttgtgtttccttccagagagcattcagtcaaacctcagatgttcttttcctatagcttgagaaaaattcctgaaagattccttagcttggttcrtggctggcagattcctgtgagggccagctaatgggcatgtcttggttatatggtggcagagaaaaaaacctctgaccagtttctggctgaggaacagggc

SEQ ID NO: 9743 - DNA, 201 bp, Homo sapiens
cctgccgtgagccagggaggaactccatacattatgtaggagtggctctccccctgcagtggatattgtagacttttgtacctgcagcaggcgagtgtcarctgctttggaaatgaagcatagccctggaagaggggaatgaatggagaagaccaagggtaagtgctgctttagggtccctctcaccagattgtgacagct

SEQ ID NO: 9744 - DNA, 201 bp, Homo sapiens
ccttccccagacttcagtgggagatctattgtttgatcatggggtttggcaggcacttcgttaaggtggtgtgatataattttctggacctaggttctggycctactgtgtatcagtctcttgagctatggggggcctctccctggttccagggctcagcttcttcatccgtgaaatgaggctggatttggagctcttgaa

SEQ ID NO: 9745 - DNA, 201 bp, Homo sapiens
tggttgctgtgggtggggacagtgtccctgccaactgttaagagtccctgcccttttccagggacaagggcaagacaggaaaaggggaccaatttccgagkactgtgtgctagactcaggtttgtgatgtatattattttagttttataatcctaacccaatgccataggtagaattagcattttctgtattacatatgag

SEQ ID NO: 9746 - DNA, 201 bp, Homo sapiens
cccccatgtgagatgaggcttcctggggcccaggggcaatattactaataattactcattgttggcattttggagctaggtaaagcattctcccattgctrctgtttcagggttagacatcagtgacgagtagcctgggatatggcactggctcccaggtatgatgtatttctttgatcctagtctttttcagctgctcgg

SEQ ID NO: 9747 - DNA, 201 bp, Homo sapiens
aaaaagtcagaaaagcacagagacagaagcaaaaaaatcactattttcctaccacataccattgttgactttttggtgtagatccttccaggtgtgtgtgtgtgtgtgtgtgtgtgtgtgtgtgtgtttgtgtgtgtgtgtggtttgtgtgtgtgtgtggtttgtgtgtctgtattagattgtatacacttctttttttat

SEQ ID NO: 9748 - DNA, 201 bp, Homo sapiens
aggcctaaaaaagtgacatttttttttttgttttaaccttggccagttctaagaaagagcacgagcatgtatgaatgggttcttcagtggtgtgaggaaaraatatgtttgccaccttggtttgtttttctttatttgcctcttggtttttcctttgtcagcgtaatgcagaaacactagatctccaccctaagaaaaaag

SEQ ID NO: 9749 - DNA, 201 bp, Homo sapiens
tcatgtgttgggtcttttcagattggctgagatgatgcacggcacacttggatgttgttgaagtacttacactttgcttgggtagagtttgcatgaaagascattatttaactctttgagtagtaggattgggcttcctggaggaattgaggtgaaagatcaaaaagttgattgtggcttggcttaggccaagagggtaaa

SEQ ID NO: 9750 - DNA, 201 bp, Homo sapiens
actttctaaggaatattacctagccacagatctacagggtgtgtttgtttcttaaagcctatgaaaacccaccccttctttttggtttgtttcttttataygacccttaaatgtctttctccagagccctgccacccaccttcttcctgcgcactctaccttttctctctgtgatatcttttctaatcctatgcttttcac

SEQ ID NO: 9751 - DNA, 201 bp, Homo sapiens
attttctcacctataaaatgggcgataatattaatacataatttgtagggtgttagaaggattcaatgagttaatatttgtgatatgcttaaaaaagtgcytagcacatagtaagtactacttatgtagcatttactacgtgctttgttagtgtgtgccttattaaataaaataaatatatatccttagcttgacctagag

SEQ ID NO: 9752 - DNA, 201 bp, Homo sapiens
ttaacctctctgagcctcatctgtaagataggagtaggttacctacttgatgaggctatgtgaggattatatggccgtgtgtgtactgagtgccgggtccractctcagcacatggtaagctcacagcaagtactgtattgttatgatttccactaatacagccattatgtgctatttaatttgtagttcgcgtatgtgtc

SEQ ID NO: 9753 - DNA, 201 bp, Homo sapiens
tgtttacactgatgtgtcaccagcacctagaacattgcctgacacataataagtgcttaataaatatttattgaatgaatgaatcccaccacacaaggatyactgcctgtcttagtccgttcaggctgctataggaaaatagctttgactgggtaatttagaaatgacagacattttttactcatggttctggcgagtggg

SEQ ID NO: 9754 - DNA, 201 bp, Homo sapiens
agttcttctaggtggtgtcttcaatgtgtgctcacatggcagaagggccagaagggataaataagcttcctctggcctctgctgtaagggcactaatcccrttcatgaaggctccaccctcgtgacccaatcacctcccaaaggctccacctcttattatcacactggggatgatttcaacatataaacttaggtggggga

SEQ ID NO: 9755 - DNA, 201 bp, Homo sapiens
ttgctcccctcctgggccctctcaggcagctgagccttgcatcaggaacacctcttgcaatcacacagcatcagccctgtgagaagctaatttgataaacyccactccaaagctcattgaacctgtctataacgatgcttaattaaagtgcagaaactttgaagagatagcaagttactgcttaatgcaataccagagtgc

SEQ ID NO: 9756 - DNA, 201 bp, Homo sapiens
tcctttagaaagtatgggagcttcttggctagcaaatggagcctcctactttgttagaagggaaagtatagatggagctggcagatctcagagtggtgttmtgagcacaactaactagattactgtgactcagtggagacacttctagtaccaatagggtctcagagctgagagagagagatggtcattcatatctgttag

SEQ ID NO: 9757 - DNA, 201 bp, Homo sapiens
aaggacaggatgtgctgcctgagtcccagagagcccctgtggaagtcaggccaggttagtggggatcatcttagtcctcttaggaagactgatctgagatgggggaagagaatggaaggggaattaggatgagttctccaagaagcagacatcaaaacaggattgattagacatgcaagaatcttattgagggagatgcct

SEQ ID NO: 9758 - DNA, 201 bp, Homo sapiens
ctaaggataccctgatgtgtctgttcctgtggtctcttctaccttacctccagcttcctaaacccttccagtggtttcaactgttcttcacataaagactrcaccctttatccttgccttctgggcctggtctgggccctttctagccctccattcttattgcctactatgctttcctccctgtccctgttccagccccac

SEQ ID NO: 9759 - DNA, 201 bp, Homo sapiens
gagataatatgtgaaagagtgctcttttgtaaactctaaagtattttacaaatgtcaatactgtgccacgtcttagtattttcaaagaagcctaaacccamtggagatgggggtggatgggggtactgtccagaccctgttgctgatcctgttcccgagcccactctggccctctccccctgaccctgtagatgagatctt

SEQ ID NO: 9760 - DNA, 201 bp, Homo sapiens
gtactgtccagaccctgttgctgatcctgttcccgagcccactctggccctctccccctgaccctgtagatgagatctttttatgtatttctaaaaaggasctaaaacgtttttggagcatcggctctatggaggagagaggagacctgtgggatggaccagtgttttagcttctgggtccctgctccttcatcagtggaa

SEQ ID NO: 9761 - DNA, 201 bp, Homo sapiens
taggaagcacccttgtccacagctgtttcctgccgctgctttgttggtgctgggaagtttcgtttgtgctgggggggtttcgtttgtgctgcaggggggtggggggggcaggggttagtttgtgcacctaggtggccactctttggatctcccacatctgttctgggttctgaactttgaccccgttcctgcttcttcctt

SEQ ID NO: 9762 - DNA, 201 bp, Homo sapiens
tctctatccctctaaggacactagggattagatttgcagcccggcctactccagtatgacctcatcttgacttgatgacatctgtaaagaccctatattcaaataaagtcacattcacaggtaccaggtgttaagacttcaacatgtctttctcagcccacaacacctcatcttagtctagccttcctgcttatttgattt

SEQ ID NO: 9763 - DNA, 201 bp, Homo sapiens
ttttcccaaagtctttacttgatgaaataaaaaattaatcttatgtccttactaggcacattctctttttgtagggggtcaaattttatttccccatgacwtctataagtctagaaacctggccagatgccacagggtagacccccagtcctggttagaaagcatctccattttctgggatactaattctctctaagaact

SEQ ID NO: 9764 - DNA, 201 bp, Homo sapiens
ggcccaccctaaggacctcattttaacttagttagctctttaaataatctaactccaaatacagtcacattaggtactggggttaggagttttggtgggaggggggatgcagttcagcccccaacaattcctgtccaatatacagggtgactatttccaggggatggggagaatcagtggaaatttcatgtgacatctgat

SEQ ID NO: 9765 - DNA, 201 bp, Homo sapiens
ttcctcaagatagagaactggtggggtggtggaagttcaggggatgaggtaatgattgactatgcagcctcttctaggtaagaagtgaagagaatggagtrtgggagggatgatagactgtgagtgaagagattagggtgccgtatagctttggtgaggttagcaaggagggttaggaagagacaggagatagaaataaga

SEQ ID NO: 9766 - DNA, 201 bp, Homo sapiens
ccagtgatcttgcacctgcagtttggatggggtttggctgatctaggttgttcatagttggggtgggtggctggaatagctctggtcattgacctgttggractggtgggctagaacaggcatgcttatctcatcgtgagggcagaggtgccaaagagcaagcacttttcaaacttttggtcatgtcacacccactaatat

SEQ ID NO: 9767 - DNA, 201 bp, Homo sapiens
acagagggaagaattcgaaagaggcattgggaggcagttggctacccagggccagagagcagctgctggagcagggaggtcctagccttaggaataaaggrcacacacacacacatacacacacacacacacacacacagctgctagaagagcgtgggctcacccgaggtaaactcccacaaagccttattattttgggaa

SEQ ID NO: 9768 - DNA, 201 bp, Homo sapiens
ctctggctgcccaggcgtattgagaatggccatggatggttgagaactaggcacggggatcaagcccgggcccctctcctatctaccctggatatgagccrtggccaccttattagtctgtctgtgtcctgctgtattcctttcaaaaccgggtcccacaccatcgaaaatacagactttgtctcatcactccctctgttt

SEQ ID NO: 9769 - DNA, 201 bp, Homo sapiens
ctttgtctcatcactccctctgtttaaaatcttccaacagctccccaagactttcttagcttggcatccaggacctttggaactctgccctcaacaagactttttttttttttaacttttaaagttatctccttattaatattctctatttgatgagacattgtcatacctacatttactttttttgttttattttattat

SEQ ID NO: 9770 - DNA, 201 bp, Homo sapiens
ttccaacagctccccaagactttcttagcttggcatccaggacctttggaactctgccctcaacaagactttttttttttttaacttttaaagttatctcyttattaatattctctatttgatgagacattgtcatacctacatttactttttttgttttattttattattattatactttaagttttagggtatatgtgc

SEQ ID NO: 9771 - DNA, 201 bp, Homo sapiens
agcacctgttgtttcctgactttttaatgatcgccattctaactggtgtgagatggtatctcattgtggttttgatttgcatttctctgatggtcagggayggtgagcattttttcatgtgttttttggctgcataaatgtcttcttttgagaagtgtctgttcatgtcctttgcccactttttgatggggttgtttgttt

SEQ ID NO: 9772 - DNA, 201 bp, Homo sapiens
attctaactggtgtgagatggtatctcattgtggttttgatttgcatttctctgatggtcagggacggtgagcattttttcatgtgttttttggctgcatraatgtcttcttttgagaagtgtctgttcatgtcctttgcccactttttgatggggttgtttgtttttttcttgtaaatttgtttgagtacattgtagatt

SEQ ID NO: 9773 - DNA, 201 bp, Homo sapiens
ggttttaccacgttagccaggatgatctcgatcttctgacctcgtgatccactcaccttcacatcccaaagtgctgggattacaggcgtgagccaccgggyccggcccaagtagcaggtatttattagaggtttgttgaatgaatgaataagggcgcgttgtgttgaatgaaatggaggttgtgaccgcttaactccctct

SEQ ID NO: 9774 - DNA, 201 bp, Homo sapiens
actgtgacagggcagagtctggcataggtgggcccattgtgtgccatccaaatgcatttaattactgcaggatgagcccataggttttatatcatatgccygttgcaactgatgggaaggtagcacttcttagactgttggttgagaaggattctgaagctccctctgggctcaacattatggtaccatgattaattaatg

SEQ ID NO: 9775 - DNA, 201 bp, Homo sapiens
atggtaccatgattaattaatgattgattagtgaagtgtgctgtgaacacgtgtagggaagattcatgtattttgccaccttatctaacatatcccagaarcagtggtataatactaatcagtgtgatatatgacagaaatatgggacttattcagaagcttgaatttaagattcaattgcatcacttactgttttgtgac

SEQ ID NO: 9776 - DNA, 201 bp, Homo sapiens
actaaacctaccatcgttctaagctctgcaggtcctaatacttgccctggcctgggagggtctgaagtgtgccctcttgctgtgtcttttctttgccactrtcttccttctttatgcctcacatgtttatgtcttcctacaggacacagtgtgagggttggtagcaccatatactctctaggggttggcagtggaggggat

SEQ ID NO: 9777 - DNA, 201 bp, Homo sapiens
ctgtgtcttttctttgccactatcttccttctttatgcctcacatgtttatgtcttcctacaggacacagtgtgagggttggtagcaccatatactctctrggggttggcagtggaggggataataagtggggacctaaggatgttgcaacagatgggctcactgggtcactgttccctctccagttctcttcagccattg

SEQ ID NO: 9778 - DNA, 201 bp, Homo sapiens
agtggaggggataataagtggggacctaaggatgttgcaacagatgggctcactgggtcactgttccctctccagttctcttcagccattgacaaggatgmtaagttcatctgaccaaagtgcttttccaatgtagatccctttatttttatttattttgtatttttcttgagacagggtttccctctgtcacccaggcta

SEQ ID NO: 9779 - DNA, 201 bp, Homo sapiens
gcttttccaatgtagatccctttatttttatttattttgtatttttcttgagacagggtttccctctgtcacccaggctagagtgcagtggcacgatctcrgctcactgcaacctccgcctcctgaactcaagtgatcctcccgcctcagcttcccaagtagctggaactacaggcatgagccaccacacctgactaattt

SEQ ID NO: 9780 - DNA, 201 bp, Homo sapiens
caagtgatcctcccgcctcagcttcccaagtagctggaactacaggcatgagccaccacacctgactaatttttgtatttttagtagagacaaggtttcascatgttgtccaggctggtctcaaactcctgagctcaagcaatctgcccgtcttggcctcctagatcccttctagccacctctgtctctgtctctgtctct

SEQ ID NO: 9781 - DNA, 201 bp, Homo sapiens
gaaggtagaggaggagagatggtagattgggtgaggggcatcacataaactctggagctagacccagttctgcggttattcattcattcattcaacatatrgtatccatattctttttctcccccagagaatagattttctttagtccttgaggactcagcttcttacagggactttggcagaggtcaggggtgtagtgcc

SEQ ID NO: 9782 - DNA, 201 bp, Homo sapiens
gtagattgggtgaggggcatcacataaactctggagctagacccagttctgcggttattcattcattcattcaacatatggtatccatattctttttctcmcccagagaatagattttctttagtccttgaggactcagcttcttacagggactttggcagaggtcaggggtgtagtgccttggctctaaattggggtgag

SEQ ID NO: 9783 - DNA, 201 bp, Homo sapiens
ggcactactcatgtagtaatgttgtttcacatacagcttgggaggcacaaaagccttgaagatacatgattcatgcatgtcctgatggctgcagtctctgytgtattttggatgatgagcttcttaatggccttgtccttggctacacatagggccaaattcatgcaataaataggctgaatatggctgtggtcctttttg

SEQ ID NO: 9784 - DNA, 201 bp, Homo sapiens
tctgcttctaagataaagacataaatactctctgtagaacttccgttcactagacaaaattctatcctggagggcaatagagaaaccgtgggatctttttkccaatttaagtatgcttcaaaaaaaaaaaaaaaaaaaaaagaatgcttcctactcctgtggacactgctcctgccactgctgcattgcctgtgttagccc

SEQ ID NO: 9785 - DNA, 201 bp, Homo sapiens
ttagtagatactgccagcataattttccaaaagtagttacatttttataaatttttaaatttcatgaagttcaaaactgccctatgagataggtattattccccccccccttttttttgatgaagaaagactcaagagagttgcccaaggttaaatagctataggaatgagagtctgggtttaaattcagctgtgcctgcc

SEQ ID NO: 9786 - DNA, 201 bp, Homo sapiens
tagtagatactgccagcataattttccaaaagtagttacatttttataaatttttaaatttcatgaagttcaaaactgccctatgagataggtattattccccccccccttttttttgatgaagaaagactcaagagagttgcccaaggttaaatagctataggaatgagagtctgggtttaaattcagctgtgcctgcct

SEQ ID NO: 9787 - DNA, 201 bp, Homo sapiens
tatgagataggtattattccccccccccttttttttgatgaagaaagactcaagagagttgcccaaggttaaatagctataggaatgagagtctgggtttmaattcagctgtgcctgcctccaaagcccatgttctctctcactagcctgaactacttttatatctttgagagaattcatgccttaacctccctcactaca

SEQ ID NO: 9788 - DNA, 201 bp, Homo sapiens
taaatagctataggaatgagagtctgggtttaaattcagctgtgcctgcctccaaagcccatgttctctctcactagcctgaactacttttatatctttgrgagaattcatgccttaacctccctcactacatgcagtagagcctttgctgttgtattaagatagatagtgctgactatgtgagcttgccctaatggtgtg

SEQ ID NO: 9789 - DNA, 201 bp, Homo sapiens
gggtgagagacccatcttgaaactaatcactgtggccaagagattggaatgtcccagttgactaaactggatcatatgatttgggattgggatgaacctcwccttgaatgacacagaacgagattggtggtgaaaatcatttacctgcaaagtggggtgaggggagcagtgaacatggggcaaaaccaccagagagccact

SEQ ID NO: 9790 - DNA, 201 bp, Homo sapiens
tttcctcagtcagcctttttgatcccccacaatgcagggcagggaatggtggtatcccccagtgctggtctgggctggaggggaaggatgagggactgaakgaatggggaggctcagcctggaaggggtgtgtggccccgacaaagcaggctaagtgcccatgatcttcccccacaagggaatgtttctgggcagcagagt

SEQ ID NO: 9791 - DNA, 201 bp, Homo sapiens
catgacgaggccctgtggcagacaccatgttgaagcagtcattgcctccagggagccccccatcagcaatctggttccagagcctgggctcttaattgccrtgctttactgtctctgaagtaaacttgtcccccactagtttgtgatgccctggagggtgagattggtgtctttattttgctttgatccagtagtgcctgg

SEQ ID NO: 9792 - DNA, 201 bp, Homo sapiens
gccagcagctgtggctcatgcctgtaatcccagcactttgggaggcctagatggggagatcagaagtttgagaccagcctgggcaacatgatgaaactccrtctctactaaaaatacaaaaattagctgtgcatggtggtacatgcctgtaatcccagctacttgggaggctgaggcaggagaattgcttgaacccaagag

SEQ ID NO: 9793 - DNA, 201 bp, Homo sapiens
gggaggctgaggcaggagaattgcttgaacccaagaggtggaggttgcagtgagccgagctcacgccactgcattctagcctgggcaaaagagcaagactstgtctcgaaaaaaaaaaaaaggcttatgctaggatcttcctatacctgatttcattgattcctctcttcaatcttgggaagaggctattattttctctac

SEQ ID NO: 9794 - DNA, 201 bp, Homo sapiens
agtcacattgaacattgtggagaatgagggacagagaagaggccctagatttgtacatctgggtgttatgtctataaatagaatgctttggtggtcaactrgacttgttcatgttgacatttagtcttgccttttcggtggtgatttaaaaattatgtatatcttgtttggaatatagtggagctatggtgtggcattttc

SEQ ID NO: 9795 - DNA, 201 bp, Homo sapiens
ggagctatggtgtggcattttcatctggctttttgtttagctcagcccgtcctgttatgggcagccttgaagctcagtagctaatgaagaggtatcctcaytccctccagagagcggtcccctcacggctcattgagagtttgtcagcaccttgaaatgagtttaaacttgtttatttttaaaacattcttggttatgaat

SEQ ID NO: 9796 - DNA, 201 bp, Homo sapiens
ataccaccctgcgcctgacattctaggtgctttttatattcattggctcatctatttctcacaaaactcctatgaagttaataccattagctccattttayggatgaggaaaccgaggaaccgagaaattgggaacttgaaccccccgtttggcatagtggataagagtatggctgctggagggaaaatgatccggactta

SEQ ID NO: 9797 - DNA, 201 bp, Homo sapiens
ggctcatctatttctcacaaaactcctatgaagttaataccattagctccattttacggatgaggaaaccgaggaaccgagaaattgggaacttgaacccsccgtttggcatagtggataagagtatggctgctggagggaaaatgatccggacttaaatttgggcttgtctacttacatgttgtatggctctggagaagg

SEQ ID NO: 9798 - DNA, 201 bp, Homo sapiens
tcatctatttctcacaaaactcctatgaagttaataccattagctccattttacggatgaggaaaccgaggaaccgagaaattgggaacttgaaccccccrtttggcatagtggataagagtatggctgctggagggaaaatgatccggacttaaatttgggcttgtctacttacatgttgtatggctctggagaaggttt

SEQ ID NO: 9799 - DNA, 201 bp, Homo sapiens
gggaaggtgtggtgggaagaggagatgtctaggatatccactgggaaaagggaggaaatgtttggaaatatttgcagtagatttagaggaacaaggtggtwtttagacagagggatcactctagtcatcctcctgagggttttttccctgctgaagttgggaggtttagtttgctgtggctcacaaggtaagggggagtgg

SEQ ID NO: 9800 - DNA, 201 bp, Homo sapiens
gaaaaagtacagtgagagtgtgtacagcttatttacttaataggttgctttcaaatagaaaggagtacccacttgcgaggagggatacgctggaaagcaargctgagatcacttctttgtgatccacatcatggggaaagggctggacaggctgggagtttaccacacactcagtttcttccttcctcctcattctctcag

SEQ ID NO: 9801 - DNA, 201 bp, Homo sapiens
gacaaatcctcccacagtatgtttgctctgtctgggccagaaaagacaaggctggagtttaggcagaggtgttgtacaatcacatgatgtgctttgactcrcggcttagttttaaggaaacacactgaaatttggggagattctggtgttgcaggagaagtctgtgaaggatgaagtgtggatcatgtggccctgttagag

SEQ ID NO: 9802 - DNA, 201 bp, Homo sapiens
tgggataataagtttaaaggggacttcaaaagtcattggatctaagtactcatttctcatcctcctctgcactatataaaatgagcctccccgtgccccgcccccccgcccaaagaaaacctgctagccatctgcaataatgggagcttggtgcttttcaaggcagcctaatgtatctctggtcaatactgagtatcaggg

SEQ ID NO: 9803 - DNA, 201 bp, Homo sapiens
cctgccaagcaaattcgctcctgcaccctaaaggggatgaggctagtcttggccgtcagccatctccccattgacagtcatttacctgacacagcagcagaaaaaaaaaaaaaaaaaaaggaacccgtctcatcattttgtggtttaaaatagtttacttttaagagcaaagcccacagacatcattttgagtccaagcac

SEQ ID NO: 9804 - DNA, 201 bp, Homo sapiens
gaggaggtattctctttaggaactgtaagacgtgaaaccaagggtggaggactctgtttcccttagttaatgcacttacaggcttgtttgctaaatgtcaygtctctgacaaaaagcaggtactcaataaatgtttgttgccttaatcacattgtgtgtatatgcaggttttatatgtgcacatatgtgtctgtattcata

SEQ ID NO: 9805 - DNA, 201 bp, Homo sapiens
tccgagccacagaggaagaattctctgttggttagaggtgttggaccacagaacgcacaactttggcaagctctgttcccaaaaggggcacagcaggtgcyttcgtgaagctatcaggagcatgtgccagcatgtgcatgccttcaatccaaggactctgtggttttggggtcttggtagccaggcccaccctcatgtttg

SEQ ID NO: 9806 - DNA, 201 bp, Homo sapiens
atcagttttccaggaatttcaggacacaggaattatcacccagctgtgttgtgtgttgctgttcagcaatctgaagttgcttatctagcgtaagtcagaayggggagcctagggaggaggggcaacgccttcatttttctaagcagaagagactgaggtgttaggggcccagctggtatgcgatgggaaccaagaaatgga

SEQ ID NO: 9807 - DNA, 201 bp, Homo sapiens
ccgatctaccctccacccagtagtacaaagatacacaaggcgctagagtgaagtttttccatcctgcatgaaaacaataaaaataaacaatgtagtacatytttggtgaagtcactttttttttttagtttatgggatatgcccttttattttggggatgtgaaaagaccttttctttttaagagaatatgatgatataaa

SEQ ID NO: 9808 - DNA, 201 bp, Homo sapiens
tttgcaggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaa

SEQ ID NO: 9809 - DNA, 201 bp, Homo sapiens
ttgcaggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaac

SEQ ID NO: 9810 - DNA, 201 bp, Homo sapiens
ggtctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaaccaaat

SEQ ID NO: 9811 - DNA, 201 bp, Homo sapiens
tctaaattttgtcaagaatgtttgatccttccttcaattttttagttaataacaaatttcaccatgcgcatttttagctgctgtcagttctattttttgtgtgtgtgtgtgtgtgtgtgtgtgtgtgtgtgtgtgtgtgtgttttcctgacaggtctaatttttttccgggtcagtttttgcagtttgaaaaaccaaatct

SEQ ID NO: 9812 - DNA, 201 bp, Homo sapiens
tgtctttagagtacaacagaaattataagataaaaatagtgattaataataattctaattataattcacaaacatattattaatatgtgaatgtgaaatcraaatgctttttagggactctctctcctcttacttaatctgtgtttctttctttctttttttttgagatggagtctcactctgtcgccaggctggagtgca

SEQ ID NO: 9813 - DNA, 201 bp, Homo sapiens
ttctttctttttttttgagatggagtctcactctgtcgccaggctggagtgcagtggtgtgatctcacctcactgcaacctctgactccctggttcaagcrattcttccacctcagcttcctgagtagctgagattacaggcacataccaccacgcccagctaatttttgtatttttagtagagacagggtttcaccttgt

SEQ ID NO: 9814 - DNA, 201 bp, Homo sapiens
aacacagtattccaggttgtcaacaatcaaagaacagggaattagtatgtgctgagcatggtgtcaggcaggtcattaagcattttatatacaattgattsttttgataagcttgacaactctggaattgatacaatgactcccaatttatagatgaagtttaagggacttatctaaggtcacataatgaatagcaatatt

SEQ ID NO: 9815 - DNA, 201 bp, Homo sapiens
agcgttctctgtcaactctaaatcccccattagtgctaagtatgataatagaagaccatgtaggaccacactatcatgtttacatcgtctcttggttcatwagattggtgactaacagcaatgcagagccgtctttttgagtctccagtgcctaagtcagtgtctggcatgtagcacctggtcaataaatgttagctattt

SEQ ID NO: 9816 - DNA, 201 bp, Homo sapiens
tttgtggcctcattcaaacctcacagcaacctggtcatgtacttactgtcattattcccagtagttggggatatggaaaatgaagctcacagaggctcagytggcaaaagtcacacagctagtaggaagctggaaagtcaggcctcaaagccagggcttctgtaactaaaatgtggactgtatacacaatggaatattatt

SEQ ID NO: 9817 - DNA, 201 bp, Homo sapiens
aactgtcaaaccctgtttcctcaagccagagccactgcaagtatgtgagagcccctgaaggtgtttgagtacagcagtgacctggcccacagaaatgcctrccttggtccttcctcttcccctcctggccgctgcctgcccaggctgactggtgcctgatatagctgctactgatgctccatcttgcaatctggagttatt

SEQ ID NO: 9818 - DNA, 201 bp, Homo sapiens
gggaggccttaggaaacttacaatcatggcagaaggggaagcaaacatgtccttcacatggtggcaggaaggagaagtgctgagcaaaagggggaaaagcyccttataaaaccatcagatcttgtgagaacttattcactaccacaagaacagcatgagtgtaactgcccccatgattaaattatctcccactgggtccct

SEQ ID NO: 9819 - DNA, 201 bp, Homo sapiens
ggggaagcaaacatgtccttcacatggtggcaggaaggagaagtgctgagcaaaagggggaaaagccccttataaaaccatcagatcttgtgagaacttaytcactaccacaagaacagcatgagtgtaactgcccccatgattaaattatctcccactgggtccctcccatgacttgtggggattacgggaactacaatt

SEQ ID NO: 9820 - DNA, 201 bp, Homo sapiens
ccaatcactatttgacattatgtatctgtttttattcccattaaaacccaagagtattgtctgtttcattcactgcttgtatctccaatgtttaaagcagrgttcagcctatgatagatgctcggccaataggtattgaatggtgaatagatgatcttcattgataaaactcgcagaaatacttttagtatctccatttat

SEQ ID NO: 9821 - DNA, 201 bp, Homo sapiens
tttaacatctattccaggcaatccatcagtaacagttaatggacccgcctagttatttatacaacactttttccctttccacctcttctcttcttcctgcyattcatccctaaatctaacacactagaaaacctgaaggggcggtgtggctgaggcatgattcagagctttctagaagtttctttgggcagatacagcttc

SEQ ID NO: 9822 - DNA, 201 bp, Homo sapiens
acagtgccttgggctgctctgggttatgcttccccagcccgattctatttcacatctgagggaaggaggaggagattatgttgttcatggggctgataggmgcgaaccgttcttcattttctgaaagttcattggcttaattcaaatgtcaacctgtctagggttgggtgtttattcgtagttgtcaaaagtgatttcaag

SEQ ID NO: 9823 - DNA, 201 bp, Homo sapiens
ccctggacatggcaggaggtggcctgagcgtgcccggccctggctgaggtcagtgggggcctcctgcctctctgagccccttgccaggcattctggagccrgcagcgctgtggttctgaaacaagaagccttcagcagttctctgactcttttttccttcccctcaggaagtcaagttggggattttatgagctaatgtaa

SEQ ID NO: 9824 - DNA, 201 bp, Homo sapiens
cctggacatggcaggaggtggcctgagcgtgcccggccctggctgaggtcagtgggggcctcctgcctctctgagccccttgccaggcattctggagccarcagcgctgtggttctgaaacaagaagccttcagcagttctctgactcttttttccttcccctcaggaagtcaagttggggattttatgagctaatgtaac

SEQ ID NO: 9825 - DNA, 201 bp, Homo sapiens
ccttgccaggcattctggagccagcagcgctgtggttctgaaacaagaagccttcagcagttctctgactcttttttccttcccctcaggaagtcaagttggggattttatgagctaatgtaactatttacccagaggccgctggaagactataaagggatgattgattaattgattaattttacatgtggaggagatgag

SEQ ID NO: 9826 - DNA, 201 bp, Homo sapiens
attcccagctctttgcacagcacatggcacagagcttaacctcaaaaatctctattgaacaagaagtatggccacaagcacatggggagttttgagtttgyagggttccaagacatggtggagcttaaagggtatcctgtccaaggagtgcaaactgaggcccaagaagggaaaggacctatccaaggccatgttacccat

SEQ ID NO: 9827 - DNA, 201 bp, Homo sapiens
cataagttatccatttgatcctttaagcacatgtttccattttatagatgaaaatactttggctcagaaaggtttttttaaaaacggaaaatcaacccacmgttgtagctgtgtcttggtctccctaattgtcttgaggcatgctcctgtgcagtgccgtagaacctccccaaacacacctgctgttctctcctgtctcat

SEQ ID NO: 9828 - DNA, 201 bp, Homo sapiens
ctgttggttactcatgggcatgataggaagaaaccctttctgttcagtccagccaccttgccataagaacaatattggtctagtggcaaacagtgagtggrctggtatgattacatggtacaaaaggctaggtggtgaggactgaacatggtagtatcatggaagggcaaaacccagaggctggaatctgggcaaccccta

SEQ ID NO: 9829 - DNA, 201 bp, Homo sapiens
tcaggaggctgaggtgggaggttcacttgagcccaggagtttagggctgcagtgagccacgatccacgattgtgccactgcactctagcctgggcaacagrgtgagaccttgtctcaaaaaaaaagggggacttaggtagaaggtttcttctaacccttcccctttcctgtaaacattcttctcaatcccacgctgtctcc

SEQ ID NO: 9830 - DNA, 201 bp, Homo sapiens
gaggattgaggaaagggagaagacagccatttaaaagggcttcccagggccctttaaaccatgctgagccagggtcataaatgaagctgatgtctaggcaygattttctgcttctggattctctgagatatgtctcctttcttctccattagcactgaactagagggggtaactggtgtcatggttaccatcacaggctgg

SEQ ID NO: 9831 - DNA, 201 bp, Homo sapiens
aggcaatttcaactttgtatgccttatctcctggtgatctttttctcctcttattcctctatgtaccctgagaacctgtgcgccacagataggcaggtacragaagggtggaatatattaacaggactagaaagagggaggtggaagggtcaaaagtatcagacatcctgttgggatccagctggagtagcactttttcag

SEQ ID NO: 9832 - DNA, 201 bp, Homo sapiens
acatcctgttgggatccagctggagtagcactttttcagggtgtgacatcaaacgggagacacttccgttgctttcttatatttttgtaattattttttawaaaaggaattgtagttccataagaatttgacattggcaattcttaatttccttagctgaactttaatggtgctgcattttgagtcatagctgaagatctg

SEQ ID NO: 9833 - DNA, 201 bp, Homo sapiens
agcctgtgccttttcttttggcagccctggaatatcaaacccagaataaatgccaaactccaaaaccagccagggtgcttgtcctagggctggcagtgtgrcctgggagattgctgctgatgggcatgcattttgaccccgtttctgaggtcgactagaaggtccatcttcatttttaccccttcctcatctacaacatac

SEQ ID NO: 9834 - DNA, 201 bp, Homo sapiens
ccttttcctttttttttgaatgtaaaattatttcaacatttatatcttaatgttgaatatgcttggaaaaaagaacctccaggatatcttaatatttcccyactcctcccaggttaagactcagggctccaaccccttttcctttgaggtgtcattcactgacacaggtgctgaccctctcatctatgaatggggttgtga

SEQ ID NO: 9835 - DNA, 201 bp, Homo sapiens
aatgttgaatatgcttggaaaaaagaacctccaggatatcttaatatttccccactcctcccaggttaagactcagggctccaaccccttttcctttgagrtgtcattcactgacacaggtgctgaccctctcatctatgaatggggttgtgagaagcccttatattaatatttgtcctgactctctctcagactgtagtc

SEQ ID NO: 9836 - DNA, 201 bp, Homo sapiens
tctttatagtccctactggtcttattgtctgaattaatcatttgacacttaggaattatccattcactcattcaatcatcaaacacacactgaacacttaytgtctgtcaggtactataataggtgttgccttacatgtcagtacatttccatagcataataaaaataacatcaacaacaactgttataaagctcgtgtca

SEQ ID NO: 9837 - DNA, 201 bp, Homo sapiens
tgaggcaggagaatcacttgaatctgggaggcagaggtggcagtaagccaagattgcaccattgcactttagcctgggcaacagagtgagattccgtctcaaaaaaaaaaaaaaaaaaaaaaaagaaaaagctcctatgtgtaggcacaaatttgtatatgttaatcctcaaagtaacttttgaggtaggcattattatta

SEQ ID NO: 9838 - DNA, 201 bp, Homo sapiens
gaggcaggagaatcacttgaatctgggaggcagaggtggcagtaagccaagattgcaccattgcactttagcctgggcaacagagtgagattccgtctcaaaaaaaaaaaaaaaaaaaaaaaagaaaaagctcctatgtgtaggcacaaatttgtatatgttaatcctcaaagtaacttttgaggtaggcattattattag

SEQ ID NO: 9839 - DNA, 201 bp, Homo sapiens
gaatctgggaggcagaggtggcagtaagccaagattgcaccattgcactttagcctgggcaacagagtgagattccgtctcaaaaaaaaaaaaaaaaaaaraaaagaaaaagctcctatgtgtaggcacaaatttgtatatgttaatcctcaaagtaacttttgaggtaggcattattattagtcaaattttatgatagga

SEQ ID NO: 9840 - DNA, 201 bp, Homo sapiens
aatctgggaggcagaggtggcagtaagccaagattgcaccattgcactttagcctgggcaacagagtgagattccgtctcaaaaaaaaaaaaaaaaaaaaraaagaaaaagctcctatgtgtaggcacaaatttgtatatgttaatcctcaaagtaacttttgaggtaggcattattattagtcaaattttatgataggaa

SEQ ID NO: 9841 - DNA, 201 bp, Homo sapiens
caaacctggctctgaagtccttgatcttaacccccatgcatcactgtcaggtatgagtatatatggcaaatgtgtgtgtgtgtaaatataagcacatgcayaccttcgcagctagactgaactctagaggtcagggatgatgtcccacacttacttgtatccccactaccttattcagtctatgcatgtggtagatacatg

SEQ ID NO: 9842 - DNA, 201 bp, Homo sapiens
tgagtatatatggcaaatgtgtgtgtgtgtaaatataagcacatgcataccttcgcagctagactgaactctagaggtcagggatgatgtcccacacttayttgtatccccactaccttattcagtctatgcatgtggtagatacatgaattgtttggatgattggttgttggtacttccattcactgttgaggggcttga

SEQ ID NO: 9843 - DNA, 201 bp, Homo sapiens
gcccaggatcttcgttttttaataaccatctccaggtggccgatgtagattgtcagtgaaatacactttgggaagcatataagataaagcgcaatgatagrggtttttacgaggcttgaatcccctcttactaccaaatgtcctgttcactatttagtaaatttaaaaaatattcacgtgggtcaaataaagactcttcca

SEQ ID NO: 9844 - DNA, 201 bp, Homo sapiens
atcttccttattcttttcttttcttttttttttctctctctctgtcttttttttttttttttgagacaaggtcttgctctgtcacccaggctggagtgcartggtgcgatcatagctcattgtagcctcaaacttcttggctcaagcaatcctcccacctcagtgcccacccgagtagctgggactacaggcatgcaccac

SEQ ID NO: 9845 - DNA, 201 bp, Homo sapiens
taatttaaaagaaagaaacctactttacctggcgtcttaagtctgcttcccaagggacttaatctttaacagatttatcacaaatcctacctattgcacaraacaacggtaaaaggaaagttctcgtgattaggcccagagcagttctgcaaacacaagactgtaagctagaaagccaggctttctgcccagcagcaggaa

SEQ ID NO: 9846 - DNA, 201 bp, Homo sapiens
ctgcatataaagatctgtaaattcagcatctgcaacctaaaatattcaaatatgcaaggaatgaactgtgcaggaaattcagctcagctaagcacagggtrggatgtgaatgaagcctttttctcctaaataaaaattttccacattatcagcctaaatcaggagttgagagctgagcctagttaaaattgtcttttcctt

SEQ ID NO: 9847 - DNA, 201 bp, Homo sapiens
actgggagaggagatcaggtgacttctctagtattagaaggggctccagaagaggctgagatgaagtctctgttcttgcagtttagtgagggagggaaggrccaacagcaagtgactatgaggtggacatgagtaggggatgtacctgatgttgaccagtgtgcaggcagcttgagagagttaagcacatctctttgagga

SEQ ID NO: 9848 - DNA, 201 bp, Homo sapiens
aaaaacatttggagagcctatattatattccttatgcacacacacagagcttcagatacaaccatgctccgggggaataagtctggtaccttctagaaagagagaaagacataatgacagacatggatgttgtgaattcctcttttgagaggttttcaagaaaggatgcagaattcttctgggtaactggtgctactaata

SEQ ID NO: 9849 - DNA, 201 bp, Homo sapiens
gatgtctccctgtttgttaacgcatttcccacctgccttatcaccgtggggtgtgaaacccaggaattactttctatcattctccttcctgaaccttcctmctcctaggcaattggtagagagagagcttgttgagactctcctccagaatgtctcttgcatctctgctgtcagctccctggatcagtttccagttagcac

SEQ ID NO: 9850 - DNA, 201 bp, Homo sapiens
ccacactgcattctcctgcctttggacttttgctaaagctctattctctttcttaaatgtccttgaacatgcttctccctcttatccttgaagatccaagyctcctaagtctgccagactttgtgctgtgttataaggtacctatgccaaactgccttgagtcacgtttactcatgtatttcaatccactccccaacacct

SEQ ID NO: 9851 - DNA, 201 bp, Homo sapiens
ctaaggccttctcttggccctgtgtgtgcaagtgtcagagggaaaattttatagattacaccagaataaacgtgggaaaggtcttgaatttattcttagayatttgtcagagaaaagaaggactatgcctcagatgttgtcattcttttaaagctgaatgatgaagtagtaaatccataatggaaagaattgtcaagttaa

SEQ ID NO: 9852 - DNA, 201 bp, Homo sapiens
gagggtatggagaatgcagagaatgacctgggagagaggtatctgacatctttaataacgatcaagaactgatttttaaacctttagggcggccgggcagsagggggatttagtttctttttccttttgctctacagagttttgtattcactggattgcctggtgttgaccctaagatctattctagtcctttaaagttca

SEQ ID NO: 9853 - DNA, 201 bp, Homo sapiens
tcaagaactgatttttaaacctttagggcggccgggcagcagggggatttagtttctttttccttttgctctacagagttttgtattcactggattgcctrgtgttgaccctaagatctattctagtcctttaaagttcagaagccctttttgatttgtttatgtgtatttttcccatgtagatttgatcactggccttct

SEQ ID NO: 9854 - DNA, 201 bp, Homo sapiens
cataaaagaaattatttctcagattttgaaacaacatgtctgtttcctcctcctcaatgatcaatttggatttattgattacttatagattttatgtctgygtatatatgtcataaaatactttctcctctaaggtatgaataatgatctatctgtttgtatagacctttgcttatccagttgagttagttaatcttagaa

SEQ ID NO: 9855 - DNA, 201 bp, Homo sapiens
ctcacagtcaatgggagtttgaaaatagctttcagatgtaacaaccacctttcctcaagtaaaaagccttaaatgcattgtttttaatgtatttttatatrtgcagtttttaaattaatttttttattttaaagggaaattgttaggtaatcatttagtcagatcacccacgctttacattatcagaatcagaaaagaaaa

SEQ ID NO: 9856 - DNA, 201 bp, Homo sapiens
agggaattttttatttgcttgtcatttatttgtttattggggatggcatacacagtgcaaagtgtataaaatgcatgctcttaagcatacagcttaaaggttttttttttttaacctgtatatacccacataaataccatccaaatcaagaaatagaatatgcccatcactataaggttccattgtgaccctttctgccat

SEQ ID NO: 9857 - DNA, 201 bp, Homo sapiens
tttcactgtgtgtaaatagaagcaaaaatattgtcctcttgtgaggtagctttgccctgtttttgatgaagcgcaggtttccctctatacaaagagaatayctaattgatattattgagtttttctcttttttcctaaggcatttagtggtaagcagaatagcagaggtggaaaagaccatatgctttgtaaaaagccaga

SEQ ID NO: 9858 - DNA, 201 bp, Homo sapiens
taataacactttttgatggatgtctgattgtaaaagtgctgcatctttcattaaaatttacatgtaaagcaagggcagaagcgatgacatgaaacctaatscaacttgcacatcttgacataataacaatcacaagaaactgcagatcccagatggcagcttggcctttgccatccttttaataagctactaactgctaat

SEQ ID NO: 9859 - DNA, 201 bp, Homo sapiens
acaaaacagagaccttccacctggagctttgaaaagtgcttccctgcaggttggaagctttccagtcagttgtaacaacgatggcaagtattgggatgaamaatgttgcttaataacattttcttgttttttttttatgaatatagagaatttaaaaaatttgttcgactaaagagccattgtgtgcatgtgcatgcatgt

SEQ ID NO: 9860 - DNA, 201 bp, Homo sapiens
acactcttctattattagtgatatctctgaacctgaacttgataatgtgagttttgtggtccagtattttacctataatggcttgtgtgctatgaagttgmtgaaaggactgtgaaactcaaatcaaatagaggctaatgcctcttgcttattaaacctagacttattaaacctatttgcgtattgactgggtaagtttta

SEQ ID NO: 9861 - DNA, 201 bp, Homo sapiens
tgactgtgggacttctcagagcctttgttatggcaatgcaaattacaaacctctgagaaggaaaatgtacatttcaaagttaccaaaatttatttgacatraaacgcttttttatgattttcattttggatgaaaatagctagaattagaactagttagtgttcagttaaaaacactttggacagcaattttatagtagct

SEQ ID NO: 9862 - DNA, 201 bp, Homo sapiens
gtaaaatacacaccacagatgttaaaacaactgcaattttaaagatactagtctggttaaaacacttccagtttgtattacctgagtacttaaacagatakccatatagtgagcataaacaatacttctgagaatggctgcttaactctaggaagagctgatcttggcataacatgagaaaactgctaggaactttagtct

SEQ ID NO: 9863 - DNA, 201 bp, Homo sapiens
tgtattacctgagtacttaaacagatatccatatagtgagcataaacaatacttctgagaatggctgcttaactctaggaagagctgatcttggcataacrtgagaaaactgctaggaactttagtcttatttgctttcaaatttggagcaggtcaacagtcatcatggttatttctctactgtatatctaaggtcattca

SEQ ID NO: 9864 - DNA, 201 bp, Homo sapiens
agcaggtcaacagtcatcatggttatttctctactgtatatctaaggtcattcatcctgagagtctggttatgaatggctttttttttttttttttttttyccagacagtgaacatgtaggtgaaggaattgctttctggtaggaattacttgtttagaagtcattggctcagctaaggattttgtgggttgtcgcagtgc

SEQ ID NO: 9865 - DNA, 201 bp, Homo sapiens
attttgtgggttgtcgcagtgcacagctgaggactttgtcctatttatgtgctgtctgttcagtatgaagtggcagccattgatccatctgtagtacaccrtttgcctggggctatttatctggttgtggagatgtagtttgctgagccaggcatacgctcccttgtttccccaagtgaccagtaatgagtctttacaaat

SEQ ID NO: 9866 - DNA, 201 bp, Homo sapiens
cattagtctcttcctttagaacaagttcatccaaccccaggtctgcaggctgcacacagcccaggatggctttgaatgcaatccaacacaaattcttaaaytttcttaaaacattatgagatttttgtgtgtgtgaattttttttctaagcacagcagaaatcattagccttagtgtatttcatgtgtggcctaagtcaat

SEQ ID NO: 9867 - DNA, 201 bp, Homo sapiens
tttatgatgctttgtaccacttacacagacttgctttgttgatggctttgtcttggctgaagtaagacggtgacaccagttgacttttaaaaagcttttayacccataactttttctttcttgctgtcccatgttgactatttataacagcgtggatgcatgttgagtgcaataaagatgagctgtgatgatattcaccag

SEQ ID NO: 9868 - DNA, 201 bp, Homo sapiens
ttggagatccagcactacttctttcttagaaatggtttatcttgtctgaaataatcctccagtttccctacttttacctctgcctttctttaaataaaggtttttttttttaacaaaactttctcgtatcagtttaaatacatttctgaatgattacatggcattatccccattttcacaggcaagaaaacagaggcccaa

SEQ ID NO: 9869 - DNA, 201 bp, Homo sapiens
ttcacaggcaagaaaacagaggcccaaggttacaaagctagttacagagctagcagcagaaccaagataaactgagctttgtctgaccccaaagcctgagstgacactactatatacgataccatcatttcaattaatttcactgaacctcagttttctcttctgtaaaatggggatgctaatatattattctaatatatt

SEQ ID NO: 9870 - DNA, 201 bp, Homo sapiens
gcaagaaaacagaggcccaaggttacaaagctagttacagagctagcagcagaaccaagataaactgagctttgtctgaccccaaagcctgagctgacacyactatatacgataccatcatttcaattaatttcactgaacctcagttttctcttctgtaaaatggggatgctaatatattattctaatatattctgaatt

SEQ ID NO: 9871 - DNA, 201 bp, Homo sapiens
gtattacatatgatgtattataaataataagacattattttacttttggtaaaattgagaagtatataagctaacacatattaaatgcctaaaaagatgtstagctctcgttatggttttaatatattccctttcctctcgacagtaacaataaagtgtaattgaatttaacaagtattgagcacaagggatacacaaaat

SEQ ID NO: 9872 - DNA, 201 bp, Homo sapiens
aaacaaaggtgagtatggtttctatgagatagagaatcacttctcattcatttttctattacacacatgtatgtgtattttgtgtatttttcttttccttyctttctttctttctttctttctttctttctttctttctttctttctttctttctttctttcttccttccttccttccttccttcctctccttccttcctt

SEQ ID NO: 9873 - DNA, 201 bp, Homo sapiens
acacacatgtatgtgtattttgtgtatttttcttttcctttctttctttctttctttctttctttctttctttctttctttctttctttctttctttcttycttccttccttccttccttccttcctctccttccttccttccttcctttctctttctttctttctttcttttctttttatttttttttgagacagggtct

SEQ ID NO: 9874 - DNA, 201 bp, Homo sapiens
tttttcttttcctttctttctttctttctttctttctttctttctttctttctttctttctttctttctttctttcttccttccttccttccttccttccyctccttccttccttccttcctttctctttctttctttctttcttttctttttatttttttttgagacagggtcttgctctgtcacccaggctggagtgca

SEQ ID NO: 9875 - DNA, 201 bp, Homo sapiens
ttttcttttcctttctttctttctttctttctttctttctttctttctttctttctttctttctttctttctttcttccttccttccttccttccttcctctccttccttccttccttcctttctctttctttctttctttcttttctttttatttttttttgagacagggtcttgctctgtcacccaggctggagtgcag

SEQ ID NO: 9876 - DNA, 201 bp, Homo sapiens
tttcttttcctttctttctttctttctttctttctttctttctttctttctttctttctttctttctttctttcttccttccttccttccttccttcctctccttccttccttccttcctttctctttctttctttctttcttttctttttatttttttttgagacagggtcttgctctgtcacccaggctggagtgcagt

SEQ ID NO: 9877 - DNA, 201 bp, Homo sapiens
ctttctttctttctttctttctttctttctttctttctttctttctttctttcttccttccttccttccttccttcctctccttccttccttccttccttyctctttctttctttctttcttttctttttatttttttttgagacagggtcttgctctgtcacccaggctggagtgcagtggcatgatctcagctcactgc

SEQ ID NO: 9878 - DNA, 201 bp, Homo sapiens
tttctttctttctttctttctttctttctttctttctttctttctttcttccttccttccttccttccttcctctccttccttccttccttcctttctctytctttctttctttcttttctttttatttttttttgagacagggtcttgctctgtcacccaggctggagtgcagtggcatgatctcagctcactgcaacct

SEQ ID NO: 9879 - DNA, 201 bp, Homo sapiens
tgcagtggcatgatctcagctcactgcaacctttgcctcttgggttcaagcaattcttctgcctcagcctcctgagtacctgggattacaggcgcttaccrgctaatttttgtatttttagtagagaccctgttggccaggctggttttgaactcttgacctaagttgatccgcccacctcagcctcccaaagtgctggga

SEQ ID NO: 9880 - DNA, 201 bp, Homo sapiens
agtgtttctcaaattcgtgagaatcacccagggaacttgtgaaactatagactttagttcctgcctcagaactgtaggacctgcagctctaaattattctrtgatcaggtaaatttgagacacgctgtgttacagcaaattccaaggaataaaatgaaccgaaaggaagtgtatgagactttaatagaagtattttgttgt

SEQ ID NO: 9881 - DNA, 201 bp, Homo sapiens
ttgataggcctgcttattttttgtgactgacttgtgaacagttaactgatggcaactcattttagtttgtagatatatcttaatctcttgtacgcatagtraccattacctccatgatgttctgaaatgaagccccttcctgtaaagctgtgcttttttctcttgtagctagaggttggcccattgtactattggaatgga

SEQ ID NO: 9882 - DNA, 201 bp, Homo sapiens
aaagaacagaactttcaactcaactgccttaaacaacaaagggcatttatgggctcagtttctaaaaagtccagtaactcacatgatatgaccaagacctrgtgtttgtcttccccattttttggctcgactttcttggtgttggcttcatttttggcagctcctgcccatgtgattttaagatggctgatggccattccc

SEQ ID NO: 9883 - DNA, 201 bp, Homo sapiens
acacgtaaaattacacttcacaagtccaccccttttcaactcgacactcatctatatctccttaaatgatacttaatctataaataaagataaaaagatcrtaatttcacctaacatgatacacctatcctgagtataattgaaaatgcactaaagagttggttttcctcctacagtatattggatttagggggaggctgg

SEQ ID NO: 9884 - DNA, 201 bp, Homo sapiens
actcccaacagcgatgacaatatacattctcagtaacctggagctggcactgaggctgcagccctggacatggggtgtcctctgggtataatctcacttamctttactctgcaaatgcaatgttggtcttgccatccctgtgttgtgttcagtcttatttgatctcactctccctgttacccatctgtataatcccctggg

SEQ ID NO: 9885 - DNA, 201 bp, Homo sapiens
gtttccccttccagatccattgcttgagtgtctgttgtgtgctgggcgtcggagattcagagaccatgttccttgataaccagcaattaccttctgaatgktacctgagtgcagatgaggaaggtctctgaaagcatacagggcgggggcttccaatacacactccctactttggactgttcaccactttgaataaaacta

SEQ ID NO: 9886 - DNA, 201 bp, Homo sapiens
tatgggctacagaaattgagattggggcagaggaggaacagtaacacagaaggaggtgagttgggaaagaatgaagagagacctaaaatcaaagtgccctrtgtgtggattgagaagccctggatttaagtcctaactctgcatttctgactgcatagcttgggtaagacgcagcacacctggagcctcatctgttgaagg

SEQ ID NO: 9887 - DNA, 201 bp, Homo sapiens
tgagaagccctggatttaagtcctaactctgcatttctgactgcatagcttgggtaagacgcagcacacctggagcctcatctgttgaagggggatttaamccctgccgtgcctgccccaggtttgttgggaaattaaatgtgtgcagtttgtaaactgtaaagtgtactgtgaatggaagggagtggtgttactataaac

SEQ ID NO: 9888 - DNA, 201 bp, Homo sapiens
aggtttgttgggaaattaaatgtgtgcagtttgtaaactgtaaagtgtactgtgaatggaagggagtggtgttactataaacagcatcatcatttatcagstaaatcctccctgagccatactgtggcaggggaatagatcgatggataggtctgctgtgacaggcaggaaaagaccagactggagggagcctgtggtcag

SEQ ID NO: 9889 - DNA, 201 bp, Homo sapiens
tgatgagagaatggacatggaaggactgtgcacactgcaaagtgtctatggtacattcactgagcacctactgcatacctggcattgctgtgggtactagsacatagtggagcataggacagctgagacacctgctcacaatgagatgtgttctacccatgatctgttaacagaggaagctgtcagaaagtgggaagaaaa

SEQ ID NO: 9890 - DNA, 201 bp, Homo sapiens
cagctgagacacctgctcacaatgagatgtgttctacccatgatctgttaacagaggaagctgtcagaaagtgggaagaaaaaaatgcagtgatctgagartgtttttgttttcaaaaaggaagaagtcctgttaattgccagtcattgccctttaagtctaccttcattcattctgaagtataaataacaaaaccaaatt

SEQ ID NO: 9891 - DNA, 201 bp, Homo sapiens
tgtaatatatctggattttagtaaaatcacttgatggagaaatggcctgaaatcttgcctgagaaattaattcaagctggccaggggggaagccatgtcaytcagaatgagaactggctgggagatgggagtgaaggttgtgatgacaaatggccttagctttcggggtgtgatagggtcaggtgagaagacccaatttgg

SEQ ID NO: 9892 - DNA, 201 bp, Homo sapiens
aagaggtcagcagtcaaggacaggaggccgaggcaggtaggaacaatgcgggagagtacaggcaaggacaaatggagggaatttccttgaggacaatctgmaaacattaaaaaatttgcaaatatataaaaattagcatcaggacaggaatgagacaaaggtccaaggccgtccaaggatttatccttccataatttgaac

SEQ ID NO: 9893 - DNA, 201 bp, Homo sapiens
atatcttctaacacatctcactctatagacttattctttacccagcaattgccatcctggagagggtgacaaacttgtatacttttagcactgaaagcccygtcttccagaaacccccttagtcctgggcaaaccaggatgattggttagcctgcccataggataactgctagcctgttggaatgttgcatggaagtctaa

SEQ ID NO: 9894 - DNA, 201 bp, Homo sapiens
agacatgcagtgtgtgtaattgtgaacagaatggatctgaattcgaatccagttagtctgcttactcacacaactcactgtgttgccttgagtgagttacaaaaaaaaaaaaaaaaatctctctgttcctgagtttcctcatctgtagaatggacataatcatagtactgcctgttatggttgtgaggattaaactagttt

SEQ ID NO: 9895 - DNA, 201 bp, Homo sapiens
gacatgcagtgtgtgtaattgtgaacagaatggatctgaattcgaatccagttagtctgcttactcacacaactcactgtgttgccttgagtgagttacaaaaaaaaaaaaaaaaatctctctgttcctgagtttcctcatctgtagaatggacataatcatagtactgcctgttatggttgtgaggattaaactagttta

SEQ ID NO: 9896 - DNA, 201 bp, Homo sapiens
tagtctgcttactcacacaactcactgtgttgccttgagtgagttacaaaaaaaaaaaaaaaaatctctctgttcctgagtttcctcatctgtagaatggrcataatcatagtactgcctgttatggttgtgaggattaaactagtttatgtattttaagtacttacaagaatacttggcacatgatccatgttactaata

SEQ ID NO: 9897 - DNA, 201 bp, Homo sapiens
tttatgtattttaagtacttacaagaatacttggcacatgatccatgttactaatattattattaagtgaactaatgcattcaaagtgctcagtgcaagastcaataaatgttagatattattagttattgttaatggtatatcgaaatgaggcataatagaaccatgtttgaagtgcaaaggcaacaaagacaaggcaaa

SEQ ID NO: 9898 - DNA, 201 bp, Homo sapiens
gaggtgctaaaggaggatccaggggaatgtagagcagttggaggtccagccgctgcttcatgtcagtgaggtgaatcagcacatcagcaacaatgtgtatgggctgcaaaatggctagtgcttttcctctatcctccaaattgcccaagagtcttccttaaggccctctctaagcagaaacattcaagaaagagaattctg

SEQ ID NO: 9899 - DNA, 201 bp, Homo sapiens
caaacctaggctgctgaggaagtgcagcaggcatttggggtaggggtggggacaggattctgccacatggtctccatcacagctttaaaaaaaccagatctttttgtgttcattccagaagctgcacagtttctagagacttgtcttttcacaggaaatatcctactcagaaatagtgtatttggcaggggactattctcc

SEQ ID NO: 9900 - DNA, 201 bp, Homo sapiens
tcttttcccttatctcccttcaattcttttcttcctccccatcattgttgccctctttgcctttggcccctatcttttaccatattttcttttcttcttctttttttttttttttgatggagtcttgctctgttgcccaggctggagtgcagtggcatgatctcagctcactgcaacctctgcctcccggtttcaagcaat

SEQ ID NO: 9901 - DNA, 201 bp, Homo sapiens
tttgaacaatttaaaaattattgtgacttaaaggaatcgatatctaatgatagaattctagttcctggcttactggtatgggagacagttttgtctggggvcagtcccatcttggtatcacactttgtaattttctgagcatttgaccttttcttcatgtggtctttgtcaacctacttgtaaggccagcctgcctataaa

SEQ ID NO: 9902 - DNA, 201 bp, Homo sapiens
cctaagggagactggtcatccagccaggtgtagggtaaaggaattattgggaaatatacagtaagggaggcctgtgaggtcagtaccttgagggatttgtrctgtgacttccaagtccaaattcaacagagatttagtgcgtgcctactgtgtgccagacaccattctaggaattgaggatgtatcagagaataagatgaa

SEQ ID NO: 9903 - DNA, 201 bp, Homo sapiens
gacctcactgaggatatgatatttggatatttgaatgatgatgacatagggagggacctacagattaggaattagagtgggaagtggttgaggtgtgtgtkgggggcatattttataagcctttgatggcttctgtgaggactctggtttctactctgagagaatggggagtcaacagagggttctgtgtagagaatctct

SEQ ID NO: 9904 - DNA, 201 bp, Homo sapiens
aagcctttgatggcttctgtgaggactctggtttctactctgagagaatggggagtcaacagagggttctgtgtagagaatctctcttgtattttaatagkatccctctggctgcagcagggccatttgggaggctcctgccgtaatccaggtgagagattgaggaggtgggtgttgggctagagtggctgcagtggacgg

SEQ ID NO: 9905 - DNA, 201 bp, Homo sapiens
tccctgttggagtaagagggacactgagcttacctattgtagaaaagctgcctttttaatgattctgtaaacacttattgaaacacctactagggctggayggagcagtggaaatttttgccaacattatatcctcagagcaaccccaggagtttggaccagagaatcgctctccatgaaggaaacaggaatggggaggtg

SEQ ID NO: 9906 - DNA, 201 bp, Homo sapiens
cattatatcctcagagcaaccccaggagtttggaccagagaatcgctctccatgaaggaaacaggaatggggaggtggattgaaggtgggtacaggggatrcccctcacttcataaatgaggggaggcgtcatcccaggctctcaccccaaggccactcttctctagtttcaagcccacccttaccccatgaattcctgat

SEQ ID NO: 9907 - DNA, 201 bp, Homo sapiens
actttggatcatctgtatgtttatagcacaggtcctctctgattttctagaatttctaattttttagaattttctagaatttagtctaagcccctttctawtttttttgtattttctagaattcagtgcccagacttttttctgagcacgcctggtgtctgcctcagtggtgtcttaaggtgcgaaataataactagcagt

SEQ ID NO: 9908 - DNA, 201 bp, Homo sapiens
ggggaggcagcaggcatgccttcacagtaatggacatgtatggaggtggagagcaaagagccaaatggaagagggaggtgcagtttccctgactgtacagrgggaattacatgacctccctgcctttaaccttgagctcagggataccacttattttcacaccatccaaattctagcattctggagcaaagagctgctcac

SEQ ID NO: 9909 - DNA, 201 bp, Homo sapiens
gtggctatgtgcctgtgcatagggcttgctctggggtttcaaaggctgtctcaccctgtgtgttaggcagagcactggatattttctctaagcactgaagrtctaaatgaaatttagctttctcaaacatcctaattatttctacattcctaaagctctgagaaggccgtatatatagtactgatattgttctcccaggtg

SEQ ID NO: 9910 - DNA, 201 bp, Homo sapiens
gtctaagatcctgagggtcatgactgactcagcttaggctgtcatggcactgagtgacttcagagtacccagtgggaaggtgggctggaggtacatggatsgggggatggagaatggggtgtgagtattgtgtatttctctcttccctttggtgtttaggttgttattgctaggagtgagccaggtctttctgtcctcaaa

SEQ ID NO: 9911 - DNA, 201 bp, Homo sapiens
tgagaggttgtgtgacttgcccaaggtggtggaggtggttaggctgagcctcggatctaggctcctgactttgatttattggctttttgtattggaccaamctacctctcaacaaaaggggaatattatggcctcattgggtctgcagtcctctgtggtcaaacaagttgctcttcttacctgagaaggacagataagggc

SEQ ID NO: 9912 - DNA, 201 bp, Homo sapiens
cgggtttctgggagagaatcatgccttggaaatatccgttcatcaaaagcatagtttgcatctgcaagcccgaagggaaactgagaaaaccagccaccaayttggcaggcaacagaattgtctcctccaagatagtgagtggaggagagaaggctgccttttcccaagaggaccagtccagcccttgttaggccatctccg

SEQ ID NO: 9913 - DNA, 201 bp, Homo sapiens
gttctgtacttttagggaggcattgttatagggaatacaagcacagggttgggaagtgcttgctagggccacatttcgtggccctctgtaattaggtgccragattgccgagggtgacattagtggagatggtgatggtaataataatagttattataaataaccactaacatttcttgggtgcttacatatatgtcaggt

SEQ ID NO: 9914 - DNA, 201 bp, Homo sapiens
acaagcacagggttgggaagtgcttgctagggccacatttcgtggccctctgtaattaggtgccgagattgccgagggtgacattagtggagatggtgatrgtaataataatagttattataaataaccactaacatttcttgggtgcttacatatatgtcaggtaaattgtatgtttcacattcattatctgattaaatg

SEQ ID NO: 9915 - DNA, 201 bp, Homo sapiens
tgtgtttttgataggatattttacttcactgagcctgtttgctcatatgcttaaaaacagggggtggttaataacactttagattgttcatttctttatcyactccccctgcctcccactttttgccacagtcataattatttcattctgcagggtgattctctaccatcagagaaagtttggcatagttcagtcgttctc

SEQ ID NO: 9916 - DNA, 201 bp, Homo sapiens
tggttaataacactttagattgttcatttctttatccactccccctgcctcccactttttgccacagtcataattatttcattctgcagggtgattctctrccatcagagaaagtttggcatagttcagtcgttctcaaagtttggctaccagactagccacaactgggaactgttagaaaagcaaatttcttgagcctca

SEQ ID NO: 9917 - DNA, 201 bp, Homo sapiens
ccatcagagaaagtttggcatagttcagtcgttctcaaagtttggctaccagactagccacaactgggaactgttagaaaagcaaatttcttgagcctcaycctagatctactgaatcagcaaatctagaggtggggtccaacaatctgttgcatggtaaggcttgagaaccatgagtataatgaaaagagcttggggtct

SEQ ID NO: 9918 - DNA, 201 bp, Homo sapiens
caactgggaactgttagaaaagcaaatttcttgagcctcaccctagatctactgaatcagcaaatctagaggtggggtccaacaatctgttgcatggtaargcttgagaaccatgagtataatgaaaagagcttggggtcttaaatcaacacaaccaagttgaattttgcttctgccatttgggtgatgcttacatcaaca

SEQ ID NO: 9919 - DNA, 201 bp, Homo sapiens
gggtccaacaatctgttgcatggtaaggcttgagaaccatgagtataatgaaaagagcttggggtcttaaatcaacacaaccaagttgaattttgcttctrccatttgggtgatgcttacatcaacaccacactataaactttttgagcctttgtttcctcttctctaatatggaatatcataatctcacagttctatcta

SEQ ID NO: 9920 - DNA, 201 bp, Homo sapiens
ggcaggccactatctttagagtactttcaaatgattttatttaattcttacaccagttctgtgaaatagaattttaagggagctttgagtttcagagtgtkaatgacttgcctgagttgccactgcaagagtgtgtgacaaagctaaggcttaaattcagtctcaattaaaaatctggtgcttcctctagatcactctggt

SEQ ID NO: 9921 - DNA, 201 bp, Homo sapiens
acttctggctttatcacttggcaaaaaagcacttgttaaaaatgcacacacatgtgggtttgccctcttcatggttcagcaccagaatttaagcagctggyggacaagacttatccttggaacaacatccaacattcctaccctagggcatattggagtctctcaaccaatgagggcccacaaataaagcagtcagcattt

SEQ ID NO: 9922 - DNA, 201 bp, Homo sapiens
tgggataagggagggcatgcacatgcgcatgtgtgtgtgtacatgtgtgtgcctgtgtgtgggtacatgcctgtggcccacacttggggggcagctgttayatttgctgcttaggtattcatagccaattgttttaactgttccttgctttattagcttttgccaagtagttcagcttttactaagggcacccgggtttat

SEQ ID NO: 9923 - DNA, 201 bp, Homo sapiens
acaaaggggcaggggcttaactgtgggacttagggagagatttcctctctctcctcccctctcttttattaccacttctcagtctcgatggatatagcaarccaattggtttcccttatgggttataaagaggaacccgttttgggatgttgagggatctgggaaataagtctcctggcaatttctgagatttcctctctt

SEQ ID NO: 9924 - DNA, 201 bp, Homo sapiens
aattggtttcccttatgggttataaagaggaacccgttttgggatgttgagggatctgggaaataagtctcctggcaatttctgagatttcctctcttctycctggttacatccaggcacctgctgggcaaaccggctgccacttgttgcaaaaaatgttgacaataccgagggaaactgagacttgaaagaactggaggg

SEQ ID NO: 9925 - DNA, 201 bp, Homo sapiens
gctctgaagggcctggggcagatgtgtcagggacttctgagaagatggggttgttttcaaatgggaaggccattaaaggctttgggacacttgggaggctragaggggatgctcaggagagggaaaggccatgggtgctggctcagcaacagggatctgaaactgctgatgctctattgagacctgaagcacgggtgatgg

SEQ ID NO: 9926 - DNA, 201 bp, Homo sapiens
ggatctgaaactgctgatgctctattgagacctgaagcacgggtgatggggaaaagcaggcatcttctgatgcatgattctcccagcaaccagaaggcccyacaacctctggctgatctctgactacagtcttgactgcggctcttgcccatcctagggtcactggaatcagatgtccatcttcccaactccagaaggttg

SEQ ID NO: 9927 - DNA, 201 bp, Homo sapiens
actccttgaaacagttgcagtggccctgtggaatagggggcaggtattagggcccccattttctgggtgaggaaacaggatcagggaagttaaatggcttmcattcacacagagaacacaatacaactggggtgagatgagctcttctgacttctcaatctgtgatccttctaacaccccaccttacccaggggagccttg

SEQ ID NO: 9928 - DNA, 201 bp, Homo sapiens
gcaggagcaggtggcatgtgggcagaggcttgtccactaaatgtggaaagaaaagcagtcatgtttttacgtgcagggaaggaatgaggactttgctgacrgcaaagggtgatggatggtgtgggagactgcatggggcgtgagtagtaatgtgatagagggtgcacattacaggcaattacaatttgaataagttatcaa

SEQ ID NO: 9929 - DNA, 201 bp, Homo sapiens
accccctgaagttacgttcacagcattttgaaaaagtttatgaattgccgtcaattacaatcccggcgacaaatgcggatgctgggagaatccctgattgyagcttctgtagcaggcaatgttttatggggacaatttaaaacaacagtcttatgtattttaaaacagcaaaggaggaagaaaaaggaagtgctcagggag

SEQ ID NO: 9930 - DNA, 201 bp, Homo sapiens
tcggaagtcagttgagcccaggtgtgcatggcatcaaagctcatgtttttcaccacaccaggtcctctgtgttttctcagatacagaactattcattaccrtcacctgggaacagcttggaaatgctaattcttggctcagcctacacctatgcattcagaggctacggttaacaagattcccaggggattcctatacaca

SEQ ID NO: 9931 - DNA, 201 bp, Homo sapiens
ccatttatcttcttccacaatttctcccacatgttcattttaaagtagctctctatctaaatgctttaggataaatctggattgtgtgtcactcattttarctttcaattacatgcggtctagttataggctttcagttgcttcatgtcttagtattatttctccagcaggactgtaagctccttgaagacaaaagatatg

SEQ ID NO: 9932 - DNA, 201 bp, Homo sapiens
gaggcaggagaattgcttgaaccagggaggcggaggttgcagtgagccgaggtcatgccattgcactgcagcctggacaacaagagcggaacttcatctcaaaaaaaaaaaaaaattgttagaaaagggttctctgggaggctggagaaagagccctgaatgcaggctaggatgaccaggaaagattgctgagcccaatgc

SEQ ID NO: 9933 - DNA, 201 bp, Homo sapiens
gctggagaaagagccctgaatgcaggctaggatgaccaggaaagattgctgagcccaatgctgaaggacaaatagtaaggggagggggaaagggcaccccmacaaaagcatgtaggagttggggctttggggcagtgaatgtggccagagcagggtatgcgtgggagacaggcagggactggtatttggggccaaagaggg

SEQ ID NO: 9934 - DNA, 201 bp, Homo sapiens
taagacagttagatttgcattttttaaacaatttaaaaaagatttatgtttcagaaaaatcaccctggtaacaatgtagaggtggaaacatgaggcagggrgctcattaatgacctgtatgagaagggatgaaagtctgagctcaggcagtgagatggagggaacaatgtagacatatttagggtgtgagggtttctatac

SEQ ID NO: 9935 - DNA, 201 bp, Homo sapiens
tgaggcagggagctcattaatgacctgtatgagaagggatgaaagtctgagctcaggcagtgagatggagggaacaatgtagacatatttagggtgtgagrgtttctatacaatgtgagagcattatatgcttttctttccttgcttctgaaaacattaaaatagaaaaatctggagaataatacaaacccctaaaacccc

SEQ ID NO: 9936 - DNA, 201 bp, Homo sapiens
tttacagttattagcttttgcaaacatttcagtttttgcatacatgaatgaggacctttctaggatatatactagaaatggaatttttagtcttaaggaawacatattttcaaatttattacatactgccgaagactttctgaagtgattgtaccaactaaaattcccaccaatagtagacgttctctttctccatgtctt

SEQ ID NO: 9937 - DNA, 201 bp, Homo sapiens
gaattctttattattctggataaccactcctttcactggaaaggattatataatatctttcccagtgtatctcttgtcatttaactttttggtatttttcttttttttttttttttgccaaaaagaggttttaacattttgatgttggcaaatttattaatttggctctccataggttgtattttttatgccttattaaaa

SEQ ID NO: 9938 - DNA, 201 bp, Homo sapiens
aattctttattattctggataaccactcctttcactggaaaggattatataatatctttcccagtgtatctcttgtcatttaactttttggtatttttcttttttttttttttttgccaaaaagaggttttaacattttgatgttggcaaatttattaatttggctctccataggttgtattttttatgccttattaaaaa

SEQ ID NO: 9939 - DNA, 201 bp, Homo sapiens
catggatttttattcttatagatgaggaaaccggactggagagaggctgagtagctggtgcaagttataatgctaaggaaagtcagggaaagcacaagacmccacgtctctggttcccacacacgttcacttttcactgcagtgctctctttgactggggtgtcttagagtccatttgggctactaaaacaaaataccgta

SEQ ID NO: 9940 - DNA, 201 bp, Homo sapiens
tacatgattggtaaggagagttgaggcattcagagaatcatataaccgtaataggaaaagggctagctccagctgcttccagcactaggcaacagttgagytccttcattcattgtagcattcaggtttgttccatttgtggtggaagttggctaagtctgagggcaactttaaactttcctttaaaggcagcctcagaga

SEQ ID NO: 9941 - DNA, 201 bp, Homo sapiens
atgattggtaaggagagttgaggcattcagagaatcatataaccgtaataggaaaagggctagctccagctgcttccagcactaggcaacagttgagctcyttcattcattgtagcattcaggtttgttccatttgtggtggaagttggctaagtctgagggcaactttaaactttcctttaaaggcagcctcagagacag

SEQ ID NO: 9942 - DNA, 201 bp, Homo sapiens
acaacagcaataataatagcaatagctaacttagattgagtgtgtatgatatgacagcatcctacatcatcttcttcagtcttagagcaaggtatggttgyactacatctcatatatcccatagaaaggctgcagagagagagagtctctgctcagttctcaagtcaggtgagttgagggggttgagaatataggacagaa

SEQ ID NO: 9943 - DNA, 201 bp, Homo sapiens
tggttttgttttagggatatggttcatggctatcagctagatccaagctcactgttttccctaggaacagtacacatgactttggacttggtaagcagctyttaagaccctctaaaatgatgaaaagatgctatattcacatgaaggattgtggtagtgggggatactgttgagggacacgttttggttgtttcttcaaga

SEQ ID NO: 9944 - DNA, 201 bp, Homo sapiens
tatcacttctgctcatattctattggctagaactcagtcatgagctcattctcaactgcagggaaagccgggacatgttgaccggctatgagtccagtagrtaaagaaaaactgtttggagaacaatttgccagtcttgatcagagtggaagatgaaaaaaatgtggagactaatttgctcatatgaggttgaaaactcaa

SEQ ID NO: 9945 - DNA, 201 bp, Homo sapiens
tctattatatgccaggcactcttcttggctctggagatgtagcagtgaacaaaacagatacaaatttctaccaagaatcttatgtttgagagggtaccccraatgaaagaggagcaaccaagagtggagaaaagcgtaaaatataatgtttgggaaagttgctttgatttgaaccaagtggcttaaaactatgaactcaga

SEQ ID NO: 9946 - DNA, 201 bp, Homo sapiens
tttgtccttagaaaaaagcatatttattttctttctttttttttaaaacaaggatatccacattttattgttttccttttatctgattctgaaaaaaaaawatttaccagaactatgtattttttcctgtggatataatcatcaggctaatccctacgatgactaaaagttgtggtggttgcatggtcaccaacttctctc

SEQ ID NO: 9947 - DNA, 201 bp, Homo sapiens
gacctgtctgtaatgagcttttagcttgcatctgaaggagtctgctaacttgagctaccagaataatatttgccatattctttttaaaaaatattggtttytattttgtgctttaattcagtgttaagtgagttgttgacttttttggtttgtttaaaaaagaagttaaacagttggaatcccatgtaggcataaaagtgg

SEQ ID NO: 9948 - DNA, 201 bp, Homo sapiens
ataagtaagggttagagagagcatattaagttatacctgggagtttatagttctttaaatcttgtcaaactgtattattcttttaaatatgtcatatgacrgtttataattattgtgaatactttaaaaagctggtggtgaatacgttacaggtggatcacacctgtaatcccagcactttgggaggctgaggcaggtgga

SEQ ID NO: 9949 - DNA, 201 bp, Homo sapiens
actcccaaggaaccctaaaaaggataaacctacatggttcagtgttagtgaaaattctttttttaaaaatttttgctggttcaacttcttcctccttgatmcacacacacacacacacacacacacacacacactcattctcctaaagataatatcatctctgctagatccattctttgagatttgtgatacagcactgaa

SEQ ID NO: 9950 - DNA, 201 bp, Homo sapiens
taattggtaataaattgatataggaaatcagcaaggataaatgtatgagtctgctagggatgctgtaacataatgtcacacacagagtggcttaaacaatstaaatttatttctcacaagataatgtggaagctgaaagtccaagagagaggtgtcagaagtttggtttattctgctgaggcctctctctttggcttgctt

SEQ ID NO: 9951 - DNA, 201 bp, Homo sapiens
gaaattgaattcataatttaaaaactcccacaaaagaaacttctaggcccagatgattgtactgagaattctaccaaacagcagagttgacactaattgcmtataagctcttctagaaaatagaaaaggagaaatctcttccctatttattttatgaagttagtattactctgatacccaaaaccagacaaagatagtaca

SEQ ID NO: 9952 - DNA, 201 bp, Homo sapiens
catatcatgacttggaagactcaaaatagtagagatttcaattctccctgaattgatatccaggttgtaatgagttgagtttggcccctcaaaagatgtgyttacagcttgcagtgagccgagattgcgccactgcagtccgcagtccggcctgggcgacagagcgagactccgtctcaaaaaaaaaaaaaaaaaaaaaag

SEQ ID NO: 9953 - DNA, 201 bp, Homo sapiens
tgtaatgagttgagtttggcccctcaaaagatgtgtttacagcttgcagtgagccgagattgcgccactgcagtccgcagtccggcctgggcgacagagcragactccgtctcaaaaaaaaaaaaaaaaaaaaaagatgtgtttacatcttaatccctggaatctgtgaatgctaccttacttggaaaaagagtctttgca

SEQ ID NO: 9954 - DNA, 201 bp, Homo sapiens
aagaatcttgacatgaggagatcatcctggattatctgggtgggcataaatccaatgacaagttttcttacaggatacacacacacaggagtacacagacrcaaaggagaaggcaatgtgaagacagagcagagggaaatgcagccacaagccaagaaatgttaccagtgccagaagctggaggaattaagaaaagattct

SEQ ID NO: 9955 - DNA, 201 bp, Homo sapiens
cagtcctggtcatttatcccagggaaatgacagtattacaaaatcgtgtacacaaaatcctatacaagaatgtctataggagattatattataatagcccyaaactggagataacccagatatccatcaatgagtgaatggttaaacaaaccatggtacatctatactttggaatacttgccagtaatcaaaagggttaaa

SEQ ID NO: 9956 - DNA, 201 bp, Homo sapiens
atataaaagagtgaacaggttagtggtttccactgtctaggcctggggagagggaagaatgtgtgcggctgtgaaaggacaacttgaagggttcttgtgayggaaatttcctgtatcttgatggtatcaacatcaatattctgcttgtgatattgtactataggtttcacaagatgttactactgggggagactggataaa

SEQ ID NO: 9957 - DNA, 201 bp, Homo sapiens
gatacatgaacttaagcgtctttagtttttttgagttctattcctgacttggcaactaatgaattagccactcattggggtgtaactttccttaccagtaraatggggctcataatgtctaccttgagagcagataggatggagagtgatgcctgatgcatagaaggtactcagtaagtgttaatccttgcctttgcccaa

SEQ ID NO: 9958 - DNA, 201 bp, Homo sapiens
gcttactttcataaaatgaagttttatttagatacccaagatgtaaaacatgaaaaatgtagacccactataactgggggagttcttgagggtggaaagagagaaccctgctcagccttcctattctgccccctccccagattcccttgcctttgctactggctttcccagccttggaagctactggggtacgttaaggat

SEQ ID NO: 9959 - DNA, 201 bp, Homo sapiens
gtataacaaatgtcaataaaatgacattttatacttcaagtcatttctaatttaatattgaaggaaataatgatttacttaatttggagaatgtctttcaycctcataaaaaaagtaccaaagtatttgatttttttgggttagcatcatgatttcttttttgagttatgctgggaaccaggttatagggcagaagatggt

SEQ ID NO: 9960 - DNA, 201 bp, Homo sapiens
ctgatgcttgtgtcagtattacactgttttagttattgtagctttacagtaaagattaacaccgggtacggcaagtcctcctttattattatttatttttrtgcatactattttaaaactgtaagtgcttattgggctataccagtaagtatctagagcagtggtttttaagctcctaatttggcccactacctatttttg

SEQ ID NO: 9961 - DNA, 201 bp, Homo sapiens
tgaaaggcaacaatgtttactaagaaggttaattcttcaagtgtgaaggtgtatctaaaagttccttcatgaccttttttgtggcaggtgtggctatgtgytcatgggctactaaagcgaggcttcaacagactttttaaaaattggataaccatatctctctaaggatagaccatttcccacagagaccactcactcaag

SEQ ID NO: 9962 - DNA, 201 bp, Homo sapiens
ggattgctgtaactagtcagggctccatgagaggctggcaggaacacctaaaaagttgctaatatgtgcacacatgaacacatacacccaatgaagagaargaaaacagaaaagcaaaggaattattttaaaagtcatatatattttctcatataatctcagaatgatatagagaaaaatgtattgggtgttggcttctat

SEQ ID NO: 9963 - DNA, 201 bp, Homo sapiens
tttcttgagacttcctttttgacttatatattatttagaaatgtcttatttaatttacaactgtttacttgtttttgttgttgttgttgtttcatttggtytaatgttggttggcacatgcactgcatatgatttcaattattttgattttgttgaggtttgttttgtggtccaggatgtggactatcttggaaaaaaatg

SEQ ID NO: 9964 - DNA, 201 bp, Homo sapiens
gccatgcctcctttgtcctcttcctcttggacttcattacagaaatgttacaccttttgctatagtccacagaccctgtggctccattcaccttcttctcttttcttgctgctgtttagattgggtaatgtctatcttccaattaattgatttttctccccctctgtgtcctccattctgctgttgtgcccattcactgcg

SEQ ID NO: 9965 - DNA, 201 bp, Homo sapiens
agatgtgggaccacactctttctgtgatgtttggctggagtatggaaattgctttgtgaaagttttttgtcttcctggttctttgactagagatagcaggscttctatggggctttttgtcacattaccaatttattcaatacttagtctgagatatgcgatacaaaacaaaaacacagaaaacttattgctgtgtcattc

SEQ ID NO: 9966 - DNA, 201 bp, Homo sapiens
agctctcagactcagtgcatgagaattttccatttctctgtcttctaatttcttcttctgtttaacctttttaaataccagcctctaactactctgctctrcccttccatactcaatgtctaactgctgcctggtgaatttgtggttagttggcccttaataactagtgatgcattggctatttttgacagtaatttttat

SEQ ID NO: 9967 - DNA, 201 bp, Homo sapiens
actgtaaaacattttacttcattctattagaaatattgaaaggggatgatgcagccatggcagaaaaaggcattattcccctttaagagaaatttctctcmgacatagaaaaaatacagcagtctcctattatgagttgaccttggagccaagaagtagtagttattccctccatccattccattactaatacagcaggca

SEQ ID NO: 9968 - DNA, 201 bp, Homo sapiens
gttgaccttggagccaagaagtagtagttattccctccatccattccattactaatacagcaggcaaaagtcagaaagattagtttcaaaatttctataamctcgaagtaaagtttcagctgtcttcctttatctgacagtgtttttactggtggtacttttaagacttaaaccaaccataggcaactattttctcttctt

SEQ ID NO: 9969 - DNA, 201 bp, Homo sapiens
taggcaactattttctcttcttgagctttatgggcatcttttatagaaactttacctagctgtcagtctattaactcccaagtatttagtttgattcatcrgattgcggatatttctaaaaggtaccgcaaaaatacatgggcctgagaatcctcaagggggttggattccagtgagctagtgaaggatcttcaaggtgtt

SEQ ID NO: 9970 - DNA, 201 bp, Homo sapiens
tggggtcccaaaatgccactttttattttttttgggatggcgtctttctctgttgcccaggctggagtgcaatagcgtgatcttggctcactgcagccacygcctcctgggttcaagtgattctcctgcctcagcctcctgagtagctggaattacaggcacccgccaccatgcctgactaatttttgtatttttagtaga

SEQ ID NO: 9971 - DNA, 201 bp, Homo sapiens
ctgtgcctcattcaattcactgcttggatcagagtgaatactcaataaatgtacaatgattaaatgttagtatcaaaatacatacttttgggataagctcrgattgatattctgggttctgcttagaatgataagatggagtaataagggagagtaatgttgattggtagataattatgaagaaatgagttctgttaaata

SEQ ID NO: 9972 - DNA, 201 bp, Homo sapiens
cctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcga

SEQ ID NO: 9973 - DNA, 201 bp, Homo sapiens
cacatctgtaagaaaagacattcaggaaagacttttacaagacagtgcatgctaagggctaggaagtttggtgagagatggctcccatggagaagtagaamttaagatgggcttcgaagcatgagcagatgacaaaaaagcccaatccaaactggcttaaacagcaagggggtggttattggctcatgtgattgagaagat

SEQ ID NO: 9974 - DNA, 201 bp, Homo sapiens
atcccattagtcaacgaagtcgtattgattttatatccaaattcctcttaaacccacaccatcttgttcatccccatgttccagtgctgctcctccctcaytggactcttataattgctgctttactgtgcatgggatatgagaggtcctccataaatagcatttgaacaaatgcagaatgagataataacacaagtgaaa

SEQ ID NO: 9975 - DNA, 201 bp, Homo sapiens
gctcacaacctggatgatgatgccaattctaagactaacaagaacaggtactagcgtagatggtggtttctatatgctaggtaccattctatgtgctttaygtgctgaagtcattgcattatcacaacaagcctataagactcttaaccctgttttacaggtgaggaaactgggacactgtcttgttaagtgtcttgcctg

SEQ ID NO: 9976 - DNA, 201 bp, Homo sapiens
aacctggatgatgatgccaattctaagactaacaagaacaggtactagcgtagatggtggtttctatatgctaggtaccattctatgtgctttacgtgctsaagtcattgcattatcacaacaagcctataagactcttaaccctgttttacaggtgaggaaactgggacactgtcttgttaagtgtcttgcctgaagtca

SEQ ID NO: 9977 - DNA, 201 bp, Homo sapiens
ttagcttaggccaatgggtataagaataaatgaaagtggagaaccagtaagtctctgaggaaattcagtttacgctggagaatggtagtgacatcttcaawggaagcttcttgagtgacctatgttatagctctgttagatggcgtggtccctccagggctaacagcatctataatacgtatgtttccttattctcctcct

SEQ ID NO: 9978 - DNA, 201 bp, Homo sapiens
agaatggtagtgacatcttcaaaggaagcttcttgagtgacctatgttatagctctgttagatggcgtggtccctccagggctaacagcatctataatacstatgtttccttattctcctccttacctatcagtatgtctgctctatgctcaggagtattccacagtggctcagtggcatgaataataggaaataatgtct

SEQ ID NO: 9979 - DNA, 201 bp, Homo sapiens
gcttttgaattagtattttgagcagttgcatcaaatcacagaacagtggaggggttctgattaagctgagcctttccctgctgcagcacaggccctgggtragggccatttgtattaggatccctgccttgcccctgactagccagatcactttggtctctgacctcagtgtcctgattagtccacatggggataataata

SEQ ID NO: 9980 - DNA, 201 bp, Homo sapiens
ttttgcaatttaaaacatcacttccatgcatggctgtctctggaagggtataggcccagaggacctcatctggtgatggggaagccccctaaattgctcakacgtatacatgtaaaatcaaaatccaccagtgcagttctccctgcacctccccctatccaagcatggggccagggtggctgccagattgttttttccaag

SEQ ID NO: 9981 - DNA, 201 bp, Homo sapiens
tcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgcca

SEQ ID NO: 9982 - DNA, 201 bp, Homo sapiens
cccagccaacataatggcaggtactgtgagagggaaataacttgtggtgtactaaggcacttgaaatttggaggtgtttttttactgttctgtaacttcayctacattgattgatacgcacattgttttatccaagataataataactaatagtacttgggcatttgctatgtgccaggtgagtattggttcacattttgc

SEQ ID NO: 9983 - DNA, 201 bp, Homo sapiens
ctgcatcccctgtagtttcatttggaagtgatttcctttgttggccattactcttcagagtggtggtgaggttgggaagccagcagagtggcctgctgtgrgtattgaatgctgatgttgtcataggaagtctctcatttgctttgctttgcttgactactttttggtttttaacctgttatttaagccaaagtatttgat

SEQ ID NO: 9984 - DNA, 201 bp, Homo sapiens
ttggccattactcttcagagtggtggtgaggttgggaagccagcagagtggcctgctgtgggtattgaatgctgatgttgtcataggaagtctctcatttkctttgctttgcttgactactttttggtttttaacctgttatttaagccaaagtatttgatatgggaacaggaagcctcttaagggtaaggaaggcatttt

SEQ ID NO: 9985 - DNA, 201 bp, Homo sapiens
gggaagctaagcaaagatgtggtatagctgaggtctagctcagcctgatccacagaggagctgagcatgacttgtgacacagagtttgctctgcattgagrcaacagggctaagtttgtttgtttgtttttttggacagagttttactcttgttgcccaggctggagtgcaatggcataatcttggctcaccacaacctcc

SEQ ID NO: 9986 - DNA, 201 bp, Homo sapiens
agggaccctgtgggaggtaactgaatcatgggggcaggtttttgccatgctgtttttgtgacagtgagtaagtcttatgagatctagtcgttttataaaaragagttcccctgcacatgccctcttgcctgtcagcatgtaagacatgcctttgctcttcctttgccttctgccatgatagtgaggcctccccagccatgt

SEQ ID NO: 9987 - DNA, 201 bp, Homo sapiens
gcctagcaattctattaggtgaatgacaagtgctttgtaatgaaacagaaggactttatttaaacagatataaggactggacagaaatcaggcttaaattrtaccttatctgggctcctgctttaactttgtaactggtcttaccacttgtggtctcaagactattttgtcctgcagcccccagagcaatctccctgaaat

SEQ ID NO: 9988 - DNA, 201 bp, Homo sapiens
atgacaagtgctttgtaatgaaacagaaggactttatttaaacagatataaggactggacagaaatcaggcttaaattataccttatctgggctcctgctktaactttgtaactggtcttaccacttgtggtctcaagactattttgtcctgcagcccccagagcaatctccctgaaatgcaaggtcaactatgctggccc

SEQ ID NO: 9989 - DNA, 201 bp, Homo sapiens
aagtgctttgtaatgaaacagaaggactttatttaaacagatataaggactggacagaaatcaggcttaaattataccttatctgggctcctgctttaacyttgtaactggtcttaccacttgtggtctcaagactattttgtcctgcagcccccagagcaatctccctgaaatgcaaggtcaactatgctggcccccggc

SEQ ID NO: 9990 - DNA, 201 bp, Homo sapiens
cctcctgagtagctgggattacaggtgcttgcctctaccacctggctaatttttgtatttttagtagagatggggtttcaccatgttggccaggcttctcrgcctccctgagttctgggattacaggcatgagccaccatgcctggccatagtccaacttttaaattttggtttaggaagtgttttttatcccatcaatcc

SEQ ID NO: 9991 - DNA, 201 bp, Homo sapiens
agtgaagaggatgttatagagagggatgcaataaaatttatctttttcatcatgttcctcatctgggttaccatgaaactaatgtgaacagtttccagctmcaggcaaaacatttacactcctcacctttcagtgctatcatttgttgcatttgggaacaaatgtgcagcttcagggtgagaatggaagaatatataggca

SEQ ID NO: 9992 - DNA, 201 bp, Homo sapiens
gccttagctacagctgattcttttctcttagtaaaaacattgataagtttaccaagaccccttgcatgttccctgtctccacatgtgctagaaagtattaygttggtgcaaaagtaattgtaccaataatgcatctgcatttattaagtgtcctttaatgcccacttcactgtagcagtccagttagggactattagcaag

SEQ ID NO: 9993 - DNA, 201 bp, Homo sapiens
aattattttatcccattgttctcaactttaaaatcactgatgcttgagtcttgtcttggagcaatccatccatctgtggggtgaaccctgggaattagtayttttagaggcactcttctagcgttactatggctaaatgtttccaccagtctggctaaaacttctcatttcatggatggaaaaagtgagactcaaagaggc

SEQ ID NO: 9994 - DNA, 201 bp, Homo sapiens
ctcatttcatggatggaaaaagtgagactcaaagaggctaagtgactttcataaaagcagacttgcagggacaaagccagcacctaaggttttataaatastagtccagtgctcttgttcagacaccacattccttctcatcttgtttcctcagatttatagccaaaaacaatgggaccatcagggacccaccttaggacc

SEQ ID NO: 9995 - DNA, 201 bp, Homo sapiens
cagccattacatgaattttctcattattttcttacaacattccttggaggtaagtattattattatccccactttgcagatgaggaatctaaggctcatakgtcagtaagccagtaaaaggcagagttgggatttgaacccaaggctacactctttccgtggccaggattttaaccggggtattcagtactggtgccatta

SEQ ID NO: 9996 - DNA, 201 bp, Homo sapiens
gtatattcctcagtgcaaccacacaaggtgaatactgttattatccttgctttacagatcaggaaactgaggcacaaggaggaaaataatcatgccaaagwactatcaatgagcagattggggattttattccagcagtttactctacagcagctctgtccagtggaaatttcagtgatgatggaaatgttttgaatcctt

SEQ ID NO: 9997 - DNA, 201 bp, Homo sapiens
tgttcaattagacttttggggtcagagacctgggaatctgcattttaataaatttcccaggtgatttttcatgaacaccttaactaataataaatcaattwaaaaatttaacggtaagagaagtagaaggagagaccaggttttcagatgtagaagataccctggagagtagggttattctgcaaacagacttaattttag

SEQ ID NO: 9998 - DNA, 201 bp, Homo sapiens
atgaacaccttaactaataataaatcaattaaaaaatttaacggtaagagaagtagaaggagagaccaggttttcagatgtagaagataccctggagagtrgggttattctgcaaacagacttaattttagaaagatctttctggtggctggtgttgaagatggacttgataaagaacgtcctgggggtagatgtggggtg

SEQ ID NO: 9999 - DNA, 201 bp, Homo sapiens
ttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagagg

SEQ ID NO: 10000 - DNA, 201 bp, Homo sapiens
acttttaaaaacctatcactaactttctttttctagcgtactatgctgtcttcatgttgccttctttgcgtgtacttcatttctttttctttcttcatccrgctttctcttaccttcttatcatctgtcattgcattcatttattccttcttccactgtcctaaatctcatcaccttcttattctgttccttatcctagcc

SEQ ID NO: 10001 - DNA, 201 bp, Homo sapiens
ctgcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgct

SEQ ID NO: 10002 - DNA, 201 bp, Homo sapiens
tgcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgctt

SEQ ID NO: 10003 - DNA, 201 bp, Homo sapiens
gcaggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgcttc

SEQ ID NO: 10004 - DNA, 201 bp, Homo sapiens
caggatttctttccctttctctctctctttctctctttctttctttctttctttctttctttctttctttctttctttctttctttctttctttttctctttctttctttctttctttccttctttcgttcgttcattcctccttccttccttccttcctctctccctcccttcctcccttcccttcccttccttgcttcc

SEQ ID NO: 10005 - DNA, 201 bp, Homo sapiens
ctccccagatttgattgatttgctagagaaactcacagaacttaggggaacgctttatttacatctacccatttattataaaggatattacaaagaatacktatcaacagccaaatgaaagagatgcagagtgggaggtaggtggggaggggtttggcgcttccacgccctctccagcacaccaccctccaggaacctcga

SEQ ID NO: 10006 - DNA, 201 bp, Homo sapiens
attgatttgctagagaaactcacagaacttaggggaacgctttatttacatctacccatttattataaaggatattacaaagaatacgtatcaacagccaratgaaagagatgcagagtgggaggtaggtggggaggggtttggcgcttccacgccctctccagcacaccaccctccaggaacctcgacatgtccagctgt

SEQ ID NO: 10007 - DNA, 201 bp, Homo sapiens
tacccatttattataaaggatattacaaagaatacgtatcaacagccaaatgaaagagatgcagagtgggaggtaggtggggaggggtttggcgcttccaygccctctccagcacaccaccctccaggaacctcgacatgtccagctgtctggaagatctctgaaccctgtcttttggggtttttgtggaggcttcattac

SEQ ID NO: 10008 - DNA, 201 bp, Homo sapiens
ttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttc

SEQ ID NO: 10009 - DNA, 201 bp, Homo sapiens
gtgtgcatgtgttcgcatgcaactgtgtgagatgctttgttaattaacattgtgaagctaagtgctcagtgaaaaaagtactagagaattgcatattgtcmttacagaattgtttgtaaatacaatcaagtaaaagctgtattgaaagaggtaggccttgttcagagccgtgttactaatctcaagtctaggggtttgctc

SEQ ID NO: 10010 - DNA, 201 bp, Homo sapiens
taacctagtttgtgttcaggtaattctggtaatgggacatttgcctctcccctgggggaccatttttagtgtctgtccatccaaccagttagtcagagaamagagccctgatgtaagtagagaaagaggtatttgtagaactgtgggaaaaagaaaaacataacacactgacctgttttaagagtgcagggtgggttcaag

SEQ ID NO: 10011 - DNA, 201 bp, Homo sapiens
tctgggcttttagtgtatccatcacctgaacagtgtacactgtgcccagtaggtaatttttatccctcatcccctcccattctcccaccttttggagtctmtaatgtctttattctactcggtacacccacgtgtactcattgttaagctcccacttgtaagtgagacatgctgtatttgactttctgtttctgaaatagt

SEQ ID NO: 10012 - DNA, 201 bp, Homo sapiens
atatctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagtt

SEQ ID NO: 10013 - DNA, 201 bp, Homo sapiens
tatctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttc

SEQ ID NO: 10014 - DNA, 201 bp, Homo sapiens
atctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttct

SEQ ID NO: 10015 - DNA, 201 bp, Homo sapiens
tctcaaattttcctgatccagtcaccagttgatggacacttaggttgattctatgactttaactttgctattgtgaatagtggctgcaataaacatatgagtgagtgccagtgtctttttaatataatgatttcttctcctttgggtagatacccagtagtgggactgttgaatcgaatggtaattctatctttagttctt

SEQ ID NO: 10016 - DNA, 201 bp, Homo sapiens
aattatattaaagatacagatgcatactagatgcaacacagaagaaagatgccttgtttctggccatagatatgacagagagatcaataaaggccacagarttctcttcctgtttattcctgtggttgttgttgggattttttttagatatagcaagtactcagcaaatttttgctgaatacatttacttagaacaaaggg

SEQ ID NO: 10017 - DNA, 201 bp, Homo sapiens
gcctcccaggttcaagcaattctcctgcctcagcctcctgagtagctgcgattacaggggcccgccaccatgcctggctaatttttgtatttttagtagasgtgggatttcaccaagttgggtcttattattattgttaatggcagctttattattgttagtgatcttggttaggtagatgtatcagttggctattgctgt

SEQ ID NO: 10018 - DNA, 201 bp, Homo sapiens
tcagcaggaaaagtaggtttatattagggggcctggggcatgggagaggtcaaagatggagggagaaaataagtttagagtttagcaaagtgggactcttyccacaaggagaaaccttctccacctagttacacaataaaatcgcctaaagagcttttaaaattgataattgagtctcatccaaggccaattaagcttaaa

SEQ ID NO: 10019 - DNA, 201 bp, Homo sapiens
aaagagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgt

SEQ ID NO: 10020 - DNA, 201 bp, Homo sapiens
aagagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtc

SEQ ID NO: 10021 - DNA, 201 bp, Homo sapiens
agagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtca

SEQ ID NO: 10022 - DNA, 201 bp, Homo sapiens
gagctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcag

SEQ ID NO: 10023 - DNA, 201 bp, Homo sapiens
agctcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcagc

SEQ ID NO: 10024 - DNA, 201 bp, Homo sapiens
tcatgttacatcttataaacaaaataaaactggtacatgattcgtgagtgtcttcattcttctctttcttccctttcttctcttcaacacactcaacacacacacacacacacacacacacacacacacacccaagaaattcacctctggctctggaatctggagaaagttcaaagtcatgcagcaatgaccgtcagcatg

SEQ ID NO: 10025 - DNA, 201 bp, Homo sapiens
cgtgttgattcatgtagtaactgggaattcttagttaatatttgtctgcagatccatttatcttccataacaccttagatgaaatgtttctttttgggctygtattcaagatcttggggtgatctttttctgtgtctagtttccatgcaatctgagctctgcagcagccagtggaaatgcccttagttgtcttcagtttct

SEQ ID NO: 10026 - DNA, 201 bp, Homo sapiens
gctgcaattctcattgcatctgagatgttcaagaggtaactttcaaaaccacacttggcacattcaacataattaggtaattgcacacagcacaggttgtrtaaaggttagaggagcatctttcaaattttagaggatattaaaattaccaggggtatttgttaaaagttagattcccaagtcagagctccagagagtccc

SEQ ID NO: 10027 - DNA, 201 bp, Homo sapiens
ctaggtataagtgtaggctaaaatggcaatgttcaggatacatcctttaagggtgtaatattattacatacatctgtctcctttctcatttacatattgtrcagctttttttgtccctttctatactattcccccttttattaaaaaatggagcagacacatgattaaaatgaggaccaggtcaagtttgcatttagctaa

SEQ ID NO: 10028 - DNA, 201 bp, Homo sapiens
ttcagtggaagcctccttttgaagaagggcaagccattcatttttcagcataaaccaagggatgctcttacacacacacacacacacacacacacacacasagagagagagagagagagagagcaaaaaaagaatagccatcataaagatacatttctgttctggattcaagaggcagaattattaatacaggtagactgc

SEQ ID NO: 10029 - DNA, 201 bp, Homo sapiens
cagtggaagcctccttttgaagaagggcaagccattcatttttcagcataaaccaagggatgctcttacacacacacacacacacacacacacacacagasagagagagagagagagagagcaaaaaaagaatagccatcataaagatacatttctgttctggattcaagaggcagaattattaatacaggtagactgcca

SEQ ID NO: 10030 - DNA, 201 bp, Homo sapiens
aaagaatagccatcataaagatacatttctgttctggattcaagaggcagaattattaatacaggtagactgccaggaatgcagaatgttaatgcagctgyggaataatacactagtgccacagagtttaataatagataatgacaaataatacagttggggaattgtgtaattcaataacagagtaaataacaaggaaac

SEQ ID NO: 10031 - DNA, 201 bp, Homo sapiens
gctgccatagtaaaatagcacaggctggaggacttgaacaacagaaattcattttctcacagttctggaggctgtaagtctaagaccaaggtgccagcagrtttggtttctccaaaggccattctctttggcttacagatggccatctttttcctgtgtcctcacgtgacttttcccccatgtgtacatccctggtatttc

SEQ ID NO: 10032 - DNA, 201 bp, Homo sapiens
tggaggctgtaagtctaagaccaaggtgccagcaggtttggtttctccaaaggccattctctttggcttacagatggccatctttttcctgtgtcctcacrtgacttttcccccatgtgtacatccctggtatttcttcattccaaatttcctcttgttataaggataccagtcacactggattagggctcactctaatga

SEQ ID NO: 10033 - DNA, 201 bp, Homo sapiens
tcactctaatgacctcattataacttaatcacctctttaaaaatcacctatctccaaatacagtcacattctgaggtcctgaaggttagggcttcaacctrtgaatttgggtaggaggcagggacacaaatcaactcataacacaagatgaggaatattgttaaatgataaaaacaaaacacttgatccctatgatctaaa

SEQ ID NO: 10034 - DNA, 201 bp, Homo sapiens
ttgctgtcaggttgttcatctccacgcctctgtgagatattattgaaacagaacccagcactgtcctccttgccaaagtggttgacgttggccttaacttyccccagttctgagacagggacagactggctaatgtaagtgtgccctgtggatgtgcaatttagagggaggaatgggaaagtatgttgtatgcagctaggg

SEQ ID NO: 10035 - DNA, 201 bp, Homo sapiens
tgaatgcatctggtggtggggagcttactaccctttaaggaaagtcattgtttaaaaacatgtatatataatttttaatttttacagaaaaatgtttgcawtgagcccaagtctgcctaataataatagcagtaagctaactctcatgtaaggtatactctgcagcagacccactttgggaactttacatatattaacatt

SEQ ID NO: 10036 - DNA, 201 bp, Homo sapiens
gatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaat

SEQ ID NO: 10037 - DNA, 201 bp, Homo sapiens
gggggagggaaaagggatgagattctggtcaagtccttcctgccactaccatgtggccaaggtcacaggccaatgatgtccagagggagttggggcagggkatgcgctctttgtcttctctgaatgaagcgagcgaggagtgaggcagagaggaaggaagatttgcagacaagcaagcctcccaggagcttgttggattgg

SEQ ID NO: 10038 - DNA, 201 bp, Homo sapiens
agcgagcgaggagtgaggcagagaggaaggaagatttgcagacaagcaagcctcccaggagcttgttggattggaatgtattctcaggtctattgtagagrcagaaattccagatttagcattctgtcattgtcagaataacaaattaatatgtcttatgcccacacaactacatatacgcaaatatacaggcatgaaacg

SEQ ID NO: 10039 - DNA, 201 bp, Homo sapiens
ccaggaggggtcaggcattgtggctcatgcctgtaatcccagcactttgggaggatcaggtgggtggatcacctgaaatcaggagttcaagaccagcctgrctaacatggtgaaaccctgtctctattaaaaaaaaaaaaaattagccaggcatggtggcacgtgcctataatcccagctacttgggaggctgaggcagga

SEQ ID NO: 10040 - DNA, 201 bp, Homo sapiens
gcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagt

SEQ ID NO: 10041 - DNA, 201 bp, Homo sapiens
gaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggg

SEQ ID NO: 10042 - DNA, 201 bp, Homo sapiens
aggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttagggg

SEQ ID NO: 10043 - DNA, 201 bp, Homo sapiens
ggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttagggga

SEQ ID NO: 10044 - DNA, 201 bp, Homo sapiens
gcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaa

SEQ ID NO: 10045 - DNA, 201 bp, Homo sapiens
ttaaaacatttcaaaagcccccaacctcagtacattccaaagcaggataaaataaatacaaacaaaaaatcaacacctacaccaaaccaggctaatataaracaaaacctacttaaggtccagatttttttgtcccagcatttaaaaacagtgccagcatggactgaagtaaacacgctgcaatgatttctcagcttggga

SEQ ID NO: 10046 - DNA, 201 bp, Homo sapiens
gagccagcccaaaaaaatatgtgattcctgccctgattcagatagagatatctccaggctacttactatatgtatttattatgaagtacatgaataaatcrccacccaaatacagtaaatgcattggtattaaaaattaacacagactttttgttgtctgtcatcccatcattttctctttaatgaaataacggtctggaa

SEQ ID NO: 10047 - DNA, 201 bp, Homo sapiens
cacagactttttgttgtctgtcatcccatcattttctctttaatgaaataacggtctggaataccacctaatggcctgagatgcctcagagtgaggtgtgttttaccaattctttaacttaatcagactggcctcttgatatggggccaggttcttctgagtaactcactctgaagaaaagcaggatggattgattcatgg

SEQ ID NO: 10048 - DNA, 201 bp, Homo sapiens
tcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgaagttgcatgttggtacatacttg

SEQ ID NO: 10049 - DNA, 201 bp, Homo sapiens
cgaatcttcagggaaggtggggggtgaataattgaaataactcttgatttcttatattagggaccaggaatatgcccttgataggaaatctgtcatttggrggtcattttggccctttctggaagaaaaggagacattgagtgctttgaggttccaacatcaccacataccagttagtgaaggtgacagtcttctggatct

SEQ ID NO: 10050 - DNA, 201 bp, Homo sapiens
tgctgttctcattaacctggaaatagacaccacattttatctgctgctctgtttcctgctgtagatctgtgtagtaaatccattaatctgtctgtccatthatccatccatccatccatccatccatccatccatccatccatctatccatctgtccacccatctgtctttccatccaaatttccatttttaaagggacta

SEQ ID NO: 10051 - DNA, 201 bp, Homo sapiens
catccatccatccatccatccatccatctatccatctgtccacccatctgtctttccatccaaatttccatttttaaagggactattttgtgtcaagtgtmatactgggaggcaatatatttcatggttagatatataggctgtatgtagcctcagactgtctggaattaaattctgcccattactttagctatatgacct

SEQ ID NO: 10052 - DNA, 201 bp, Homo sapiens
cagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactg

SEQ ID NO: 10053 - DNA, 201 bp, Homo sapiens
ctttttttttgagatgggggtctcactatatcacccaggctcaccttgaactcctgggttcaagtgattcttttgcctcagcctcccaagtagttgggacygcaggcatgaaccactgtggctggtcagctcatagctccatcttttattggtcatgttaccttgggcaatgttgttagcttctctgtaccttagttttat

SEQ ID NO: 10054 - DNA, 201 bp, Homo sapiens
cacctggttgtaagcacaacttcattcctggagtgttgtgggattgaaggtgtcagttcctagctggctgttcactagaggctgccctcagtttcttgccrtgtgggctttcccatcatggcagcttcaccaaagtcatgagagagagagggagagagagagacagagcctgctaactagatggaagttgcaatcttatat

SEQ ID NO: 10055 - DNA, 201 bp, Homo sapiens
gtgggcagtagcctctaataaagggaacagttttaagtttccttttcttctcagcttctctgttaaatggttaatgatctggaagcaagtacttggaggtscttagggagctcctatttaaaggaacactgtgaagagaagttgccttctacagtaaaaaagtggggatgattagtcctccatttacatgtttagtaaatc

SEQ ID NO: 10056 - DNA, 201 bp, Homo sapiens
ccactcctagttgattccctctccctttcttttacttatgacatgcaacttccacaaaggcagtttatgttagttatctatggctgcataacaaattactsttgaacttagcagctaaagacaaaaacatttattatttcacagtttccatggaggaggaactcaggcatacccttgctgcgtcctgtaactcagaatctc

SEQ ID NO: 10057 - DNA, 201 bp, Homo sapiens
attttattttttacaaagcgttatcacatattaaatctggaaaggacattagagggccttatgcaaatgaataaactggcctagagatcttctatgcagcscccccagggtctgttctactgcagaccctggatctcctataacagaactataacagaacactggatctccacagaaagccacaaaggcccagagatgtgt

SEQ ID NO: 10058 - DNA, 201 bp, Homo sapiens
aatcatgtttaggattaataatagtttatataattaatatatgtgccatgcttgagccaacacattccatcacttatcttcaggctggctgcctcctgggrgccactaggtctcgagctgcaggctgagcatgctgggtaacaatgctataagtctgcttactggacccagtcctacagcctatgaatattcttttctgta

SEQ ID NO: 10059 - DNA, 201 bp, Homo sapiens
catgctgggtaacaatgctataagtctgcttactggacccagtcctacagcctatgaatattcttttctgtatttgaatagcaatagctggagatgcacargtcttgataaaataattttacatttgttatattcactttttttcttgcctgtcaaaaatgtcagcttttactctctggcttgcaatctaaatggacccaa

SEQ ID NO: 10060 - DNA, 201 bp, Homo sapiens
tgctgggtaacaatgctataagtctgcttactggacccagtcctacagcctatgaatattcttttctgtatttgaatagcaatagctggagatgcacaagkcttgataaaataattttacatttgttatattcactttttttcttgcctgtcaaaaatgtcagcttttactctctggcttgcaatctaaatggacccaatt

SEQ ID NO: 10061 - DNA, 201 bp, Homo sapiens
actggacccagtcctacagcctatgaatattcttttctgtatttgaatagcaatagctggagatgcacaagtcttgataaaataattttacatttgttatrttcactttttttcttgcctgtcaaaaatgtcagcttttactctctggcttgcaatctaaatggacccaattttaccttagctactttgatatgatattag

SEQ ID NO: 10062 - DNA, 201 bp, Homo sapiens
ttgatatgatattagctgcttagggcaattgcaagaaataccatacaagggttaatctccctcacccttccattcctttgatatgctgttggaaatttcaragtgctcaaacacggagatgaggaggcagagggtaaatggatacagaatggctgggaaagggagtagcagtggttggctgctcttaagatctctctccca

SEQ ID NO: 10063 - DNA, 201 bp, Homo sapiens
aagtgctcaaacacggagatgaggaggcagagggtaaatggatacagaatggctgggaaagggagtagcagtggttggctgctcttaagatctctctcccwtggcctggtgccatgagtctgtgtccagtgtgatttttggcaatttctacattctatgtgtatttgtgaagtactgtttttgcatcagatgatatctaag

SEQ ID NO: 10064 - DNA, 201 bp, Homo sapiens
catgagtctgtgtccagtgtgatttttggcaatttctacattctatgtgtatttgtgaagtactgtttttgcatcagatgatatctaaggataaattttgygttagaggagtgtagttacttgggaggaaagcagtgccatattattttatattaaacatcactggcagaaatatgaggatgggtaaatgtctactgataa

SEQ ID NO: 10065 - DNA, 201 bp, Homo sapiens
gcaatttctacattctatgtgtatttgtgaagtactgtttttgcatcagatgatatctaaggataaattttgtgttagaggagtgtagttacttgggaggraagcagtgccatattattttatattaaacatcactggcagaaatatgaggatgggtaaatgtctactgataatttaatagattttacctgcctaaatgac

SEQ ID NO: 10066 - DNA, 201 bp, Homo sapiens
gacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaa

SEQ ID NO: 10067 - DNA, 201 bp, Homo sapiens
agcaaatcctggcacattagcataatacctaagggcaaaatattggattgactgtttgtttgcccttaggttatttttaaaaagctacttgtataaattawaaaataaagcgaggcttggttgctaagaggatggtgggatttgtagactgcacaggagactaatgcaaatcaaagagaccaggaaggaaaggccaggaga

SEQ ID NO: 10068 - DNA, 201 bp, Homo sapiens
gcacattagcataatacctaagggcaaaatattggattgactgtttgtttgcccttaggttatttttaaaaagctacttgtataaattaaaaaataaagcraggcttggttgctaagaggatggtgggatttgtagactgcacaggagactaatgcaaatcaaagagaccaggaaggaaaggccaggagaacaacagacaa

SEQ ID NO: 10069 - DNA, 201 bp, Homo sapiens
caacaggtgaatatccagaaaccagcagattctaacaggcaagaggtagaggctcaaggggagacagatgattgattggcttcagagaggtctggtaggartctaggttgtcagctgggatcgtgatcttcagaacagaccagtgtggggcaagcccaaagcaataacttggggtcaggcatgaggtcagggcaaggcagt

SEQ ID NO: 10070 - DNA, 201 bp, Homo sapiens
atcgtgatcttcagaacagaccagtgtggggcaagcccaaagcaataacttggggtcaggcatgaggtcagggcaaggcagtgggagaattgtaagctttsaggtatgtgtaggttaggggcttggtcaggaccaccatcagcaggatcaggattagggctcatgggtcttgaacttctttcattcttcctgaccagaggc

SEQ ID NO: 10071 - DNA, 201 bp, Homo sapiens
aggcatgaggtcagggcaaggcagtgggagaattgtaagctttgaggtatgtgtaggttaggggcttggtcaggaccaccatcagcaggatcaggattagkgctcatgggtcttgaacttctttcattcttcctgaccagaggcagggctagtcccagggcctaggacaaggctaagcctgaaggtggacattatgtgaca

SEQ ID NO: 10072 - DNA, 201 bp, Homo sapiens
atcaggattagggctcatgggtcttgaacttctttcattcttcctgaccagaggcagggctagtcccagggcctaggacaaggctaagcctgaaggtggayattatgtgacaaccaacaaaaggaggaacatcatactagagtcaccgtatgtcctagtttctctaggacaggcccactttacatgtgttgttccagcatg

SEQ ID NO: 10073 - DNA, 201 bp, Homo sapiens
ggacaaggctaagcctgaaggtggacattatgtgacaaccaacaaaaggaggaacatcatactagagtcaccgtatgtcctagtttctctaggacaggccyactttacatgtgttgttccagcatgataatcagtggttctcccctttcacttgaaagtgactgacttgcgtgataagttacatagttaccctgattattt

SEQ ID NO: 10074 - DNA, 201 bp, Homo sapiens
ggaacatcatactagagtcaccgtatgtcctagtttctctaggacaggcccactttacatgtgttgttccagcatgataatcagtggttctcccctttcayttgaaagtgactgacttgcgtgataagttacatagttaccctgattattttccagaatgtgtttcataaaaatctttttagaagaatgtcatccagagac

SEQ ID NO: 10075 - DNA, 201 bp, Homo sapiens
gactgacttgcgtgataagttacatagttaccctgattattttccagaatgtgtttcataaaaatctttttagaagaatgtcatccagagaccacaaaagyagagttctctagtcacataagtatggcaaatccagaatgaaaggaagtttaatggaggagtctttactgcaggatttctcactgcctttatatgctaaat

SEQ ID NO: 10076 - DNA, 201 bp, Homo sapiens
ctgattattttccagaatgtgtttcataaaaatctttttagaagaatgtcatccagagaccacaaaagtagagttctctagtcacataagtatggcaaatmcagaatgaaaggaagtttaatggaggagtctttactgcaggatttctcactgcctttatatgctaaattataataggaattgctaagaggggaatagagt

SEQ ID NO: 10077 - DNA, 201 bp, Homo sapiens
acactttggtactcctgagactacgttatgtggaacacactttgggaaaccctggttagttgaatatggggtcagaaagggaaactggtcattgctcctgytgtaataagggtgcttgcaaagacagcagtcaccagttaaataaataattctggaaacaacaactgcagactctgacaaaatcttcaatttgctgattat

SEQ ID NO: 10078 - DNA, 201 bp, Homo sapiens
actacgttatgtggaacacactttgggaaaccctggttagttgaatatggggtcagaaagggaaactggtcattgctcctgctgtaataagggtgcttgcraagacagcagtcaccagttaaataaataattctggaaacaacaactgcagactctgacaaaatcttcaatttgctgattattgactgacattagcagagg

SEQ ID NO: 10079 - DNA, 201 bp, Homo sapiens
attttatctctctgcctggtggaatgggtcaatatcaaacaagctaatccagggagaatgatgcattgatttcctaggccttaccaagtgtgcaggctgawgtcaacctacctaggaaggttttttttttaagatgaggtggaagagagaatacagcaagaaacaaggagaaagatttgctttgcttttgttatggagtta

SEQ ID NO: 10080 - DNA, 201 bp, Homo sapiens
aaatatggctgttttctcagaaatttcaactttttaaacaaaagttgaaaatctatattttttgaaagtttttctgatttttaaaaacagacttcttgagrtataattgatatacaaagagctgtacatatctaatttgatgaatttggacatatgcaaacatcgatgatgccttcaccataatcaaggtaatagacatat

SEQ ID NO: 10081 - DNA, 201 bp, Homo sapiens
atattcaacacctcccaaagtgtcctgtgctcctttcttttttgtgggtaagacgcttaacctgtgatctaccctcaagaaactttgaagtgctcaatacsatattattaactatgggcacaatgttgtatagcagatctctaaaatttattcattgagcctatatccattgaacaattccccatttctccctcccctcca

SEQ ID NO: 10082 - DNA, 201 bp, Homo sapiens
cttcttttaaaaaactaaataatagtcatgcttggatgaaactttgggttgtttccatatgttattgcgaacagtgctgcaataaacatgggggtgcagakatctctttgagttcctggtatcaattgtttagatatatgtccagaagtgggattgctggatcatatggtagttttatttttaatcttttgagtagccttc

SEQ ID NO: 10083 - DNA, 201 bp, Homo sapiens
tatattggaaattttgtgacacttcttgagacaccttgagtttctctgagttgttacaaaaccagagcaaagagtcaaagctgtaatttctgcctatcacyggcttttgaatagattatgaactcttagaggattgggtttgtatctatatagttctctttatacagagatgaaggctttcacagcagtatctataattgg

SEQ ID NO: 10084 - DNA, 201 bp, Homo sapiens
gggcgtgttttaagccatatgctcataacctttgtgtcatgattcagttggtgtgtcttgatcagtttcctcatctgtcatctcttggaaagcatgtaaarattaatcacagatatctgcttgtattacctagattaatgctagatgattagcagatgaaccttaacatctcagtggcttaacaaaaaaaggtgttaatct

SEQ ID NO: 10085 - DNA, 201 bp, Homo sapiens
ttattaatatcccaaattttttaaatggtcacaataattccccttgcaacttctgtcatatgaataagcccaggatcgcttgatggatgatgatgaaggaytcatggccaagtcatccacaccacctcagccgactttgagtcagtcaccagacatgtaagtcatgtaagtaagaccatcctagagcatacagccccaggc

SEQ ID NO: 10086 - DNA, 201 bp, Homo sapiens
gatgaaggattcatggccaagtcatccacaccacctcagccgactttgagtcagtcaccagacatgtaagtcatgtaagtaagaccatcctagagcatacrgccccaggcaagccagcctagatcagaagaaccagccagcctactcacagaactgtgagaatgaccaatgtttgttactttaagccactaagtttggtgg

SEQ ID NO: 10087 - DNA, 201 bp, Homo sapiens
tagagcatacagccccaggcaagccagcctagatcagaagaaccagccagcctactcacagaactgtgagaatgaccaatgtttgttactttaagccactmagtttggtggtggtttattatccaacaaaggctgatacagaaaggatcacaattgaggagtttatgtgagctcaatctgaaagtttatatgagctagatt

SEQ ID NO: 10088 - DNA, 201 bp, Homo sapiens
tgtgagctcaatctgaaagtttatatgagctagatttgcccattatttcactaaattcatcacatggccccacctaactccaaaagagactggaaaatgtraaaaacccagacagaaagggaagtaggctccaggacagctggccaatatctgccacactgatttaccttgattttgtaaaaacaaaacaaaatcaaaacc

SEQ ID NO: 10089 - DNA, 201 bp, Homo sapiens
ttaatattgtatttattaggagtatggcacacgataggtacttattagatgttagctatcatcatcatcttcatcataatttgattttgcttttcttattycctttgatcttgcctcctagtctaacaggagaaacattagaagttggtggagacggcctagaaaaggaagggtagattagagagcaggagatagtgaaaa

SEQ ID NO: 10090 - DNA, 201 bp, Homo sapiens
ggggatgtgccactggggccgagatgacgagtttcgtgaaaaacagagttcaaaagaggaggctcttgagtgtaaagataatttgaggggaaaagaaaaaratagaatgtgactggaaggaacggaataggaaaagcagcatgatatagatggaaatctcctcatttctttgacgtccttaacaagaacatcaagtgaggc

SEQ ID NO: 10091 - DNA, 201 bp, Homo sapiens
gccaatatagagctggggttaaacatgtcaagaattcaaagctatagtgcccctgggtattcaaaaagcgtaaagatttgactaaattcacagccaaatgrcatttaccccaggtctaccccataccagtcactggcttctctctaatagttgttatcccttttaattctatagaatagaaaagaaggaattggggctagg

SEQ ID NO: 10092 - DNA, 201 bp, Homo sapiens
tggcttctctctaatagttgttatcccttttaattctatagaatagaaaagaaggaattggggctaggctgagcagcagaggagagattggctgtggagartatagatgacacatgaggccaggtgatctctgagaaaagtttctcccatctgttgcttagattgcccatcttggaactcaggaaatctgagatggcttta

SEQ ID NO: 10093 - DNA, 201 bp, Homo sapiens
tttaatatgttgatttaagtaatgctgggtgatgagtggtagtgacaaggctcttctcttactaggatatcacatgaacaggttctgtcctaattctgccyttgcctagtacatatgggtgactagaatttggtgagagggggctgtctgctgagctaccccaactgtggttacagcacagttacagagatggatttttaa

SEQ ID NO: 10094 - DNA, 201 bp, Homo sapiens
ggagcattcacagagaaggttatatttgttgaggaccttgaaggagtaggagttgcctaggtaaatcaaggaaataaagggaataaatatcaaaggacccrcatgtatgaagacacagaagacatagctttagagaagtttagagatgtttgtagagcatgctggaacacaagaaatgcttttggaaagactctgtaaaat

SEQ ID NO: 10095 - DNA, 201 bp, Homo sapiens
tactaggtatgcaacagtgaacatttaaagtttattgaattaagtcaaccaaagaagacccaagttgtgggattcaagaatagcaaggctctttcaaatgyctctgaaacagttgggggtggacctctccatggtgctgaaacatcccctgttcaagccttcctatctatctggattattggctcctttccatgttcctaa

SEQ ID NO: 10096 - DNA, 201 bp, Homo sapiens
tttgaagatagactcaaacaatgggcatgtctcacaatgatacagaggactcagataaagttggtggaatagagtggaaagaatactggatttgaaattamaagttcaaatcagggtttcaccacttagaagctgggtaaagtcatttagtttattttgaagcctcagtatccttatttgtaaaatgtagacaggttattc

SEQ ID NO: 10097 - DNA, 201 bp, Homo sapiens
aataatttatgggggatccattgcatgctcctttgtgtactctgtctgtctgtctctctctcttcctctatccccactctaattcctttcaccgtcatttmtttctgcctctttctggtattcagtcctgtatatattaaaagcataagccaattagaaaataattgctgttactctgcttggcccatctttcttgatgtt

SEQ ID NO: 10098 - DNA, 201 bp, Homo sapiens
gcagaagtgctctgcctgaagcccagggttaatttttacaatggccacttagccaattgaggatggttaagtgagcaatattttatagactcttgtattarttattttgggggatggatataagtttgtggatggggaaaacactctcagattattctaggggagatgaatgatatatctttacaaaaacatataaaaacc

SEQ ID NO: 10099 - DNA, 201 bp, Homo sapiens
agccattaaatcgaggtgtgcctaactctaaattccatactctttatattacactatgatgtctaataaataatttggttgaaagagtcatttttattcargataggagagtagactcattgatttctgttagtcttttctatgaatctgttatcggaaatagttgactacaattaaaataattcctggcactataacact

SEQ ID NO: 10100 - DNA, 201 bp, Homo sapiens
agtagaatgcaaggctagactactagcaggcatccttctcattaattagcgagagaagagcttgtctgaactatggagggaaaaatagagaatcaatatcwaacggtattctttaagaccctgaatccagccacacttgaaccatttttctaaaggaatgtgaattcatagtgtttttcttttatcttgggtctatgttat

SEQ ID NO: 10101 - DNA, 201 bp, Homo sapiens
ccagtaatggttagtaaagaatacaagagagtgtaggccgggtgcggtggctcacgcctgtaatcccagcactttgggaggccaaggcgggcggatcacgrggtcaggagattgagaccatcctggctaacacggtgaaaccccgtctctactacaaatacaaaaaaaaaaaaaaaaaaaaaaaattagctgggcgttgtg

SEQ ID NO: 10102 - DNA, 201 bp, Homo sapiens
aatcccagcactttgggaggccaaggcgggcggatcacgaggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccagg

SEQ ID NO: 10103 - DNA, 201 bp, Homo sapiens
atcccagcactttgggaggccaaggcgggcggatcacgaggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccagga

SEQ ID NO: 10104 - DNA, 201 bp, Homo sapiens
agctcccttttcaaaatacttgaactccacctggacctaggcaaaatgttttaaaatggcatcagagtgaatcaaatcacattaacctgagatggtgggcraggatcatgaaaaaggacagagggaagcctgaatgtgagtttgcctgaagaggaaatgatgattccaataagtgccttttctttccgtttgcattctgtg

SEQ ID NO: 10105 - DNA, 201 bp, Homo sapiens
cctaagaggtaggtagggatgatgactatttatagacaggaaagctgagttggactaagtgaaataaacagcgatgaataaagtctgtggaagaaaggggmttcatattttctatgcttcctgatatccaagtcacccagaaatacaccaaagaagctttcagttttcacacctggctgtatgaatttattccatctcagt

SEQ ID NO: 10106 - DNA, 201 bp, Homo sapiens
gactgagtaatttataaagaaaggaggtttaattggctcatggtactgcaggctgtacaggaagcacagcagcatcttctctgcttctggggaggccttargaaacttgtaatcatggcagaacgaaagggggaagcaggcacatcttacatggctggagcaggaggaagagatgaagtgggaaggtgatacacactttta

SEQ ID NO: 10107 - DNA, 201 bp, Homo sapiens
gaggtttaattggctcatggtactgcaggctgtacaggaagcacagcagcatcttctctgcttctggggaggccttaagaaacttgtaatcatggcagaasgaaagggggaagcaggcacatcttacatggctggagcaggaggaagagatgaagtgggaaggtgatacacacttttaaacaaccagatcttgtaagagct

SEQ ID NO: 10108 - DNA, 201 bp, Homo sapiens
cagatcttgtaagagctcacttgctacacagtaccaaggaggatggtgttaaaccattcatgagaactccactcccatgatccaaccacctcccaccaggmcccacctccagcactggggattacaattgagcttgagatttgggtggggacacagatccaaaccatgtcagccttcttttctgtgttatttttatgtcca

SEQ ID NO: 10109 - DNA, 201 bp, Homo sapiens
aagttatttttcaggtgcctggaggatggaaaagggttgccctggaaattgatatcttcttctgagtttggcttaacaggggaaccaccagtgcccttgckgatggctgaggtgtcttttatgctaggtatggctctcttccagataaccaagtgtagacaggagtaggcccagttgttcatggagcattggttttaggac

SEQ ID NO: 10110 - DNA, 201 bp, Homo sapiens
aactttcaggttttactgtatttggctgtaaaattcaaaagccagattgactaattctcagtgcctgttaaattcttttaggagcaaagtgatacattgtscccacccctgcctttcctaagaactcattttttcccctactcattagctgtattcaaatgcagagctttgctgatgaacagcaaagtggcttcttgacta

SEQ ID NO: 10111 - DNA, 201 bp, Homo sapiens
gaagcttaggacaggagctgatggagattagccaaaatgtcagagttagcctaccctttgacctgggcctggaggtgaggttttcttcttacacttacttyggaatgagaaatgagagagtgaagttttcttcctacacttacttcatgtcaatcttctcagtgtctaattgctatgatcagaaattcagagttatcccag

SEQ ID NO: 10112 - DNA, 201 bp, Homo sapiens
cagaaattcagagttatcccaggctgggtatttgcataccacaatgagaattgctacaactaatgttgcttgatggaagggcaggagctgaaattttaccygagccaccaattttctcaaaaccttggcctgagagagaattcaagttttacccagaagtatctacattttgttttttacaaaagggctcatgatagagct

SEQ ID NO: 10113 - DNA, 201 bp, Homo sapiens
gtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatag

SEQ ID NO: 10114 - DNA, 201 bp, Homo sapiens
aaggtactcaaatactttttatttaaccttcttactttttgtccttagggaaactgtagacactttgagactgtttattttatgcttcttttctaggaggyaaagcttttgggggaaggttttatgctttcagaattttcagttaacatttctgctttgtgatggtctcccaatcccatctccttcaatgacagctccaaa

SEQ ID NO: 10115 - DNA, 201 bp, Homo sapiens
aaaatatcaccagttttttatttttcttattcaaccctaagttttattggagaaccttattcctgcttcatggagaaaactggctaggcgtggtggctcaygcctgtaatcccagcactttgagaggccgaggtaggtggatcacctgaggttggaagttcaagactagcctgaccaacatggagaaaccccatctttact

SEQ ID NO: 10116 - DNA, 201 bp, Homo sapiens
ccagttttttatttttcttattcaaccctaagttttattggagaaccttattcctgcttcatggagaaaactggctaggcgtggtggctcatgcctgtaaycccagcactttgagaggccgaggtaggtggatcacctgaggttggaagttcaagactagcctgaccaacatggagaaaccccatctttactaaaaataca

SEQ ID NO: 10117 - DNA, 201 bp, Homo sapiens
atcacttgaacccaggaggcggaagttctggtgagccaagatcgcgccattgcactccagcctgggcaataagagcgaaactccatctcaaaagaaaaaaraaaagaaaagaaaagaaaagaaaaagaaaattgatgatattttgtgtgtgtgtgtgtgtgtgtgtgtgtgtgtgtgtgtgtgttttagttctccagcccc

SEQ ID NO: 10118 - DNA, 201 bp, Homo sapiens
tctatagtactgggcaaggttcttgacacacatgagctgcttaattaagtttaatgtatttatgacaaatttagagcaggtttgaagaaattcaggctttkccccattaagtaatggtgcaccccattaagtaatggtgcactttgggagaaatgggctgaaaaagttttaacgatagcttttgcagcctatttgccccaa

SEQ ID NO: 10119 - DNA, 201 bp, Homo sapiens
aaagcacaattaataattgtgtgtaatgagcaaattagagcaataatacaagaaaatgagaggcaattccttgaaatgtttctgtcttatcttttaattgaaaaaaaaaaaaaaagccttccatttccctcaggtagagtgaaactgacaactgagctgccctgcttctgccaaatatgaagatatctaagactctgcttc

SEQ ID NO: 10120 - DNA, 201 bp, Homo sapiens
aagtcctggagggagagtggggaggggaaaggaagaagtctgttgaacttggggcttagtttcactctggattatgtggcaaattgattttgataacaggyacctccccattcatacctatgttattcttaggattatgcagtaaaatagtttaatagtaaaaggatagaactttggtgttagaaagacctaatttctggt

SEQ ID NO: 10121 - DNA, 201 bp, Homo sapiens
ccaaatctattaaaaaatggataatcatgcttaatatagaacagttctgagaattaggtaagaaaatgtctatgtaagtgcctagtgccacatcttgccaytagtaagaaccaagaaatgctatttgtggtgggatgccattgatgttgggtagagcttagctatgatttatgatactcccaagagactttttttttaatc

SEQ ID NO: 10122 - DNA, 201 bp, Homo sapiens
tagctggctcttgccccgtctgtaggtcacatccccgcatcacgttcctaataatctacctgcacttcactcttggtctgaaggtttgcttctgaggaaamccaaactaaggcatggggctactctagtaagccagcccagtgatgtttatggtgaattatcataagtagatctcgataccaggatttgtattatattgta

SEQ ID NO: 10123 - DNA, 201 bp, Homo sapiens
tgctgcacccatcaactcatcatttacattaggtatttctcttaatgctatccctcccccagccccccacccatgacaggccccagtgtgtgatgttcccyggcctgtgtccaagtgaactcaatgttccattctcacctatgagtgagaacatgcagtgtttggttttctgtccttgtgacagtttgctgagaatgatgg

SEQ ID NO: 10124 - DNA, 201 bp, Homo sapiens
aagtctttgctattgtgagtagtaccaccataaacatacatgtgcatatgtctttatagtagcatgatttataatcctttgggtatatacccagttatggkattgctgggtccaatcataattctagttctagatccttgaggaattgccacactgtcttccacaatggttgaactaatttacactcccaccaacagtgta

SEQ ID NO: 10125 - DNA, 201 bp, Homo sapiens
gtacttcacatcccttgtaagttggattcctaggtactttattctctttgtagcaattgtgaatgggagttcactcatgatttggctctcagtttgtctgytaatggtgtataggaatgcttgtgatttttgcacattgattttgtatcctgagactttgctgaagttgcttatcagcttaaggagattttgggctgagac

SEQ ID NO: 10126 - DNA, 201 bp, Homo sapiens
ccagtagtcattcaggagcaagttgttcagtttccatgtagttgagtggttttgagtgagtttcttaatcctgagttctaatttgattgcactgtggtctvagagacagtttgttgtgatttctgttcttttacatttgctgaggagtgctttactcccaattatgtggtcaattttggaataagcgcgatgtggtgctga

SEQ ID NO: 10127 - DNA, 201 bp, Homo sapiens
ctaatttgattgcactgtggtctcagagacagtttgttgtgatttctgttcttttacatttgctgaggagtgctttactcccaattatgtggtcaattttmgaataagcgcgatgtggtgctgagaagaatgtatattctgttgatgtggggtggagagttctgtagatgtctattagttctgcttgttgcagagctgagt

SEQ ID NO: 10128 - DNA, 201 bp, Homo sapiens
tatgaaattctgggttgaaaattcttttattttagaatgttgaatattggcctccactctcttctggcttgtaatgtttctgctgagagatctgctgttastctcatgggcttccctttgtgggtaactcggcttttctctctggctacccttaacacttttcccttcatttcaaccttggtgaatctgacaattatgtgt

SEQ ID NO: 10129 - DNA, 201 bp, Homo sapiens
ttcttgctttatttcattaatttgatcttcaatcactgataccctttcttccacttgattgaatcagctattgaaacttgtgtatgcatcatgaagttctygtgccatgattttcagctccatcaggtcatttaaggtcttctctcactgtttgttctagttagccattcatgtaatattttttcaaggttcttagcttcc

SEQ ID NO: 10130 - DNA, 201 bp, Homo sapiens
gttggtgaggagctgtgatcctttggaggagaagaggcactctgatttttagaattttcagctttcctgctctggtttctccccacctttgtgctttcatyccacctttggtctttgatgttggtgacctacagatggggttttggtgtagatgacctttctgttgatgttgatgctattcttttctgtttgttagttttc

SEQ ID NO: 10131 - DNA, 201 bp, Homo sapiens
tgctggaggtccactcaagaccatgtttgcctgggtatcaccagcagaggctgagaacagcaaatattgcagaacagcaaatattgcagaacagcaaataytgcaggaaagcaaatattgctgcctgattcttcctctggaagcttcgttccagaggggcagctgcctatatgaggtgtctgtcatcccctactgggaggt

SEQ ID NO: 10132 - DNA, 201 bp, Homo sapiens
ggttatctgagcaccaggtaaggcctgggaagggtagaggcaatatggctagatgtccatttcctataatctctaaatttgtatgaattgatgcattcatratctgagatcataaatgaagtccataaagtccataaacctcctgatattttatgtaaaacttaatgcatatgtacacttttctagagaggaagtcttgag

SEQ ID NO: 10133 - DNA, 201 bp, Homo sapiens
cttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagc

SEQ ID NO: 10134 - DNA, 201 bp, Homo sapiens
caatctggccttttattacattgctgttgactttgttgttgttgttattgttacatgtttgtttttctttggatatcaatgcttttatgggaattatttcycatttcgttaatcctagcctagtttccttcaaaagggtcttgagtgcaggtagcctcttcagggtagagtaaaacaacaaaaaagtcaaagccggaatca

SEQ ID NO: 10135 - DNA, 201 bp, Homo sapiens
agagtaaaacaacaaaaaagtcaaagccggaatcaagggtgtgttttctatcatacagaatattatgatggaccactgaggctcagtgccactagggactytcttgggaggtgcatagaatgaatattaaaactctctgcctgaaagatggaataaggcagaatgtatttactgttcccatttccccttggccaaggatta

SEQ ID NO: 10136 - DNA, 201 bp, Homo sapiens
tctttgcagcagctggcatgcaaaagtgaacagagaggatatgagggcacaagaggtgtctcatacaccttctccattctagcatctctcctcactgagamcatggtaatcttaacttgtaggcatgcagtgttaataaatgaagccaaagtgctggatttgatccctatgtaggtcacttagctgcccacagtgaaaagt

SEQ ID NO: 10137 - DNA, 201 bp, Homo sapiens
cttctccattctagcatctctcctcactgagaccatggtaatcttaacttgtaggcatgcagtgttaataaatgaagccaaagtgctggatttgatccctrtgtaggtcacttagctgcccacagtgaaaagtagcaccatggacatcaaagtgaacaaacccctgcctgagtacttatttccatggatcaaaaggatggg

SEQ ID NO: 10138 - DNA, 201 bp, Homo sapiens
gcccaagagacagcagggagattctgggaataaacaggagttgggttctcaatttggcaactaagcattcttttgttattgcactttctcaggctgcagcrgagcctgattagctttaaaattcatttccattggtttcttctttcatgatagttttagatgttgttttattggcattcctatagatgtaatttaaccttg

SEQ ID NO: 10139 - DNA, 201 bp, Homo sapiens
ctgagacataggttttcttaccatatccattttacacttgaggaaaatgaggcacaaaaaaattgagtaattagcccaaaggtcacagaggaggtcaagtkgtgaatgtgggatttgaactctgggaatctggcactgaaatccactcttattatagttcctcttatttgttaggccaggactatttatgaaaaaagccac

SEQ ID NO: 10140 - DNA, 201 bp, Homo sapiens
catggagatcattttagttaaaattagaatgcatttagggatgtcccttgttatctatattaaacattgcatttgctatagcctccaaggccataaaacasaaaagtaaaatagttggtgtaaatatcagaagaggtaaaactatctctttttgctgatactataattccttatcaagaaatttaaacaactctagttaaa

SEQ ID NO: 10141 - DNA, 201 bp, Homo sapiens
gaggtaaaactatctctttttgctgatactataattccttatcaagaaatttaaacaactctagttaaaaacttacagaatgaataagatactttgataasctatctggatataagtatataatatcaatcacttctttattctatcaataattaaccatttttagttctcaaggttcaaatttcagagaaggtggctttg

SEQ ID NO: 10142 - DNA, 201 bp, Homo sapiens
cactatgcctggctggctctgcaaacttttacttctatgaccctttctttctcttggtttctccttgacacttctccccaatgaacccatggtgcaatatrggagttggtgccctaaaagtgactacctcctaaaatcactcacactcaattattagtaaagttcaaatgacaacttttttatgataattgtgttttaaaa

SEQ ID NO: 10143 - DNA, 201 bp, Homo sapiens
aaagcctgagtatttctgtgccttgtagcacatcttagaaagggagaagggctattcagcagcattgttcatgctcaggcccaggcccagctgcctctaamtgtggtcatgagaagtctcagacactggcatgaagtcagcaaataaaaataaacaacatagccaagtatgatggtgcacgcctgtagccccagctactca

SEQ ID NO: 10144 - DNA, 201 bp, Homo sapiens
ccaggagtttgaggctgcagtgacctgtgatcacaccagtgcactccagtatgggcaacagggaaaaatctctgtctccaataaataaataaataaataartagtaattagaaataaataaacaacatttttgaggagaagggatgaagttgattaatgggtacaaatacaccgtttgatggaataagacctagtgttaga

SEQ ID NO: 10145 - DNA, 201 bp, Homo sapiens
acctaatataaaaaatccagcctctagtttgaggagctgaaagaatgaaccctatgcagtcctgattgtctgggcttattttcacttgctctgtgaagcasctgagcccttgttggtgaaccctgctacagtccccactgagtttaagacccactcttttcaagggtccccatgttaggtttgcctccacaccttagcttc

SEQ ID NO: 10146 - DNA, 201 bp, Homo sapiens
tgctgtgtatttctacccataccctcatccaacttatctaaatcttgctcctttttttccattcttgctgatttaattttatccctcaactcatggttccraataatcccctgtgttagttgtgcctacagcaacttgtttaactctctctaccaggcaataaggtggaggggcaggggaaggataaatgcagcctacttg

SEQ ID NO: 10147 - DNA, 201 bp, Homo sapiens
cttgaacaaatcattctgcctgtctaaacattaattaattcctcaacttttaaatggaatatgatgactatttccctttatatgtgtatcttagatgtagkcatggagctaaaatagaaactcaaaatgaagtaacagtaagggctggcagtggaatattattgatcccagaggaaaataaaaattttatttccaacgttg

SEQ ID NO: 10148 - DNA, 201 bp, Homo sapiens
agagtagacctccctggagcttcttaaactagccaatgttaatcttggtgctgagacatattgatggtatgtcatatgtaataggttaccaaataataatkcatatactaaaattatgctaaagatttactaaaaatttaaattaaggcagatcaggcttatggctaaaataacatcatttccatgcacctgcattctgac

SEQ ID NO: 10149 - DNA, 201 bp, Homo sapiens
tcaacactgtttataagatctttcatgttgctatgttttcatttagttggttttctgtaactgctgcatagcatttctctgtatgcatccaccacatcttygcatctgttcctctagtgctaaaactctgcttcaattccacaattaccaatagtgtggtgtgtggccctgagcaaaaattgcttggggatatattcccaa

SEQ ID NO: 10150 - DNA, 201 bp, Homo sapiens
ttgtaaattgcatctttcttccttacctgtgtatgccctcaatgctttgcttgttgcaagactccagtaagtgttttctgaaataaattgtctgatctctsgaaggtcctgcctgacaataaggggccattggctatgaaagggtggtaggatctaggagtggaaagtcacagatgattattttctattctaatagggtga

SEQ ID NO: 10151 - DNA, 201 bp, Homo sapiens
tgctttgcttgttgcaagactccagtaagtgttttctgaaataaattgtctgatctctcgaaggtcctgcctgacaataaggggccattggctatgaaagsgtggtaggatctaggagtggaaagtcacagatgattattttctattctaatagggtgatcggtttatttttttcttttcttgactgttttcctccctact

SEQ ID NO: 10152 - DNA, 201 bp, Homo sapiens
ctacaaacacttctcttagggactcaggtcccaaccttgctgggcagagtgcatgatgtgtttcataatgcatgagtgtttatttaacaaacagcaacackttttaattaaactgttgttgaagatacagactgtataacctttctccaaggcctggatgctcactggcccttccaagatgctgacccctcgctagctgca

SEQ ID NO: 10153 - DNA, 201 bp, Homo sapiens
attacatgtttaacactgggtaacagtggggctatgcttatcttggacgttcagggacctatacgctcagaagcttggctgctttttgatgtgaccatctygacatgagtctttagggttttctacagcagagaaagaacaagaaataaattgtctcttaaatgttcttaccattttcattggccaaagcaggtcacatga

SEQ ID NO: 10154 - DNA, 201 bp, Homo sapiens
ctctactccaaggaggcataggagtttaaaataggaaaacagtagtacgttgtgatggattgtatttttcaaagaaagtcacaataatatttcccatcccrtgcactcttctgcaatgtatccttgacattctgtcatcaagattaagaggtagactctctctctaccctcttgaatgtggataggccctatgatggcttc

SEQ ID NO: 10155 - DNA, 201 bp, Homo sapiens
tgaaggttatagtgtttggctctgtcaagagcaacctcacacatcttcttcactggaggctcacaaatgctcctcagaatgtctatttaactatctctagrtaggactgggctctgactgggctcctacttcacccattacctgtttcttcctttgtcctgagaatgtttgcatgaagccagaatctctgtttgtttagaa

SEQ ID NO: 10156 - DNA, 201 bp, Homo sapiens
caatctattcaatttggaattcacaaacttacctaaaacaaggcctttcaatttcctgtttcccctgtaaacagagctctaccaccaggatttctcagaarctctttctccacactgaaccctaaaactgaaggttcaggtagagagcttttccagtgtgagagaatttttaaagcatctggggtttggcacatccagtgc

SEQ ID NO: 10157 - DNA, 201 bp, Homo sapiens
gcagtggatgctggtaggggagctcagttggaagtggggctcatgttctgatcttcagtgccgaatgtctgtgtccctccctcagatttacatgttgaaaygtaatcaccaatgtgatggtattaggaggggggccttttgggaggttagtaagtcatgagtgctttgggattagtgctcttataaaataggcccaaggga

SEQ ID NO: 10158 - DNA, 201 bp, Homo sapiens
tcagatacaaatttttgttgtttataagctacccagtttatggcattttgttgtagccacctgaacagattgagatatccagtttatagctggaactggargtataccaggtatcccagactttggtaatttatgtatcaggttcactattttcaccataactccctacaacagtattgattttctttacaccgattatct

SEQ ID NO: 10159 - DNA, 201 bp, Homo sapiens
acaacatctggagacactgctatagggtagtggttcttaaactttagtgggcatgagaaacactggcagagcttctaccagaaacactggtagatagctgygctcttccccagagaatctgattcagcaggtctgtggtgggaaatatgactttgcaggttttttttttttttttttttttttgagacagggtctcattct

SEQ ID NO: 10160 - DNA, 201 bp, Homo sapiens
cctcccaaagtgctgggattgcaggcatgagccactgtgcccggccttttctttattttttgagacagagtctcattctgtcacccaggctggagtgcagyagcgtggtctcggctcactgcaagctccgcctcccgggttcacgccattctcctgcctcagccttctgagtagctgggactacaggtgcccactaccacg

SEQ ID NO: 10161 - DNA, 201 bp, Homo sapiens
aagggttcacaactaaatgcttcttatgctgagcaaatgtatacactgctaaaaccatatactcactccttgtggtgtgtttgttaggaagctgccacttstgtcttctccattctttggaaaaggctgtgagtaaacacagagcactggctatttacatacctagctcctgcttgctttttcaaagctctttgttcaagt

SEQ ID NO: 10162 - DNA, 201 bp, Homo sapiens
cttcttctttgttcttctcttaattcagcccatgagcacatggtagattatgaatggatgctttaggaaccatgtagatggaggtttgtgaaaatttccayggaacatggcagttgagaattggtgactgatatggtctagctctgtgtccctacccaaatctcaccttgaattgtaataatccccatgtatcaagggtga

SEQ ID NO: 10163 - DNA, 201 bp, Homo sapiens
tgagaattggtgactgatatggtctagctctgtgtccctacccaaatctcaccttgaattgtaataatccccatgtatcaagggtgagactaggtggagayaattaaaaaatgggattggtttctgccattctgttctcgtgatagtgagtgagttctcacaagatccgatggtataagggggtataagaggctacccctt

SEQ ID NO: 10164 - DNA, 201 bp, Homo sapiens
ccagaatgctaatagtgatataaacaatgaagtcctcagatggggatgaggaacttggtgggaactggaataaaagtaattcttgctatactttagcaaasagactaaatttgcatttcacccctgccctagacatctatggaactttgaacttgagagagatgatttaaggtatctggtggaagaaatttctaagcagca

SEQ ID NO: 10165 - DNA, 201 bp, Homo sapiens
agatcttcatggcagtccctcccattacaggactagaggccaaggaggaaaaaatggtttcatggattgggcccagggccttgctgctttgtgcagtctcrgaacttggtgctctgcatcccagctgtggctaaaaggggccaatgtagagctcaggccattgcttcagagggtacaagccccaagccttggcagcttaca

SEQ ID NO: 10166 - DNA, 201 bp, Homo sapiens
gaacctctgctagggcagtgcagaagggaaatgtggggtctgagctcccacacagagtccccactggggcactgcctagtgaagctgtgagtagaggactrgcatcctccagacttcagaatggtagattctctaataggttacaccatacacttggaaaagctgcagggactcaatgccagccaatgaaagcagccgaaa

SEQ ID NO: 10167 - DNA, 201 bp, Homo sapiens
atggtttgcctctggggccccacccaaatctcaccttgaattataataattcccacatgtcaagggtgggaccaggtggagacaattgaatcatgagggtkgtttctgccatgctgttttcatgatagtgagtgagttctcatgatatctgatggttttataaggggcttccctgtttgcttggcactcattctgtcccct

SEQ ID NO: 10168 - DNA, 201 bp, Homo sapiens
ttcctgaggccttctcagccatgtggaactgtgagtcaattaaacctcttttctttgtacatttataaattacctagtctcaggtatttcctcatagtagygcaagcacagactaatacaatggccaagaagtgatcataggatggtaatataataaacacatggaggggaaagtgagtgtagttgcaggttttcaggaga

SEQ ID NO: 10169 - DNA, 201 bp, Homo sapiens
gtacatttataaattacctagtctcaggtatttcctcatagtagcgcaagcacagactaatacaatggccaagaagtgatcataggatggtaatataatawacacatggaggggaaagtgagtgtagttgcaggttttcaggagaaaatctgaaaggggtgaccaaaaatgagtacctgaatgatgcagctttttgaaaaa

SEQ ID NO: 10170 - DNA, 201 bp, Homo sapiens
acaaatgccaagtatgttgtagaattattttaggtgctaggaaaacagcagtggataaaacaaaaattccttagagtttatattctaatggcgagtcatargtaatctacaaaataaataaatatacagtattctagatgatggtaagtgttttaaaggaaaaatgaaacaacaaatagtgatagtacaagcgggggtggt

SEQ ID NO: 10171 - DNA, 201 bp, Homo sapiens
tattttaggtgctaggaaaacagcagtggataaaacaaaaattccttagagtttatattctaatggcgagtcataagtaatctacaaaataaataaatatmcagtattctagatgatggtaagtgttttaaaggaaaaatgaaacaacaaatagtgatagtacaagcgggggtggtggtgataatttcaagtttaggtagg

SEQ ID NO: 10172 - DNA, 201 bp, Homo sapiens
attaataatacagctgtcctttttctcccaatcataagttaaaagggaggaaatagaggcaagtgaaagagcagctctcatcctgatcagaccttttctcytggcatttgtctcttcctctgcccagccatttctgtggcattggcttctgatcagtatcagtcttgatttatccatctcagttcttccttcacctttcat

SEQ ID NO: 10173 - DNA, 201 bp, Homo sapiens
agtctctatttgtgtcacattcactaacatcacaaagcaaatcatgtgattaagcccagtgtcaaggggcggaacattctgtcctacccatagttggaagrtactgcagggttatgtggcaaagggaagggtgaaaacttggggcaaaatttgcgacttcctatactgggtcaaaagacacccttgtttcaaggcttatga

SEQ ID NO: 10174 - DNA, 201 bp, Homo sapiens
tgttaatatgctagtatacatctgtatatgggaattataggtgaattttttttttgcgatggagttttgctcttgttgcccaggttggagtgcaatggcaygatccctgctcactacaaccgccacctcccaggttcaagcgatcctcctgcctcagcctcccaaatagctgggattacaggcttgtagtaccacgcccag

SEQ ID NO: 10175 - DNA, 201 bp, Homo sapiens
gagtcatctaagtcagctatgtaaatgtatatatatatatacacacatatatgtaatatctgtatgcataaattaccatgacttcaaaatttgacaaatgkttcaggtaaatagtggattttatcttttaaatcacattaaggctcccaagtggatgcatcctgagttctggacacataatttatcataggcatcacatgg

SEQ ID NO: 10176 - DNA, 201 bp, Homo sapiens
tgcttgttctttatttctttttcacctgaatgctctttcaagaatattcaaaaacacaaaaacaaaaacttttcccctggagagtggggattagctcaagwatcaccatgatgatgagaagcagaaaacctggtttggagagtcctggacctggagaacaccaaaaagatgttagcatcttgagtatattgttctgatcta

SEQ ID NO: 10177 - DNA, 201 bp, Homo sapiens
gacacattctctcacggcaagtacatctgcacctggatgccttctactagtatgacatacttaaaagtatcttggatatgccttaaagatcattgttggckgcttcttgatggcaaagtgctcagttagagccagtttaaacacatgtcaccagaactgaataaatagattttgataaaactgattcagtgaatatctccc

SEQ ID NO: 10178 - DNA, 201 bp, Homo sapiens
agaggtgggagcatgaaagttcacctaatagcttagttttgttaagtctcattgccacagtctgcaccttatcctgatgttctcactggaaaataactagmctagttcctgagaaggaattgtgaacagggcattgcctgtttgtcaaaaagttatttaaagtcactccagctcctcacttaacctctctatgcctgtttc

SEQ ID NO: 10179 - DNA, 201 bp, Homo sapiens
tatctcagtccatttgtgctgctggaacaaaataccacagactgaataatttataaataatggaaacttatttctcacagtcctggagtctgggaagtccragatccaggtgctggcacgtttcatgtctgctgagggctgctctctgcttccgggacgacagcttgttgctacttcctcctaaggggaggcatactgtgt

SEQ ID NO: 10180 - DNA, 201 bp, Homo sapiens
gggacgacagcttgttgctacttcctcctaaggggaggcatactgtgtcctcacatagctgaccttttatagaggttgctaatgccactcacgagggttcygccctcatggtttaactacttccccaaagccccacctcttaatacttatcacattggtgattaagtttcaacacatggattttaggcgacaatcagacca

SEQ ID NO: 10181 - DNA, 201 bp, Homo sapiens
tgttgttctgtccattatctgtaaggctcaaatatagaaagaaagtgcatccatatcagtgagagacagttcagagtgattgtgggtgagctcatggtttyctgcagctgcaggactagagagagctacttcatgatgttggagatctggagtttaggaagcctaggaggtattcaagcagcagtcagtcagcttgccttg

SEQ ID NO: 10182 - DNA, 201 bp, Homo sapiens
cctcctgtcaggtgccctgtggttctcattagggcctctgggatactaacattcacacaggcaatgtactttcccttcctgacgcctctggggcccacccrggaccgtcaaacagaccctgcaaagcttaggagatcaattccaacagaagtccagagccatggtgctcttggaaaaatcacaaaccaaaatatagaagta

SEQ ID NO: 10183 - DNA, 201 bp, Homo sapiens
gtctggagggaagaggctgctggtgcctatggccctgaggaccagctttctccttcccccatgtccccaggccaccccacccagagcatgccctcggcacscaacaagcggcatgttccaggttgttccagggccagagagagtgacatgaggcaatgtctgtggcaagcgaaaaatgtgtgctgagccttgggaggcgcc

SEQ ID NO: 10184 - DNA, 201 bp, Homo sapiens
taactacctattgtcttctagtgtcagtaccacaggagtaactccacatctttgagttaataaataaatttacttacttattcaataaatattctggactmtttacggcagttctgacaatgttctaaatgtataggctatggtggtgagcagaacaaagtccttggtctcatgaagctaacattgtaaagggagatacag

SEQ ID NO: 10185 - DNA, 201 bp, Homo sapiens
cctattgtcttctagtgtcagtaccacaggagtaactccacatctttgagttaataaataaatttacttacttattcaataaatattctggactctttackgcagttctgacaatgttctaaatgtataggctatggtggtgagcagaacaaagtccttggtctcatgaagctaacattgtaaagggagatacagacaaaa

SEQ ID NO: 10186 - DNA, 201 bp, Homo sapiens
ctattcctgggaaagggggtggcagaggagagagagatattgagacaggctacatatcataatatcatgggttaaaccaacagcaattttagaccccaagrggacaattcgcatagctgcagacgtttttccttgtcacactggggatgggtggggagcgctactgacatctagtgggtagagacctgggatgaggttcta

SEQ ID NO: 10187 - DNA, 201 bp, Homo sapiens
gggttacttacacactggatctctagatacaggactaaagtcataatggaaatttaagattccatttggatgctgatttttttcccaagctctcttcactrtttattaaatggttagtgaagggaggtggaaagcttgatctccaggcaagtgagtcccttggacgtggggtggggagggtgaagctctggtgtggtactg

SEQ ID NO: 10188 - DNA, 201 bp, Homo sapiens
ttggactggatatctccaagggccctactaacaataagattatggactggggatggcttttcttctttccattttgttcaaggaagcctcctcttcgtcayttctcacctaccacccagctctgtattttcccatatttcaatgtcctttcatgaagacatataaacagtggccatgagtcaaggggatgcaagggtatct

SEQ ID NO: 10189 - DNA, 201 bp, Homo sapiens
ctctgggccaccttgaagggcaagttgacaaaataaagcaaagcccagacagccttacagagtagtagattctgcattcctcattttcatggataattacygtagccttcaatttgaggaacatggcagtgatttgtgtgcagtttactcttctttcaggtgatggaaccagagccagaggcgtggatgtgactctgttgc

SEQ ID NO: 10190 - DNA, 201 bp, Homo sapiens
cattctcctgcctcagcctcccaagtagctgggactacaggtacccgccaccacgcccggctaattttttgtatatttttagtagacacagggtttcaccrtgttagccaggatggtctctatctcctgacctcgtgatccacccacctcggcctcccaaagtgctgggattacaggtgtgagccactgtgcctggccttg

SEQ ID NO: 10191 - DNA, 201 bp, Homo sapiens
cagctgtggggttcccagccaactgccttgtcctctgagggataaattccctttgaccgtgccacttgtgaaaacacagagcaagtgtagagtattttacrtataatttagaaagagagaggacttatcggtgggtggtaggaaaggacagaagatggattaatattttttctttatcacttggcatgttaaacttaatta

SEQ ID NO: 10192 - DNA, 201 bp, Homo sapiens
gagccatggccttcataggctagatggtcattggaaatgaagttgttggcaccgacagtcacagttatgaaaataagaatttggatctcagatttttctgytccctcttctcctgtgtattagtccgttcttatgctgctaataaagacatacccgagactgagtaatttataaaggaaagaggtttaatggactcacagt

SEQ ID NO: 10193 - DNA, 201 bp, Homo sapiens
agagagaattagagccaagtgaaagaggaaacccattataaaatcatcagatcttgtgagacttattcactaccacaagaacagtatgagggaaactgccyccataattcaattatctcctaccgggtttctctcacaacacttgggaattatgggagctacaattcaagatgagatttgggtggggacacagccaaacca

SEQ ID NO: 10194 - DNA, 201 bp, Homo sapiens
ctcataatttctatgatcacagccccattgtctgttggagctgagggcattgtaagtttttgtaagcagcctttgataagttttagaggtgtagagaaagmgctctgtctcctccctgggagaatactcctttccctacacctcagaggaccaaatcatgtctttattaatatgaagcattcattccagtggcatatttta

SEQ ID NO: 10195 - DNA, 201 bp, Homo sapiens
gcacaatgttccaggatgcagaattgaatagcctagcctgggtcgctcccctctgagaagattacagtgtaatatgataattattaccatagtgctacccytggggcagaggacactcagagaaggggtatctgatttagacatggggatcactacagctgcctggaggagaggaagcttaaactgtgttgggaagtgtga

SEQ ID NO: 10196 - DNA, 201 bp, Homo sapiens
ttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcaca

SEQ ID NO: 10197 - DNA, 201 bp, Homo sapiens
gaacatactgaccaggattttggctctgccacttgccagatttgtagctttagaaaaattacttacactcttcagggcttagatttttgaactagtctggkactcagttgagatttgctattctgtattgtttcttttctgtctgtaatgctttgttctcattcctgcatactgaaactcttcctgcaggtttttctctct

SEQ ID NO: 10198 - DNA, 201 bp, Homo sapiens
gaggtaggtagggaggtaattaggtttagatgaggacatggggatagagcccccttatgggataagaaaatgattataagaagagtgctcgatatggttargctttgtgtcccacccgaatctcatcttgaattgagattcccataatccccataatccccatgtgtcaagggagagaccaggtggaggtaattgaatcat

SEQ ID NO: 10199 - DNA, 201 bp, Homo sapiens
gcccccttatgggataagaaaatgattataagaagagtgctcgatatggttaagctttgtgtcccacccgaatctcatcttgaattgagattcccataatscccataatccccatgtgtcaagggagagaccaggtggaggtaattgaatcatgggggttgctccctcatactgctcttgtgatagtgagtgagttctaat

SEQ ID NO: 10200 - DNA, 201 bp, Homo sapiens
tgtctccctggccctttatgtaatatttggatagcgcaatccttagctgcatgcagataatgtgttaggcagctagaaaaataacctgcttgtactgtttmtgatttattccccctcctccctcacgtctttgttcacagtaaacacatcactgcagagtagctagcaaatgaatgcctttttatcagaggtacatgccca

SEQ ID NO: 10201 - DNA, 201 bp, Homo sapiens
gcctcttaaagtgtcttcttaaagtggcacaaagagagcacctctgtgagtgcagggtgattgggcacgcagtaggagaagcactcagggttagcaagtgrttttcctgacacaaaaccatttgttggcaagatctgtgggagaaacattctggattttgtatttcttgacctttccgtgctttcatttggtaaactttgc

SEQ ID NO: 10202 - DNA, 201 bp, Homo sapiens
tgggagccctggctctgcatctggctagctttgtaacccagtcccacgtctactgaccccttgacttcctgttcctttgtgtgtgtgtgtgtgtgtgtgtktgtttgtttgtttgtttgtttgttttgagaaggagtctcgctgtgtcacccaggctggagtgcagtggtgcgatcttggttcactgcaacctccgcctcc

SEQ ID NO: 10203 - DNA, 201 bp, Homo sapiens
cccaggttcaagcgattctcttgcctcagcctcctgagtagctgggactacaggcgtgtgccaccatgcccggctaatttttgtatttttagtagagacgsggtttcaccttattggtcaggctggtcttgaactcctgacctcaagatccacccgccttggcctcccaaagtgttgggattacaggcgtgagccaccgca

SEQ ID NO: 10204 - DNA, 201 bp, Homo sapiens
ttttttaaaattgtactggaatcttatgagaaacacgagggattattctttttgcttttaagatttatccatgatagagtataagataagccatgggactygcttctctcccaactcaccatacccaaaagatattaatcttggtaagatcccacaaccaacactatgcttttgcaagagcatccaaagttgtgattttgg

SEQ ID NO: 10205 - DNA, 201 bp, Homo sapiens
cttttccagaggcaggtgctgcccagtgccagctccagtgactctgggacgttgatggaaatgtgaatctggatgaggcacacatgcaggaggcttggagkaaggactcaactgggaattaggaatctaacatcctggaaatcaaagttgtcccctgttaatatatctgcttcatggttattttacaactaatgaacttat

SEQ ID NO: 10206 - DNA, 201 bp, Homo sapiens
aacccgggaggcagagcttgcagtgagccaagatcgcgccactgcactcagcctgggctacagagcgagactctgtcaaaaaaaaaaaaaaaaagagactrgtaatagcctgagatgaagaaatgacaaaaatgaaataaatactttcttctagttttatgcaccatattagtactataattgaatatgcaatcactaaag

SEQ ID NO: 10207 - DNA, 201 bp, Homo sapiens
gcccctcatcatttatattcattattctctatatattctgggctgaaggaaggacatgttaagtaaaattctttaataccttatacttccctgttcatcayccaagcaaaacttggtaccacctctagatcccactttcctgttttaggatcagaaagcatttggctcctaaaatatctgtaggaagtttcacataatatc

SEQ ID NO: 10208 - DNA, 201 bp, Homo sapiens
tcccaaattctgtaaaccttcatgacttctatattattttctaaacatgtatgtgtgaatatagtgagtatctaattttggtagcaattagtgttgatatstgtgctactgtatataaaaaacatttcagatgctctactttgggctctagattcattgtggatatttttcattattattaattttgtttgtatgaaaatt

SEQ ID NO: 10209 - DNA, 201 bp, Homo sapiens
gcattttgtttctgcagcttcgtagattttcctcattctttgaatatatgtttttctttttaattaagttagccattgccacgatgccataattttaattycttccagaaaaagtcttccttttcctcttttaatttactaccctttcccaactatttttttcttttatgttaacctctagctttggaattaattagccgg

SEQ ID NO: 10210 - DNA, 201 bp, Homo sapiens
atggcatccaggctttattaaccagaaaacactatactttctgaagtgcttatcaaaaagtgcttaccaaattttcttctgccacatgattgatttaatgycttctaatgtcaatgtgaaagcgtaagaaatgataggtgtctgcctacgttttctgtttgataaaagtgtaactccttacgaatactaaacaaatggtat

SEQ ID NO: 10211 - DNA, 201 bp, Homo sapiens
cggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgca

SEQ ID NO: 10212 - DNA, 201 bp, Homo sapiens
tgacatgtctaaatcaatgactggatctgtcctcaaatctatgagatgatagattgcagcagaaacaaccttgaacttggaagtaggtgtcctacgttttyattcccgcttaagctggttgcatgacttggggtttgtcactttagtactgtattagtctgtttgcatgctgctgataaagacatacccaagactgggtaa

SEQ ID NO: 10213 - DNA, 201 bp, Homo sapiens
tcttatgagacttattcactatcatgagaacagcatgggaaagacctgaccccatgatttaattacctcccactggcttcctcccactggctccctcccaygacatgtgggaattgtgggagctacaattcaagatgaaatttgggtggggacacagccaaaccatgtcaagtaccctgtagttctatttcctcatctaac

SEQ ID NO: 10214 - DNA, 201 bp, Homo sapiens
tggaagctcttatcccacagatggctgtgtttataaattaaatgcagtcacacaggtgaaaggccattgaaatcacaaggaactagatgagtgcaaagttkgattttgtgattttgacctggcaaataggaaagctctagctaaaagtggctcaatctgttgttgtgtaccctgtctaaaatataacatatgtattatttt

SEQ ID NO: 10215 - DNA, 201 bp, Homo sapiens
aggtcaattgttgaggcaaaaagaatcagactaaatttggtagagctctttcagaacactgtggcatcaaagcagtgcactgcacattttaagctaagctycattgccgaagatatctataccatctccctggggatgttacttgagaagcaaacagtgttccttcttgtagataacaatcccttgtgacatcttatgagt

SEQ ID NO: 10216 - DNA, 201 bp, Homo sapiens
acaacttctctggatatccttgtcttgatctgtaaaatgaggatagtaatccctgctaatccaaatgcacactactgtagagaccttcttgtaaatgtagyatagaacacacattattgctttgggtagcaaggtaaacatcttgctgtacatctttattccattaaggaagatgtacggaaaagcactctgtgggtttgg

SEQ ID NO: 10217 - DNA, 201 bp, Homo sapiens
gccccagagggttagtttgctgactcttgctatagttaaatggcaggcaaaacttgataattataatgcaacatattaaactctatctatctatctatctrtctgtctgtctgtctgtctgtctgtctatctatctacctacctacctagatctatctgtctacctagatagatagatcagtcaaagttttcacaggttta

SEQ ID NO: 10218 - DNA, 201 bp, Homo sapiens
gaccccaatagagagttcttggaccaagaaaaaattcagggtgagtccataaagtgaaagcaaatttttaagagagtaaaggaatgggaataaaagaatgkctactccgtaggcagagcagccctgacggctgctggttggctattttatggttgtttcttgatgatatgctaaacaagaggtatatatttattaaatacc

SEQ ID NO: 10219 - DNA, 201 bp, Homo sapiens
gtattccatggtgtatatgtgccataatttcttaatccagtctatcactgatggacatctgcgttggttccaagtccttgctattgtgaatagtgccgcartaaacatacgtgtgcatgtgtctttatcgtagaatgatttatagtcctttgggtatattggccggcttctttaccacattctgttttatcagcaaggtct

SEQ ID NO: 10220 - DNA, 201 bp, Homo sapiens
gcaagtgatgaagaaccaagggacaagcaaaggcatcaatatattgtttgctatttgaggaccaactgtatttatttatctttgtatctccagggccaggyactatggctaccatgtattaagtacatgcagtcagtgctgaattgattacttctggtcattagattagcacagctgagctgaggtagcttggaccatgtg

SEQ ID NO: 10221 - DNA, 201 bp, Homo sapiens
cattgtgagtgtttatgtggctggggcaaaagaagttgtggtttcggtgctgatccattagcagtgagtgtggtaggtgaaagttccttaattgttccccrgagtaaaaacatcccagtatttatagactattaggggagagggggttggagaggcaggtgacttttcagccctacactgatgacttttatgtcttccagg

SEQ ID NO: 10222 - DNA, 201 bp, Homo sapiens
gaattaataaagaaatgagtggaatctaaaagtctctaaacataaagaaatacctgtaagatgtctcttctgagagcccattatatagaaaggagtcaaargaagaagagaagccaagtgcatggatccaggagagtaactggtccagtgcatttctgtttaccatacctttattcctctaaattttttcagcagttctgg

SEQ ID NO: 10223 - DNA, 201 bp, Homo sapiens
tatgctgaatctactctgcctgtactctgtaagttgaacaacaaagtctggatgagagcccatctgtttacagcatggtttactgaatatttcaagccaawttttgagacctactactcagaaaacaaagtattttatgtaaaaatattactgttcatcgacaatgcacttagttaccaaagagctttgataaaaatgttc

SEQ ID NO: 10224 - DNA, 201 bp, Homo sapiens
ccttattatttaagaaatacagtttgtaaggctatagcttccatagatagtgatttctctgatggatcacaaagccttttagaaaggattcaccattctaratgccattatgaacatttgtgattaatgaggaaaggtcaaaatatcaacattaacaggaatttggaagaagttgattccagctctcatggatgactttga

SEQ ID NO: 10225 - DNA, 201 bp, Homo sapiens
tattacataacttaattggtaaaggaatgataaggtttgagaagattgactccaattttgtaagaagttcagctgaaggtaaaatgctgtcaaacagcatyacatgctacaaagaaatcttttgtgaaaggaagagtcaatcaatgtggcaaacttcgttgttgttttattttaggaaattgcacagccaccccaacattc

SEQ ID NO: 10226 - DNA, 201 bp, Homo sapiens
cacactggggcctgtaggaagacagagggtgggaagagggagaggatcatcaaaaataactaatgagtgctaggcttaatacttggtgatgaaataatctstacaacaaatccccatgacacaagtttacctacgtaacaaacctgcacttgtacccctgaagttaaaagttaaataaagaaaagaagcaccttttctatt

SEQ ID NO: 10227 - DNA, 201 bp, Homo sapiens
cctaaaggaaaatgactacacctcccaaagcagatgactaattttcagaaattgttttttggaaaagtgggtctcctttttaatttcccattcgcaccccwtgtatgttctcttatcagtgaaggagatgagaagccactctggggaaaagacacgtagaagatcaagaaagctcttttcctcattgcgtgattgatactc

SEQ ID NO: 10228 - DNA, 201 bp, Homo sapiens
cagtgaaggagatgagaagccactctggggaaaagacacgtagaagatcaagaaagctcttttcctcattgcgtgattgatactcggttttgttttttttkttgttgttgctgttgttttatgggagtcttgctctgttgtcaggctggagtccagtggcacaacctcggcccactgcaacctctgcctcccgggttcaag

SEQ ID NO: 10229 - DNA, 201 bp, Homo sapiens
gccaccatgcccggctaatttttgtatttttagtagagatgcggtttcaccatgttggccaggatgatctcgatctcttgaccttgtgatccacctgcctyggcctcccaaagtgctgggattacaggcgtgagccaccacacctggccgattgatacttttttgttggttcattccagtgctgaaaattgggctggattt

SEQ ID NO: 10230 - DNA, 201 bp, Homo sapiens
atgattgtatcactatacttcagtttgggagacagagcaagaccttgtctcaaaaacaacaacaaaatatcctactccctctcattttttccccaagagtrttgaaagctgaatttgtgtaagttatacataaatatcatgcaacttcattgtactgcttattttcctaataagttaattgacttgtattatgctttacat

SEQ ID NO: 10231 - DNA, 201 bp, Homo sapiens
aagggataaataaaatttaaagggtttcaccctgggagtgattaagcatttggcctcgacatgacacataacacttctgctcaaactaattggccagaagyaatcatatggctccatcctgcacaaggggccgataaatacaatcctgtcttgtgccaggagacaaaggactagagcctactcagacagcaacaccaatga

SEQ ID NO: 10232 - DNA, 201 bp, Homo sapiens
ctatctctcacttctccaactcagttctttctatcagtgtcttgacatctaactagttaccctagagacctcaaagcaattattctttccttaaacattcyttcaaaacccagtcgttccttaggcatattgacttgaatcatgtctatctttgccattgctaccttcttagttctaatattcatcattattttctgggtt

SEQ ID NO: 10233 - DNA, 201 bp, Homo sapiens
gaagttagattgtacttgtcaatgagagacttaatccagattccatctctctaggacagaatagaccatttctatctacatggagtatcccttacatgatrtccatatttctctcttaacatcattgtacacatatgtttacatgtgtaacacttctactaaattgtaagctccttaaggtcagagaccatgtcctaacat

SEQ ID NO: 10234 - DNA, 201 bp, Homo sapiens
ttagagtgctgcagagacaaggttgtaaaaattctctcctatatcatcggtggttgaataaaattcctttattggtttttcttggaactgtaccctctagmcaaacagcccagtggaatccagtgatagaagccaaagaaataaaagctaagtgtctcaatttatcctgttgtcactttcagctttctctgctcattatta

SEQ ID NO: 10235 - DNA, 201 bp, Homo sapiens
aaatcttgcctctgccacataaaagctttgtgagcttggacaagtcatttacttctctcagcctcagttttctcatctgtaaaatgagataattatggcawcttatagaattgttgcgataatttcagatagtctaaatataaagcatttggcaggccaggcgcagtggctcacgcctgtaatcccagcactttgggaggc

SEQ ID NO: 10236 - DNA, 201 bp, Homo sapiens
tccgtgctatttcttttaccttcctatttcaaaacctggctaatgccactcatttatcaggtctcaccttagtactccatcctttcaaaggcatttctgaytgccccttccctctgcccacagcttgaattaagagctcatccctgatttcatggtagtttggaaatatctttttagaaacctttatcatgcaaattgctc

SEQ ID NO: 10237 - DNA, 201 bp, Homo sapiens
caagtcgcagaacaagaatttcaactcagagtatatgcttcaactcagaatatacttcaactcagcatatttgctgttaactatattttatgctgcttctygtgcctcagattgtgaggatcaaatagggtggccatctattccaggtcaccttggaaagttctgggtaatatctcctgtccaggtgaattattaatagtg

SEQ ID NO: 10238 - DNA, 201 bp, Homo sapiens
agtctgggacccttagggttaggggattaacccaagttctgcaaaggcatgtcatgggagccactgttcccagttcccacacccgtagcagacattgctcrttgatcacagtacaacagtcttccttacttagtgtcatagacaaccattcgtgatagatcacgtttgagatgtgaaattaaaattatttatcacacctag

SEQ ID NO: 10239 - DNA, 201 bp, Homo sapiens
tcttagaggatcttactggagtttgtgattgagcttttacttcttctgttagtgttctgctgagacatatacactaatgatagctgccactctggggtgcrgaactttccatatagattgccttaaaaataaaagcaaattttctatgcatacatgccggggaaaactctactaaatattcagtggttccaagaaatgcct

SEQ ID NO: 10240 - DNA, 201 bp, Homo sapiens
ataaaagcaaattttctatgcatacatgccggggaaaactctactaaatattcagtggttccaagaaatgccttttaaccatttgtaatactttagctttytaccttttcatctcattacttattttcaggcagaatagatatagaggcttctttctgcattatagtcttcacagacttaaaggcatcaggaagtagccct

SEQ ID NO: 10241 - DNA, 201 bp, Homo sapiens
acatggctctaagaaatgggagagctgctatccagttgtgtctgaaaagattaactggcagctagaaacttttaaaactacccattgactagttctatctyggagaactacaccccctacttgccagttcatgtcttatgtctctgcctgggtctgtctatgtcaagttcttatttgttaacttagtagaagcttagtgga

SEQ ID NO: 10242 - DNA, 201 bp, Homo sapiens
tgcttaacttcttactgttcacatctgtaactgggcataaacctataggatcattttcctttcacaaagaatccatcaaataaatacttgttaaagcctaygcttaacttgagcaccggtagtaatgactcgcattatcagcggggcttttgggcttgcactcatggctctgtgattcatgagggcagaaaaactgactgg

SEQ ID NO: 10243 - DNA, 201 bp, Homo sapiens
tgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttagg

SEQ ID NO: 10244 - DNA, 201 bp, Homo sapiens
gtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggc

SEQ ID NO: 10245 - DNA, 201 bp, Homo sapiens
tttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggct

SEQ ID NO: 10246 - DNA, 201 bp, Homo sapiens
ttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttgtagccctgcctcttaggctt

SEQ ID NO: 10247 - DNA, 201 bp, Homo sapiens
aataaatatataaagttatgattttatagtttattaaatccagagtttttcttttgttgtagccctgcctcttaggcttggcaattggcttagaagttatyctcaagagagaatctttctttttcttttcttttctttttttttttttttttttgagatggagtctcactctgtcacccaggctggagtgcagtggtgcga

SEQ ID NO: 10248 - DNA, 201 bp, Homo sapiens
tagaagttatcctcaagagagaatctttctttttcttttcttttctttttttttttttttttttgagatggagtctcactctgtcacccaggctggagtgyagtggtgcgatatcagctcactgcaacctccatctccggagttcaagtgattctcccactgcaggatcccgagtagctgggattacaggcataccgcacc

SEQ ID NO: 10249 - DNA, 201 bp, Homo sapiens
ctttctttttcttttcttttctttttttttttttttttttgagatggagtctcactctgtcacccaggctggagtgcagtggtgcgatatcagctcactgmaacctccatctccggagttcaagtgattctcccactgcaggatcccgagtagctgggattacaggcataccgcaccatacctgctaatttctgtattttt

SEQ ID NO: 10250 - DNA, 201 bp, Homo sapiens
tgtggaacagatatcgaggctcttacctttggaataaataaaatgggactcagaagggttattcagctgtcagtgagagtggtgttggctttttattcacracagtgaaaactccatataaatagacaggtaatttcagggccatggagtagatagagcactcaccctcaaagagcctttgagagaagtctggttatctct

SEQ ID NO: 10251 - DNA, 201 bp, Homo sapiens
tctcagttaggtacccttctcacagaagagttcctcttcactgctcttgtatcttgttaaaaggcttttttttccctcctttttattctgtccccagcctsctgtaggaatgcctgatctctctttctatttattgttccatggagccaaacctccttctgtccctttgggatgacctattgttatacattaataattaac

SEQ ID NO: 10252 - DNA, 201 bp, Homo sapiens
taggtacccttctcacagaagagttcctcttcactgctcttgtatcttgttaaaaggcttttttttccctcctttttattctgtccccagcctcctgtagsaatgcctgatctctctttctatttattgttccatggagccaaacctccttctgtccctttgggatgacctattgttatacattaataattaacctttact

SEQ ID NO: 10253 - DNA, 201 bp, Homo sapiens
cataacagatttttttcccataggttattggggttcaggtggtgtttggttacatgaataagttcttaagtggttatttgtgagattttggtgcactcatsacccaagcagtatacactgcaccctatttgtagtcttttattcctcaccctcatcacacccttcccctcaagtccccaaagtccatgtatcattcttatg

SEQ ID NO: 10254 - DNA, 201 bp, Homo sapiens
tcacattttcttgatccacttgttgattgatgaacgtttgggttggttccacaattttgcaattggaaattgtgctgctatacacatgcctgtgcaagtayctttttcttataatgacttcttttcctctgggtagatacccagtagtgggattgctggatcaaatggtagttctacttttagttctttaagggatctcca

SEQ ID NO: 10255 - DNA, 201 bp, Homo sapiens
cctgcctaatattccattataacgctgtgccatctgctattgatggtcatttaggttgtttctggtgttttactaagggtgcttcagtaaatcactttgtwtgaagtatgtgaatccatgcaactcgatctctcttgatttttatttgcaagcttatgttgtataactttctgacaacacaagaaattggccaggagacaa

SEQ ID NO: 10256 - DNA, 201 bp, Homo sapiens
ggccagtaagagagagcaataagttccccaaaaggctgaaactgggagtgactgagctttggtgggttggcttttctgcataattccaaagctaggctgayggcagagatagcaatattgcccttaggaagagctggatgggttctttgcagagggcagatgggtggcagattgcagccctggctattttattgcccagta

SEQ ID NO: 10257 - DNA, 201 bp, Homo sapiens
ccagtaagagagagcaataagttccccaaaaggctgaaactgggagtgactgagctttggtgggttggcttttctgcataattccaaagctaggctgacgrcagagatagcaatattgcccttaggaagagctggatgggttctttgcagagggcagatgggtggcagattgcagccctggctattttattgcccagtagg

SEQ ID NO: 10258 - DNA, 201 bp, Homo sapiens
agttccccaaaaggctgaaactgggagtgactgagctttggtgggttggcttttctgcataattccaaagctaggctgacggcagagatagcaatattgcycttaggaagagctggatgggttctttgcagagggcagatgggtggcagattgcagccctggctattttattgcccagtaggaatctttactggttgtctg

SEQ ID NO: 10259 - DNA, 201 bp, Homo sapiens
ctttggtgggttggcttttctgcataattccaaagctaggctgacggcagagatagcaatattgcccttaggaagagctggatgggttctttgcagagggyagatgggtggcagattgcagccctggctattttattgcccagtaggaatctttactggttgtctgaaatctgatcagaaccaagagccttcaaattaaat

SEQ ID NO: 10260 - DNA, 201 bp, Homo sapiens
caagagcagagtcagaaagctgttccagaattataaagaaaacactgctgttggtttttaagagcatgtgtttgggatctctgaggttaggtcacggtggrcgggttttgtgtctgactaacctagaccttggcacagcataaaagttaccttacccgtgtctcaggcaggctaaaacacacaaaattgccatttgttcat

SEQ ID NO: 10261 - DNA, 201 bp, Homo sapiens
atatgtttgaatttcagaagtcttaaatttcatacctgggagctaaagcactggctaattcttttctcttttttttttttttttttttttttgagacagartttctctcttgctgcccaggctggagtgcaatggcgcagtctcggctcactgcaaactctaccttccaggttcaagtgattctcctgccttacctcccaa

SEQ ID NO: 10262 - DNA, 201 bp, Homo sapiens
catcaggaccaagtttttgctaagggtatagctctagggctttgagaatgctgtacctgtatagttcttgccctcaagaagtttatcatttatttagctgmggagttgagacatctatataataagctgtaataagatgatgtaagacagtagcatgttagtggacagaaaagaaggacatggagattcagagacagaaga

SEQ ID NO: 10263 - DNA, 201 bp, Homo sapiens
atcagaagataggtgatgtggatggatcctgggccaggtctagaacaagggctgaatgaccagttttcaaggcctgtttttttgtaaggccaactgtgggrccaactgtgttactagctaaggtatatttcaagagaactacaaaccctttttacagtcagatcagaaatagaatacaggacatgaggacaaaggaagaaa

SEQ ID NO: 10264 - DNA, 201 bp, Homo sapiens
ctgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttt

SEQ ID NO: 10265 - DNA, 201 bp, Homo sapiens
tgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcattttt

SEQ ID NO: 10266 - DNA, 201 bp, Homo sapiens
gattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttc

SEQ ID NO: 10267 - DNA, 201 bp, Homo sapiens
tctgacatatgcaccagctgaacacgaagaatacaagtatttttacttctctccagtgactcttgttccagtgggaaaggcatgcaggcagcagctgctgytcctctccattcggggcctccctttttaggcaacctcctatgtgatcctgggtagcagcagcagcagcagcaaaagcaaatgattctgcctggaaagggt

SEQ ID NO: 10268 - DNA, 201 bp, Homo sapiens
accagctgaacacgaagaatacaagtatttttacttctctccagtgactcttgttccagtgggaaaggcatgcaggcagcagctgctgctcctctccattyggggcctccctttttaggcaacctcctatgtgatcctgggtagcagcagcagcagcagcaaaagcaaatgattctgcctggaaagggtgagataccaatc

SEQ ID NO: 10269 - DNA, 201 bp, Homo sapiens
gggttggcagaggccaggcgtggtggctcatgcctgtaatcccagcactttgggaggctgaggtgggtgggtcacctgaggtcaggagttcaagaccagcytgtccaacatggcaaaaccccgtctctactaaaaatacaaaaattagctgggcttggtggtgcatgcctgcaatcccagctactcaggaggctgaggcat

SEQ ID NO: 10270 - DNA, 201 bp, Homo sapiens
tgacagagtgactccgtctcaagaaaaagaaaagaaaatagtgaaaatagtagggttggcagataccgttagtgttacctgcacctcattcctgttttggyaaatgaggaattggaagccctgagaagttaagtcaacatcagtttagcttggaattgctatagaatggttagaatttatgattcctgattcctaatgcat

SEQ ID NO: 10271 - DNA, 201 bp, Homo sapiens
cagcctttccttcatatatactgttatatacatatactagatggttattaaatgtgggagggctccagggtttctgttttaggtctcttcttggcctgcayggttcccttggtgctcttattctttgccacgatattaaaggtcatctatatgttagtgacttccaaattgaggtctcttgcctagaactctccctgaaat

SEQ ID NO: 10272 - DNA, 201 bp, Homo sapiens
atatactagatggttattaaatgtgggagggctccagggtttctgttttaggtctcttcttggcctgcacggttcccttggtgctcttattctttgccacratattaaaggtcatctatatgttagtgacttccaaattgaggtctcttgcctagaactctccctgaaatctcagattcttatgtccctagttgtctactt

SEQ ID NO: 10273 - DNA, 201 bp, Homo sapiens
cttaatcatatcattgaaaagcagaaatcttgaggtcttccttcctgccccagacttcttttactttcagtttttccccttcttggtaaatggcatccctrctgtccttgggcattttcttttatttttgtcctatgatattcaatctatctcagcaagtctcatccatttctcttataaacccatcctgcatctgtccac

SEQ ID NO: 10274 - DNA, 201 bp, Homo sapiens
tcactggtgtgggaataagagaaacctgggcttccaaggtcaaatataataatggtggttgctttcactggtctcagtgctattgaggaggggaatctgcrttatggctgtgccctcatccctcgtaggtttccagatcctttatttaaatgtctgacctggagatggatcctctgacctttcttttctgcaagaataaaa

SEQ ID NO: 10275 - DNA, 201 bp, Homo sapiens
tttcaactctaaaactctgattctcaaatgtcatcagcttggcaatgctttctcttatcccaaggagagagagaaaggtgaatgaagggcagcaatgtgartccttgttccttacaatccgcagaactgtctggattaggactcggtttagttatatcagcactgcaatcaaattttcatctccctgattcattcatccaa

SEQ ID NO: 10276 - DNA, 201 bp, Homo sapiens
gaatcgaaccttagatttctaaagagcattaaaaggctgtttcctctttggtccattgtttactctttttgatagataatgacatgtatctgagaaagggrcttcccaagaaatgtgcaattcatttacataaatcaaactgtctccttttttttttgtttgtttttttgcttttctgttgttgcttaagtcatacaaatg

SEQ ID NO: 10277 - DNA, 201 bp, Homo sapiens
tggttcttaatatatactgagtcatttaaccctcacatccactctgcagactgcatattattatcctcactttctacgtgaagaaattaagggccacccarttcattctgaatacctactgagtgctacgtgccagggactgtgttgagcacttgggacacaaaggcattgactgtggttctcataaatgtgctattatat

SEQ ID NO: 10278 - DNA, 201 bp, Homo sapiens
gtagctgagagtcaaacctacacctgctttggtcccactcggaacatatgtatttaccttctcaccttctctctgtgcctccgtttcaatatttgccatgrcaatattggcagtgggtgtttaactggcttattgtgaggctccattgtagaatcaaagtgtataatgtgctcacatagataacaaagttaatattcccct

SEQ ID NO: 10279 - DNA, 201 bp, Homo sapiens
accttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtt

SEQ ID NO: 10280 - DNA, 201 bp, Homo sapiens
ccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgttt

SEQ ID NO: 10281 - DNA, 201 bp, Homo sapiens
acatagataacaaagttaatattcccctttcagaatctggagtttagcaatgcaagaattgaaaaaatgatctggctggtgtttttactccatttttttttcttgtgtggtggaaatgacccaggtcttatttctgtgtttaaggcatatgatacaggttagagtttaaaattgagaaggttggaccataagagaacatac

SEQ ID NO: 10282 - DNA, 201 bp, Homo sapiens
ctgttttatcatgggttctgttttaatcccaccaaggactgttaagaggaaaaagcagcaaacatgtagtaatcaagaatagaagtcccaaacttaaaacytaaaacttgactgacccaacaaaaaccaggcagagtataaagagttgtgtaattacttatcttgccagtagaatagatgctcagatactatctagcaaaa

SEQ ID NO: 10283 - DNA, 201 bp, Homo sapiens
tcttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatat

SEQ ID NO: 10284 - DNA, 201 bp, Homo sapiens
cttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatt

SEQ ID NO: 10285 - DNA, 201 bp, Homo sapiens
ttgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatattt

SEQ ID NO: 10286 - DNA, 201 bp, Homo sapiens
tgccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatttg

SEQ ID NO: 10287 - DNA, 201 bp, Homo sapiens
gccagtagaatagatgctcagatactatctagcaaaaccacccacccccaattttagatgaagaaactgaggcctccaggtgggaaatgagtggtcaatagaatagaatagaatagaatgttcttagtccctcgttttggttcctatttattggctttttcaaagaaatatacatgcatctgtgcatctgtgcatatttgt

SEQ ID NO: 10288 - DNA, 201 bp, Homo sapiens
aaaaccacccacccccaattttagatgaagaaactgaggcctccaggtgggaaatgagtggtcaatagaatagaatagaatagaatgttcttagtccctcrttttggttcctatttattggctttttcaaagaaatatacatgcatctgtgcatctgtgcatatttgtgaagatatacttttatgtctcatgatcttctag

SEQ ID NO: 10289 - DNA, 201 bp, Homo sapiens
cgttttggttcctatttattggctttttcaaagaaatatacatgcatctgtgcatctgtgcatatttgtgaagatatacttttatgtctcatgatcttctmggcagtagtcatgccgttatagcaaagccatttggtaaatctccagtaatttgttctaactgataaattttatttgaaatgttggcaactgatttagagg

SEQ ID NO: 10290 - DNA, 201 bp, Homo sapiens
aaattcctaaattgctgtgtagagtctataggaatatgtactcttatctacatatgatgtactaaatgcttagcagtggttagcttatttaatctttgcartaactacataagatatgtgctattttcattcttaatttatatctgaggaattggggttaaggataggttaagtaacttgctcaaggtcacccaagaatac

SEQ ID NO: 10291 - DNA, 201 bp, Homo sapiens
cctttttttattatactttaagttctgggatacatgtgcagaacgtgcagtttttttacataggtatacatgtgccatggtggtttgctgcacccatcaayccatcacttacattaggtatttctcctaatgctgtcccttccctagacccccaccccctaacaggcccagtgtgtgatgttcccctccctgtgtccatgt

SEQ ID NO: 10292 - DNA, 201 bp, Homo sapiens
tccctagacccccaccccctaacaggcccagtgtgtgatgttcccctccctgtgtccatgtgttctcatttttcaactcccacttatgagtgagaacatgyggtatttggttttctgttcttgtaaacactcttttttattgtgataaaatacacataacataacatttaccattttagcttttttttttttttttttttg

SEQ ID NO: 10293 - DNA, 201 bp, Homo sapiens
gatggcttccagtacttcacaggggtctttgtgaagcaggccatgcccttccaaggagaaagcatgtattgttaatgcagtaactcacatgaatatcagakatagtgacacatatggactatgggtttgtgtagttggcaggattcactggtacatttatggtggtggtggggtgagtgcttttgttagtttcttatcctg

SEQ ID NO: 10294 - DNA, 201 bp, Homo sapiens
aaaccccatctctcctgaaaattagccaggcatggtggtgcttgcctgtaatcccagctacttgggaggctgagataggagaatcacctaaacccaggagrcagaggttgtggtgagccaagatcgcgccattgtactgcagcctgggcaacaagagcgaaaactccgtctcaaaaaaaaatgctgtgggcccacttcagg

SEQ ID NO: 10295 - DNA, 201 bp, Homo sapiens
actggatttgtgggggcggtggggaggtgcacagtggctcatgcctgtaatcccagtgctttgggagatagaggtgggcggatcacgaggtcataagttcragaccagcctggccaacatagtgaaaaccccgtctctactaaaaataccaaaaaaattagccaggcatggtggcaggtgcctgtaatcccacttctcagg

SEQ ID NO: 10296 - DNA, 201 bp, Homo sapiens
aatatggctgaggaatgcagaagagtgcactggtatatcaatctctaattggggaaatgatttggctgcagcacaaaggagcccctctctgtctaacattrggtttgccccttgagctttctgcaggcggagattgatggtggtggcgtgatggtcaaggaatgtgtcctcagatgaggctgagcagaattatttctttgt

SEQ ID NO: 10297 - DNA, 201 bp, Homo sapiens
aaaacctgtggtggttctacaaaacccatttcatgataaacaaaaataaatataattgagcataactgtaccaagcagaaatggttattattaacatatckgtatgctttattctattattttgggaatgtgtatatatatatgtgtgtgtgtgtgtgtgtgtctctgtgtgtgtgtgtgtgtattctattcttgaatata

SEQ ID NO: 10298 - DNA, 201 bp, Homo sapiens
ttataagaagcagtatttaatttctatacttacagatttgtggataggttgaggtggctctgttccaagctgtggagggctggaaatagctgcaagtttcragttagattcattaactccctcattactacattccttttggctccctcattaccacattctttttggaccagaggctacccaggggatattctcctatta

SEQ ID NO: 10299 - DNA, 201 bp, Homo sapiens
caaagtcacaagcaaaggctgtgggtatataattcagaaacaggggaggtgcaactaattatgaacaataaaacagtctactatagtagactacctgataytttgttatcactaatgtccataggttgatccaagaagactagttttttatcctttctgttaacctctaatgtgccccaatattgataaatgccatgagac

SEQ ID NO: 10300 - DNA, 201 bp, Homo sapiens
caactaattatgaacaataaaacagtctactatagtagactacctgatattttgttatcactaatgtccataggttgatccaagaagactagttttttatyctttctgttaacctctaatgtgccccaatattgataaatgccatgagacctttttccaaacacataggcttcagaagacatcagagtcttctccactgcc

SEQ ID NO: 10301 - DNA, 201 bp, Homo sapiens
tttagtttgtatttattttttgaaataataatctggttactgaattagacaccaagctcatggaaagcttggaccatgcctgctgcactattttctgcctyatgcctgggatatagaacgtgctcaacacattgttgttgacggtgataggttcagggcacaggtatcctgtatcctcagtctttgcatccaaaacttgac

SEQ ID NO: 10302 - DNA, 201 bp, Homo sapiens
gctgtgtgtagtgtagggaggtcatggatgtgaccatcgattgaaaatatattttatcatttcagaaaagacttcctggtagattacatgaactgttaagytaatttgctttttgggaaaatttagcacttggtatatcctctcattcttccctttccccttcctccttcccttcctctcttaatgcctcacacatttgtg

SEQ ID NO: 10303 - DNA, 201 bp, Homo sapiens
ttcccttcctctcttaatgcctcacacatttgtgatattggctgtgttagttgctgagaatgtaaagaggaatgtttcttttatctgcttgtctacctacmgttcttcctacttaatcccctatttgttccacaaaggattaagacacatacaaacaaataggaatggtccagccttctaattcctctgctcgggctgtgc

SEQ ID NO: 10304 - DNA, 201 bp, Homo sapiens
aaaggtaccagtaggggtccaaacacagttcccaagtgcactataggaaatccggatagagttggccctaaggcaccttaccctgcaccccaagatgaacwctaaaaatctgttcagctcattaaggggcctcccagcagggtggctccagtctgtgatctttgcagagcaaagtgatgggtgccctcattactgatgtag

SEQ ID NO: 10305 - DNA, 201 bp, Homo sapiens
tgacccgtgagctgcagctgcacacagacagctctgctgcccaacacactctcatcccagtcctcaggtggaggagggatagagtttactgggaaatggcmaaaaagggggggaggggtagaaatgggaacattttcaaattaatttcagaaatccagtcttagctctaaacgacagctgtgagtttaatcactgaaactc

SEQ ID NO: 10306 - DNA, 201 bp, Homo sapiens
gaatgtcagctgatatgaaagctttaccctcccctcccatttacctctcagaccccaccctcaggacagtggtatctgtccgtggctcccatctgtgtgtygctgcccatcacttcagaggaaccagaagcacctgccagagagctttatgtcatcagccatgggaacttcttccatgctgtttgttgcactggcctattt

SEQ ID NO: 10307 - DNA, 201 bp, Homo sapiens
gaagaatgatttttgagtaaagcccaggcccagtggaatctgccttgaccatgtggtgctcgtgtgggcccacagaaaaaaacccagaacattgcagtagyaaagtgaaagctctgtggactgtgaatgcagattagaattaaaagatgtgcttaccacactgtctctgtctctgtcccagagcctgcctgtgaacgccaa

SEQ ID NO: 10308 - DNA, 201 bp, Homo sapiens
ctcctgagtagctgggattacaggtgcctgccaccatgcctgggtatttttgtattttttagtagagatggggtttcgctatgttggccaggctgctctcraacccctgacctcaggtgatccaaagtgttgggattgcaggtgtgagccaccacatccagccatctccttgtatcttatgttcccatcccaaaaccaatc

SEQ ID NO: 10309 - DNA, 201 bp, Homo sapiens
ggatagagatgtagttatcaattagcagtgactgttgtaggtttcatggaaagaggagaagtgtgatatctttcaaggacacaattttcctccagaaaatycaggaatcctcattttatatccatgctgaaggctcctagagtagcattcctcctcttccctccctctccctctttttttgctgtaacaacacgtggggag

SEQ ID NO: 10310 - DNA, 201 bp, Homo sapiens
tctgggatgggagaaaatctggccagagtgtgtcttgtaggttgatcacaaattcctaatgttcatcaagagtggaattttgacggtataatgaaagcctrttttaactatgtaatactattcttattccattatgtaggtaatgaaagtttgtatgtaaataaaagtttaagcttctctttataataatttatcacagga

SEQ ID NO: 10311 - DNA, 201 bp, Homo sapiens
aatgttcatcaagagtggaattttgacggtataatgaaagcctattttaactatgtaatactattcttattccattatgtaggtaatgaaagtttgtatgyaaataaaagtttaagcttctctttataataatttatcacaggaactgcctgcaaatagattctaacgataagaatgttcttcttttagctataaatcctt

SEQ ID NO: 10312 - DNA, 201 bp, Homo sapiens
ttaatcataatcacttttttatttgaattgagctttacttagtttattgcctctattattgtctgagaggagcactcttatattgtctgctttatgcaggsaagtgtggttttaagatgagcttgggtcaaacatcaaagcaaaaaagatttgactataaatcctagcttcctcattaaccagcttggtcacctatcacaa

SEQ ID NO: 10313 - DNA, 201 bp, Homo sapiens
aaatatgtaagatactactttatctactttgttcatagtagttattgctgacatgggacaagatgatctttatgctctatttggtgtttgaattatagaaygcttcatgaattggattaattaatgtaaagtttttgaatgttggtgtttgtttaatcagtattctataatactgccaatctcttactccttgctatccac

SEQ ID NO: 10314 - DNA, 201 bp, Homo sapiens
atagtttcttaagaccaaggcacaaaatatttgtgtagaggagacatggggcaaaggagagaagaaaagcaagaacgaggttgtaaagaaccttgtatgcygagtaggaaatgttcatctttattccgaaggcaatggagggatccttcattgaaagccttctgagcaagggtgtaacatggtcagatttaagtcttatta

SEQ ID NO: 10315 - DNA, 201 bp, Homo sapiens
gcccaaagtgactcagctggcagatggcaagtaccaggctgatatcctgcaggttttttgtttgtttgtttgaaatggaggagtctcactctgccacctargctggagtgcagtgacgcgatctcagttcactgcagcctccgcctcccgggttcaaggaattctcctgcctgtctcctgagtagctgggattacagcata

SEQ ID NO: 10316 - DNA, 201 bp, Homo sapiens
ggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgta

SEQ ID NO: 10317 - DNA, 201 bp, Homo sapiens
tcattttcattttacatgaaagagaacacttgggtactggtgaaatgcttaggtcagcaatccttttgggaagatacacatgaggggtattatgtatctcrtctttccctctttcaacattttctaattcaattctatataataaatatttactgagtatctactctctgctgggtattgtgctaggttcaggggatatat

SEQ ID NO: 10318 - DNA, 201 bp, Homo sapiens
atcagactctgcagtagaaccaaatccaggacatccgtgtacagcctactcacatcacagcatctaactgtgttcacataaaaggcagtgtgaggcataaygacccaactcagaaatgccttttttttctggatgttcttttcctcacaaaacatcaaataagagagtctggccacattctgatgatttctcttagaaact

SEQ ID NO: 10319 - DNA, 201 bp, Homo sapiens
agtatgctgacaagatattattaaggctacaataaggcaattgaggaagctgtatgtcaataaggtcttgagatactcagagagattagacaaagcagagkaatattttcacctgcttaccctcctcttcccccaaaccataccaatgaacaacatgggccccagccctaaattcacaatctctgatgtaagagcctgact

SEQ ID NO: 10320 - DNA, 201 bp, Homo sapiens
gaagaagcagtgtggatagaggcccagggataggaagagccttgccctcagggctagttcagattggctgcaatgtggggcctgaccagagagagatggtkcttggctgcaagggtgggccagggtcatttcacgcagggggttgtaagcctggtcattaggagctttattctaaggacatcaggaagctgatgaattttt

SEQ ID NO: 10321 - DNA, 201 bp, Homo sapiens
agcattccaccgactctgcccttagatacagtgaccccagatgtcaattcagaaaccacacacccacgttacacagtctgtaagtgaccagccactcaggygaaacaggagacttgagtgatggcagcaaaatgaattgcctccaaattcaactgaatatgaaaacatggatgggttctcatttcccttcaacaaggaagt

SEQ ID NO: 10322 - DNA, 201 bp, Homo sapiens
aagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggt

SEQ ID NO: 10323 - DNA, 201 bp, Homo sapiens
ctactctgagttgggttttggtttgcttaggtaggaacccaccacactggagctgactcagcctaatggtctcccagttaattattttaacactatggtgkggttacaaggctctgtaccagttggcctccgtttctttgttcagccccagtcctgggtactccccaccccacaccgttctcctcactcccagccacacag

SEQ ID NO: 10324 - DNA, 201 bp, Homo sapiens
atcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagt

SEQ ID NO: 10325 - DNA, 201 bp, Homo sapiens
catggaaagtatgagagatatttctcacaaggctgcttatagcaagtaaaataccattagggtagtctctttttcattgaattattcatccagagtcattragggcttccctagacaatgtttatgtattttgtgtggaaagtataatatccaagaaaaaccattttcatattttttaacacttttaaatggttcactagc

SEQ ID NO: 10326 - DNA, 201 bp, Homo sapiens
gaaagcgaatgctgtttaagtgtttaacaggctgttttctctactcagctgatgactgttatatttcacatttactctgaatttgaaaactagctttgcartctcagcagaacttgttactctcatctgaatgtgccttgcctccaccttaaaacaaacctgaatcttaagactgatggttcagattttcataacaatgat

SEQ ID NO: 10327 - DNA, 201 bp, Homo sapiens
taacaggctgttttctctactcagctgatgactgttatatttcacatttactctgaatttgaaaactagctttgcaatctcagcagaacttgttactctcmtctgaatgtgccttgcctccaccttaaaacaaacctgaatcttaagactgatggttcagattttcataacaatgattaaaataggattctgggtggagca

SEQ ID NO: 10328 - DNA, 201 bp, Homo sapiens
cacatctggagaattggtacctgctcaccactttataattgtgtggcttcgggtcagttaatgtatctgagcctcaggttttttaatctgtacaatgaacrtattgttttgcttatgcagacaatgggactactctaatagcgaatttaaaataatgttgtaaaagtgctgtaatcactgtgctctaaaaatgtaagaaag

SEQ ID NO: 10329 - DNA, 201 bp, Homo sapiens
tgttcaaggcaaagccaggacccagagcctgcagtcttttttttttttttttttttttttgagacggagtttcgctcttgttgccctggctggagtgcaayggaacaatcttggctcactgcaacaacctctttctcccaggttctagtgattcttctgcctcagcctcctgagtagctgggactaggcgcccaccaccac

SEQ ID NO: 10330 - DNA, 201 bp, Homo sapiens
ctttatatatagcgaatgaataaaaataccctctttctttggtaaaataaaagaggaaaggcattctagatggggaaaatagcaaaagcaatgatgaagarataccaatgatttgttagtgataaatggatttttatacagcaagaattgaacatacatttggcaaggcggattggagccagcctaaagagtttagacttt

SEQ ID NO: 10331 - DNA, 201 bp, Homo sapiens
atgatttgttagtgataaatggatttttatacagcaagaattgaacatacatttggcaaggcggattggagccagcctaaagagtttagactttttgtttwgctctcattatcagaaatcgtcacttcctacctgtccaggtttgcataaaccatggatgctctgttttatggtcccatataatgaagattatgtgtaatt

SEQ ID NO: 10332 - DNA, 201 bp, Homo sapiens
gttttatggtcccatataatgaagattatgtgtaattacttcatagtggattgcactctagcaaaattaactgtccatatttcttctcatgagccctttgygttaataaatgatgcatttgaggaggcaaaaatggttgggattttctgtgggggaattcctcatgaggagataggaggaatcatggaaaatacctggttc

SEQ ID NO: 10333 - DNA, 201 bp, Homo sapiens
tcctctgtctcagaaagtggaattaatccaggtaatattttgactggattttgactggtaatatcagctgttgctgataaagtcaagattaatgattcctkggctaccagtgggctgagagtgtgaaagtcaaaacctgttagaaaccaggggaattgcccatgaaataagatggctttgtgaatgcgtaggtgactctga

SEQ ID NO: 10334 - DNA, 201 bp, Homo sapiens
ccctgatggctgatttcataaataagcttaagtgcaatgtgtaggaaaattggagtgaaagttggcaatggcgggagtgctggtatgtgttggagtaaggrtggcagggactacaatgtcactgccaacaaatggcaaattttatggaaattaaaatatcctgcaaagtgcggattcaaggcaatgctgtcccctttgcta

SEQ ID NO: 10335 - DNA, 201 bp, Homo sapiens
cacacagccagtacatggaaacattaggatctaaacatgatctaagtgttcctaatgaccatgccatatccagttaagaattgaattgtgcatacaatttrcaaactagttaagagtagagggaggaaagccaaacatcaacttccaaagcaacagaagttagatattctataataaagttatcggttgcatgttgccggc

SEQ ID NO: 10336 - DNA, 201 bp, Homo sapiens
gtgaagggagtgggtagaagaattatttaacctgcagctgggcaggttaactagagagaggaagctaaatgtatgctatggtcacctctgtagaggaagaragcacagaaaattttaccttttcctggattaccttcccttcttgtttgcctggtgtcctttttttgttttgtttgtttgaaatggagtttcactcttgtt

SEQ ID NO: 10337 - DNA, 201 bp, Homo sapiens
agtgaataaatgttgatatatatatatatacacacacacacacatacatatatacatatatatctttatatattctcaccttcccccatccattatttctktggctaaggccacctggattttctctgttttcatctccatatctatagactgcatagacctctcacacaaatttgcattgctagttgaggtgttctttga

SEQ ID NO: 10338 - DNA, 201 bp, Homo sapiens
tcaagaggtgaagaggaccgtgtcaccctagggtctatctaccacactgtcaacgtgcaatacccctggcatgtgtcgcagagcgccctcttgtctgtgtkggttactaattgttacagtgaaattagattcctctttccaaagaagtcagagttgtgaaatgcttgggaaactatgagctgtttccccatcccttactgg

SEQ ID NO: 10339 - DNA, 201 bp, Homo sapiens
aagtgcaattttggcaagaccttgtttctctagttgcataaggaatcactacatgataagaaacaagaaaagtttactggcagaaatagagaaaagatatrtacatctattttatctacctaaacataagtagataaaaatatgtgtaaatagttccttatgtcaggaaactgtgtctgaatatctttctatccttaaagg

SEQ ID NO: 10340 - DNA, 201 bp, Homo sapiens
agtgtattttctattttgttaaaaaagtaaaagtaaattgcaaagaagatacttggagaggaggaacaaagtaagtaaggcaaggacatgatggatacagrgggattaactggggagggaatgtctgtaaagtgtataaattttggggttggggggggtacagctaaaaggagctgtcctaaatcctggcaaaggccctcc

SEQ ID NO: 10341 - DNA, 201 bp, Homo sapiens
agctaaaaggagctgtcctaaatcctggcaaaggccctccactttaataagcgttgtaactttctctttcattgttggaggtaacacgtatgaaaggaaarcagcaatcagaacaatgcagtttcccagagggctctttagcagaagtctcctgtggttccatgctgttgttaatgctccccttattttagtctcctggac

SEQ ID NO: 10342 - DNA, 201 bp, Homo sapiens
ctttctctttcattgttggaggtaacacgtatgaaaggaaagcagcaatcagaacaatgcagtttcccagagggctctttagcagaagtctcctgtggttycatgctgttgttaatgctccccttattttagtctcctggactccctaaatgctttggaccacttgagcaaggccacgttgctaattgtgcagaacccctt

SEQ ID NO: 10343 - DNA, 201 bp, Homo sapiens
gttacactgtaatgggcaaaactgctttgcaaactcaagttctctaattctggatgcttttgtgtgatgacttattgctattcccatgtctctataccaaygacaaaacctttcaaccctctgagtttttcccctagctcctgggactatgggtgggagagtctgagggtcatctattgatattgaatgtggcaggagtga

SEQ ID NO: 10344 - DNA, 201 bp, Homo sapiens
tggacctcgtgatcaaccctcctcggcctcccaaagtgctgggattacaggcatgagccaccgcgcccggccacttattttcttatttgcatgctttatamctgctattacttagttcctgtgatgtttcccagaaatatggaattagctgtgccagacactatggccagaagactcaacagtcacatagcgttatgatgg

SEQ ID NO: 10345 - DNA, 201 bp, Homo sapiens
aatacaaaattagctgagtgtggtagtgcacacctgtagtcccacctacttgggaggctgagacagaaggattgcttgagccaagggtttgaggctacagkgagctatgatcatgccactacacgctagcctgggtgacagagtgaaaccctgtctctaaaaaaaaagaataaaaaatagaggttaaataactcatgggta

SEQ ID NO: 10346 - DNA, 201 bp, Homo sapiens
tgttgtcagatgatgctgatgttgctggtctcagagccctactttgaaaaccactggtctattgtaaggctttctttttacctatgagaaaactgaggacrtgagggaggccattcatgtacatatattattcaaatcctgttcctttccatccaaaagccctcatgtggtatcctgttgaagtttgaataaaatcccaaa

SEQ ID NO: 10347 - DNA, 201 bp, Homo sapiens
cccatccttccatatcagagtctccatagagccttacttactttcactgcagttattcaatggacacattcttatttcagcatgaaaaacaactaatatgrgcacatggcacagaacaaaagtgaaggtttgacttacagagaatttcaattccatttttcaattcctgccattttcttgggggctccaaatacagctaat

SEQ ID NO: 10348 - DNA, 201 bp, Homo sapiens
ctctattatatactgaaataatagtgatgtttgtctaaacaaccctagctggtcaaacaatggcaaccccttcccctggctgctgttttactcaccatttracaaaaaattaggtggtgcctttggaggaagagaagggagatttaggcggaaggatttttttttaaaaatttatttttgagacagagtctcgttctgtca

SEQ ID NO: 10349 - DNA, 201 bp, Homo sapiens
aaccccttcccctggctgctgttttactcaccatttaacaaaaaattaggtggtgcctttggaggaagagaagggagatttaggcggaaggattttttttwaaaaatttatttttgagacagagtctcgttctgtcacccaggctggagtgcagtggcaccatctcagctcactgcaacctttgcttcctgggttcaagtg

SEQ ID NO: 10350 - DNA, 201 bp, Homo sapiens
tgatccgcccacctcagcctcccaaagtgctgggattacaggcatgagccaccacacccagctgaggttgaagggattcttacaaagacatgtgaagagartaaattgaaaataaatatgattacattaaaactaagctcagtactttaagatgtcatgttctctgacttgataactgaagaatttgtgtgagtcatgaga

SEQ ID NO: 10351 - DNA, 201 bp, Homo sapiens
acctcagcctcccaaagtgctgggattacaggcatgagccaccacacccagctgaggttgaagggattcttacaaagacatgtgaagagaataaattgaarataaatatgattacattaaaactaagctcagtactttaagatgtcatgttctctgacttgataactgaagaatttgtgtgagtcatgagaagaaggtaat

SEQ ID NO: 10352 - DNA, 201 bp, Homo sapiens
caatgtgcctgtcatatttattttaaatattgaaactcactagaaccaaagtccaaatatggatgctctgtcgtggtgagtccacttgttacaaggacccyggaaaatgaaatcaacttggatagaaaccaacatagacccaattttatatcattaaaccatcttctattctaaagaacaactgtatgtgtattacatata

SEQ ID NO: 10353 - DNA, 201 bp, Homo sapiens
ataaagtcctgaataagtcatcaacattgaccatatttatgtatgggtagactcaataacatgaagatgccaattttttctaaattcttctataaatccayacatttccactcaaaactccaacagaactgttcatggaatttgacaagctaactctaaaactcatgtatgatcacggggccaaaaatagccaagacaact

SEQ ID NO: 10354 - DNA, 201 bp, Homo sapiens
agcacattggtattagccttgcaggcctcacctcccagagctagcaataacatttaccagctacagttttctccattttcaaatatttcctctggcccacrtgccagtgatccagctcctccatagagtagaacctgaaaggagtggtttaaagaaaggagagccctcctgtaagaacttttaacatttacctttcattaa

SEQ ID NO: 10355 - DNA, 201 bp, Homo sapiens
agaaaatacatttgtccttccagtttgcttacagaattgagagagtcaaatatgtaaactaaactaaagtacacacaaaaaacagtcctgtaggcaccgcygataataaatgtatgtaccagatagaaggccatggaaaagggtggtcatcttacctgggaagagagcacaggtagcactcaggataggcttcatagagaa

SEQ ID NO: 10356 - DNA, 201 bp, Homo sapiens
gcttcatagagaagacgatgctcaaagatttcttatttatccaccatctgttttatagagcatctactatggaccaggcactcttctagaacatagctacrtcatggtaaacaaaaaagaaaaggtatctgcattcttggagcttacagcctagaagaagtcagataacacatgagaaaaaaaaaaaaaaaacaacaccaa

SEQ ID NO: 10357 - DNA, 201 bp, Homo sapiens
ggcactcttctagaacatagctacatcatggtaaacaaaaaagaaaaggtatctgcattcttggagcttacagcctagaagaagtcagataacacatgagaaaaaaaaaaaaaaaacaacaccaaacaaaattaattagatattttcggtgttgtcatgaaaaataaatgagctgatgtgatagaatatgctcagggagat

SEQ ID NO: 10358 - DNA, 201 bp, Homo sapiens
gtcaccaggtggctctaagtccaaactggcacacttttgagtaaaaggtggtgctattaataattacaccaggacaacagaagtgaaatgagactgtctgrccaaacctggacataagatcatcctttagcaaggaaagaaatcacgtaggacttggtgagccagccaaggagtatgaagttattcccagtgcattaggaa

SEQ ID NO: 10359 - DNA, 201 bp, Homo sapiens
tattgaatgactcaagaaaaattgaattcatgtcacaagaactcaaagaaaaaaaaaaacaaattatctgaaaggaaaagggagattgtagactaaaggcaaaaaaaaaaaaaaaaaaaaaaagggaaagccaaaacaatgtgatcacataactaatttgaaataattagtaacaacagggggtggaaaagatatggctaa

SEQ ID NO: 10360 - DNA, 201 bp, Homo sapiens
attgaatgactcaagaaaaattgaattcatgtcacaagaactcaaagaaaaaaaaaaacaaattatctgaaaggaaaagggagattgtagactaaaggcaaaaaaaaaaaaaaaaaaaaaaagggaaagccaaaacaatgtgatcacataactaatttgaaataattagtaacaacagggggtggaaaagatatggctaaa

SEQ ID NO: 10361 - DNA, 201 bp, Homo sapiens
agtacctcataaaaagtagttgaaattcggagttttttcttttgctaactttgtgtaatattaaagtttagtttaattaaagtagtacatatagattttcytctaaagagtttgtctattctatttgtgtgtgtgtgtgtgtgtgtgtgtgtgtatataatatatatatgcttagaaaagtacctagaaatatgcctctct

SEQ ID NO: 10362 - DNA, 201 bp, Homo sapiens
attcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttga

SEQ ID NO: 10363 - DNA, 201 bp, Homo sapiens
ttcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaa

SEQ ID NO: 10364 - DNA, 201 bp, Homo sapiens
tcggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaaa

SEQ ID NO: 10365 - DNA, 201 bp, Homo sapiens
ggagttttttcttttgctaactttgtgtaatattaaagtttagtttaattaaagtagtacatatagattttcttctaaagagtttgtctattctatttgtgtgtgtgtgtgtgtgtgtgtgtgtgtatataatatatatatgcttagaaaagtacctagaaatatgcctctctactgttaatgatggcatgatttgaaaag

SEQ ID NO: 10366 - DNA, 201 bp, Homo sapiens
tctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttg

SEQ ID NO: 10367 - DNA, 201 bp, Homo sapiens
ctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttga

SEQ ID NO: 10368 - DNA, 201 bp, Homo sapiens
tgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgag

SEQ ID NO: 10369 - DNA, 201 bp, Homo sapiens
gtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagc

SEQ ID NO: 10370 - DNA, 201 bp, Homo sapiens
gaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaa

SEQ ID NO: 10371 - DNA, 201 bp, Homo sapiens
aggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaag

SEQ ID NO: 10372 - DNA, 201 bp, Homo sapiens
ggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagt

SEQ ID NO: 10373 - DNA, 201 bp, Homo sapiens
gccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtg

SEQ ID NO: 10374 - DNA, 201 bp, Homo sapiens
caaacaaacaaacaaacaaacaaaaaaaaaagtagccaggtgtggtggtgctcctgtagtcctagctacttgggaggctgaggtgagagaattatttgagyccaggaattcaaggttaagtgagctatgattgtgccactgcactccagcctgtgtaacagagcaagactctgtctcaaaaaaagaaaaaagttcttaatt

SEQ ID NO: 10375 - DNA, 201 bp, Homo sapiens
tgtattatctaaagtccagctttcaataaaaaattaggagaatgcaaataaacaggaaatgtgacccatacacagaaataaatgcaggcaatagaaactgsctttgagtgggctcatatgttggacttaatagacaaagaatacaagtaactattataaatatgttcaaataactaaaggaaattatgcttaaaaattaaa

SEQ ID NO: 10376 - DNA, 201 bp, Homo sapiens
tggctttgggcagctccacccctgtgggtttgcagagtacaattcctctcctggcagctttcatgggctggttttgagtttgtatggcttttctaggtgcrcagtgcaagctgtcagtggatttaccattctggggtttggaggacagtggccttcttctcacggctccactaggcagtgccccagtggggactctgtgtg

SEQ ID NO: 10377 - DNA, 201 bp, Homo sapiens
tacaattcctctcctggcagctttcatgggctggttttgagtttgtatggcttttctaggtgcacagtgcaagctgtcagtggatttaccattctggggtytggaggacagtggccttcttctcacggctccactaggcagtgccccagtggggactctgtgtgggggctcacaccccacatttcccttcggcactgccct

SEQ ID NO: 10378 - DNA, 201 bp, Homo sapiens
tgggacacagggcaccaagtccctaggctgcacacagcgaggggtttgggggtgtggctcagccacaaacaaaaccattgtttcctcctagcctctggggygcctgcagttggagaggctgccataaaggtctctgacataccctggaaatatttgcctcattgtcttggccattaacatttggccccttattacttatgt

SEQ ID NO: 10379 - DNA, 201 bp, Homo sapiens
gggacacagggcaccaagtccctaggctgcacacagcgaggggtttgggggtgtggctcagccacaaacaaaaccattgtttcctcctagcctctggggcrcctgcagttggagaggctgccataaaggtctctgacataccctggaaatatttgcctcattgtcttggccattaacatttggccccttattacttatgta

SEQ ID NO: 10380 - DNA, 201 bp, Homo sapiens
aaaccattgtttcctcctagcctctggggcgcctgcagttggagaggctgccataaaggtctctgacataccctggaaatatttgcctcattgtcttggcsattaacatttggccccttattacttatgtaaatttatgcagctggcttgaatttctcctcagaaagtgggtttttcttttctatcacattgtcaggctgc

SEQ ID NO: 10381 - DNA, 201 bp, Homo sapiens
agttccatgtggctggggacacctcacaatcacaatcatggcggaagtcaaaaggcctgtcttatatcatggtagacaagagagaaaatgagagctaagcraaaggggtttttcgttataaaaccatcagatcttatgagacttattcactaccatgagagcagtatgggggaaactgcccccatgattcaattatttccc

SEQ ID NO: 10382 - DNA, 201 bp, Homo sapiens
aaagagcatgtgaagggaggaactgtcaaacacttacaaaaccatcagatagtgtgagaactcatgagaacagcatgggggaaaccacccccatgatccarttatctcccactaggcccctccttcgacacatagggattatgaaaattacaatttgagatgagatttgggtggggacacagagccaaaccacatcagatg

SEQ ID NO: 10383 - DNA, 201 bp, Homo sapiens
gtttgattcctaggaatgtgagtgatattctcttcctgtgttttctaaaattatttgcctagtgaatatttaaacaaattcacatgttgaacatcatagtrtttcaaaacagcccctggacttggtatcagatatattgagtcaaatccagagatgctgtgtgactttgggatgataacatacccctttaagagtcttggt

SEQ ID NO: 10384 - DNA, 201 bp, Homo sapiens
agtgatattctcttcctgtgttttctaaaattatttgcctagtgaatatttaaacaaattcacatgttgaacatcatagtgtttcaaaacagcccctggayttggtatcagatatattgagtcaaatccagagatgctgtgtgactttgggatgataacatacccctttaagagtcttggttttcccaaacaccacatgtt

SEQ ID NO: 10385 - DNA, 201 bp, Homo sapiens
ttgatcaatcatattcccataagtccaactcctcagtcaccactcaaaacagtcacagctgaggtcagggacagggcaggaagtggaggcaaaatgttgayggtggggttgtaggaaattaaactttgtgggtagggtgagaagtacattgtttctagctccacagctactattcaaatggagaattctggtggccttgat

SEQ ID NO: 10386 - DNA, 201 bp, Homo sapiens
ataactagctcactgaaaaagatgatgaagacaatttttatctctggatctatttcaaagtcagagagagacaaacatatgagaatgattcagccccacgsgatcctgagggagtgtacacagtgtcattaaacagacatttttttccccattaggtgttgtttagtaaagattagagtgtcaactttgacaggtctcaca

SEQ ID NO: 10387 - DNA, 201 bp, Homo sapiens
tgagttggtcatacatcccacatgcatttctagaagcattatttttgtattttaaactctagtcaaagtctgagagatgtgcttttccaatagactttgctttttttttttttttttccccctttggcttcttttgttgcaatttcaatctagctcctgctgcgttgaaccatctcaggcaaaggagaggtagcctctctg

SEQ ID NO: 10388 - DNA, 201 bp, Homo sapiens
ccacatgcatttctagaagcattatttttgtattttaaactctagtcaaagtctgagagatgtgcttttccaatagactttgctttttttttttttttttccccctttggcttcttttgttgcaatttcaatctagctcctgctgcgttgaaccatctcaggcaaaggagaggtagcctctctgtagagagcactgtgctt

SEQ ID NO: 10389 - DNA, 201 bp, Homo sapiens
cttctaccttttagtatctaacggtaaacaaatccttattggaatttccaccatgataaaccaaccttaggctgaaccgggcagcttggtaacaactaacytgagacctttctctgaccttttctgcccagtcccctactatgcccactgattctactcaaggacttctatgttgtgtgtccatgactcccaagcagagat

SEQ ID NO: 10390 - DNA, 201 bp, Homo sapiens
gacttctatgttgtgtgtccatgactcccaagcagagattaatacaatgatagatatgctgatctctggcacagaataccttgtctgattactagctctgsccagttggtcactcttttcttccctccctttcccatttaaaaaagtgaaacaaaaaccaaaaaattttctctcctcaagatgtggaatcacagagtgaaa

SEQ ID NO: 10391 - DNA, 201 bp, Homo sapiens
atggcaagtctgcctatgcaaatttctatagcatttggggcccaacctaaggagagggtggagggagtttgattttagaaaaagagaaagggttaagtacktcactgagcaacttcatgggcagattttttaaatgatacaatcagtcagactggtgatatgtctttggaatactaatacaaaaattgtgttaatgctact

SEQ ID NO: 10392 - DNA, 201 bp, Homo sapiens
tttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatat

SEQ ID NO: 10393 - DNA, 201 bp, Homo sapiens
agatatattataggcatgacaaactaataaagcccaattctactttttggggggcaaatgttccatctaagttaacacaaaaagaagaaatttaaaatatygatataagcaactgcttactaaatagagtgctttatccttgtcttggcatcacttacagttattttaagcaatggcctattttctgtgtttaaatatttc

SEQ ID NO: 10394 - DNA, 201 bp, Homo sapiens
tattttctctttccttttgcattggttttcagaaggaaataaggtggaaacccagcatgaaggtggaaagcctcgtatccgaagctacatctagcatcttstagcttcagagacttatttggagaacagggaactgaggcagttatttaatcaggatatcagaatttgcttttgctgttctatccacactttctcatgaag

SEQ ID NO: 10395 - DNA, 201 bp, Homo sapiens
ctttttcagtcattcttttttagaatgcctgtcctctgaaaagtcacttgggtaaaatactgaatgacatcagctatttttttttcctgttcatctgctataaatgttgtttgttctgggaaatggctatttccaaggcattctgtgacactctttaatggagacaagagcatgaaaaagaaggatgatcttccagcatcg

SEQ ID NO: 10396 - DNA, 201 bp, Homo sapiens
tttcattttaggggggtgctatattttattaaatcagcaccgtacatttaaatttttctcagctttttactactaaaaatgtaagaagtatatacttttgytcattagttaatgcatacatgtataagaagatctattggataaattcctaaaagtagaattgctgagtcaaaagataagtgcattataaatattgatata

SEQ ID NO: 10397 - DNA, 201 bp, Homo sapiens
aaggaagaagcagaggaaacagcaaaagaggaggagaaaaagaacttgttcaaagcacaagccttcataagttatgtcttagtccatttggtgttgctatratagaatacttggggctaggtaatttataaagataagaggattatttggctcttgattctggtggctgaaagtttcaagagcgggcagttgcatttggcg

SEQ ID NO: 10398 - DNA, 201 bp, Homo sapiens
tgtaatccatcaaatattttctttgctttactcgcctatttatcctataaaagcctgctatttgcattccctcagtggagctcctgagccacttttgattyagagcttccctgtccaattcatgaatcactgtttgttaataaagtccttaaaatttttattgtgcctcagtttatcttttaaccgtttgacctctatgcg

SEQ ID NO: 10399 - DNA, 201 bp, Homo sapiens
ttagccacaaaatgaaagtctgtttactgattcaaagcatctcaggaaacacagtttccaattttgggaagaaaactttacagaccaggagatgttatttytaaaaaaaaaaaaaaaaaaaaaaatggagtaattttctggctgttctgttgacttactagaatcacatagctttttaactctgagtttatttgaagttag

SEQ ID NO: 10400 - DNA, 201 bp, Homo sapiens
cccactgaccagagtgacaatgcccataggactgaaggggtaagagcaacagaaacggaatgcttgaaaggagcagaaacagtgtatggcagcagcaaatrtgtgtcagatagaaagacaaagggaaagggacacaaagaagtattcacaatggagcaacacacatgtagtgtgttttataatgctggaaaaattctgtac

SEQ ID NO: 10401 - DNA, 201 bp, Homo sapiens
aaccaatttacaaaactttccggtcatcataaatagaaaagccagatatggtaacaccgcgatgactagttaagtactcaggtacttatccatgactttgwttatccatcctcctacatatctgatagaaaacacaaggagtaggaatctcatggttaacatttcaaaggcatgaaaattgaatactaagtgaagatacaa

SEQ ID NO: 10402 - DNA, 201 bp, Homo sapiens
acaacttcattctttcccctcttcatatcttcctggaccctttttctcctttgtcacagcaaaataatataggctactaagtctatgcacaaggatatttrcaataaacatttgacagtctttgctattgctatatgaagtgcatgcacttgacaggtggctactaattattatagtaaaaacaatagcattgagtgattt

SEQ ID NO: 10403 - DNA, 201 bp, Homo sapiens
gtgtcattaccctcattttagaaatgagacttgttcatatggaggctgggtgtggtgtctcaggtctgtaatcccagcactttgggaggccgaggtgggtrgatcacttgaggtcaggagttcgagaccatcctggccaacatggtgaaaccctgtctctgctaaaaatacaaaaattacccgggcatggctttggacacc

SEQ ID NO: 10404 - DNA, 201 bp, Homo sapiens
gtgaaactgattaactgtcacatcaatactgtaaagagggagagagagtctggttgtggcctcaggtgattggctaaagacaataaagaaatgggtcacckgcttctttttttttttttttttttttttccagagctggtttctgttgctccttaggaaagaatcctggttaaaggtgaataaggaaggggtatactgagg

SEQ ID NO: 10405 - DNA, 201 bp, Homo sapiens
gtatcaaaatatttcatatactcaataaatatatacacctactatgtacccataaaaattaaaaatataacagtaaaaatcggatccatcttttccctaamtagtggttgttcaaagagacatttaaggcacaagtgttgtttgtgcagtattgttttgcacatatcaaattctaggttttatgtcttacccaccctggat

SEQ ID NO: 10406 - DNA, 201 bp, Homo sapiens
ctaggttttatgtcttacccaccctggatagaaatttatatccattccaggaggcggaggttgcagtgagccgagattgcaacactgcactccagcctgcrtgacagagcgagactctgcctcaaaaaaaaaaaaaaaaaaaagaaaaagaaaaagaaaaatttgcacccattcctgtattctttttataggcttctgtaa

SEQ ID NO: 10407 - DNA, 201 bp, Homo sapiens
tgtattagatcctttaattctcacaaggatgatatggaggatacaggaccatttacattatttgtgtgatctagtgccaaataaaaatgtaagctccttgytctaaaggcagaatgaaagctttttcctttctttctcaattttttagttaacctgtcaaacatagggatactcagggagcaactgtagacccccacaggc

SEQ ID NO: 10408 - DNA, 201 bp, Homo sapiens
tttctgttgctgatcatcagcaactagaagacagaatttggatattctcacaccaatgtactattgctgcagaaatcctttgggctaactgagaggaccgaaaaaaaaaaaaaaatacaaaagaacattccagaaataattacctattcaccatctttagtacaatgctgtacaaataattaatttttggttcgttattct

SEQ ID NO: 10409 - DNA, 201 bp, Homo sapiens
cattttttagttctagatgctggtaatgcaatgctgaacaagaccaacatggtttctctccttataagatttgcattaacatttgtgaatgcataaagacktaagtgagttcaagtaatgccaaatgcaataaataaaattaaacagagtaaagtaaatgcctggatgtgggaggaagtataactttagataaaactgccc

SEQ ID NO: 10410 - DNA, 201 bp, Homo sapiens
ctgtgcagagacattgacaaaggtgaagggcttatggaagatacatacttggtgtgtttgaggaataggaagacaccagtacggttgagaagggaaagggmctgttatctctatcttgaactgtccccattaaactgatctataatcagaattttaagtgagttaaattctctttctgatttacaatcatcctttcttttg

SEQ ID NO: 10411 - DNA, 201 bp, Homo sapiens
aaatcagtctgaattcataaaatagtatatcatggattttttaaaaaataaaattgcttcgaaatacatacaataactcgcccaagatgtgtatgggtgcrtgtgtgtgttatctccatcccaataaatgctattgggaatatataaggctgacattatcattttagttgattaaaataaaatatctaagttactcgtatc

SEQ ID NO: 10412 - DNA, 201 bp, Homo sapiens
cagcctggccaagatggtgaaaccccgtctctactaaaaatacaaaaattagccgggcgtggttgtaggcgcctgtaatcccagctacttgggatactgasgcagagaattgcttgaacccaggaggcggacgttgcagtgagccaagattgtgccactacactccagcctgggtgacagagggagactccatgtcaaaaa

SEQ ID NO: 10413 - DNA, 201 bp, Homo sapiens
caaaataaatattttacaaaattatttctaagtcgaaaaagacttagtgtcttggtgtacaagagtggggtaataccagcatgtttctcagtggggagtgrggtaaaagaggaggacaaaaaggttaattaatgcataaaagtgcctagatcaaaggcaggcaccactgtaagcaaaagacatctccttgaatatttccta

SEQ ID NO: 10414 - DNA, 201 bp, Homo sapiens
tgtttagttgttcttgccaagaaagaaagaaataattccagattccaggtgttactacttagctggatgttttactttataaggaggcagcaattcatgaraaacagctgtaattacacagcattcaggtatttcataattaaactaacagctgattttaaggtggcacatggcatgagattttgcaactaggctaagtaa

SEQ ID NO: 10415 - DNA, 201 bp, Homo sapiens
tatcactcctgtatctatctacttatgtcagttgtttaccagttcccttcagctgtctgctttttatcatattattgatcagtcagtcttgggcgtcttakgttggaggggagagagagagaaccggcaaagggaagcacgagtagagaatagcggtggcggacaatcagttaagatggttccaaaaatagctcagctctg

SEQ ID NO: 10416 - DNA, 201 bp, Homo sapiens
cagttcccttcagctgtctgctttttatcatattattgatcagtcagtcttgggcgtcttaggttggaggggagagagagagaaccggcaaagggaagcasgagtagagaatagcggtggcggacaatcagttaagatggttccaaaaatagctcagctctgctgatgacagctctgcttgcagccaccccgtatgggatt

SEQ ID NO: 10417 - DNA, 201 bp, Homo sapiens
catctgtgttctttgtacactatgctctgggcacttggcatccagtttctttttgtccctatctcttttgaatgagatgagggagtaagtgatgagaaatkgttatatttctcacccactgtgtctattttgttgctattgctctagtttattatatacataggctttttttccctactgcactttctgttgggagactca

SEQ ID NO: 10418 - DNA, 201 bp, Homo sapiens
gagttgggactgatatacattttcataagcatgtgcagtaattctgatgtagctcgtctgtggaccacaactcaggaaccctagtcttttaaatgtatatwtttttaataacatggtgctctaatttggagccctcagaaagaaaggaaaataaaacagcataacctgtgtcctccatgatagtttagtgggctctagtat

SEQ ID NO: 10419 - DNA, 201 bp, Homo sapiens
ctttgggcctggtgagtgatcctggaatttgtcaaacaagtttatggaaggaaacctgaaaatgcttcaccctagtcctttgcctctttatttttgtgggktttttttttttctctttgagaatgttttctatttgagtggagaatgctctcatatggtacttttctctgatccttttggaaagagcaagtgtcctttgag

SEQ ID NO: 10420 - DNA, 201 bp, Homo sapiens
tctttagtgaaaagccacctttgcgtgttgttatgccacattacagtgttccagaaaacatattggtgtagatgcaaaatcttgccttcataatttttagycttatgttggattagagagcatattttcaagttgatctcttggaacctcagcatgaatctatattagaagcccagagaatgctaaacagagttttcactg

SEQ ID NO: 10421 - DNA, 201 bp, Homo sapiens
acttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaat

SEQ ID NO: 10422 - DNA, 201 bp, Homo sapiens
gatttccaaaaggggagggagtgtacgaatagggtgtgggtcacagagatcacatgcttcacaaggtaataagatatcacaaggtaaatggaggcagggcragatcacaggaccacaggactggggcaaaattaaaattgctaatgaagtttcaggcatgcattgtcattgataacatcttatcaggagacagggtttgag

SEQ ID NO: 10423 - DNA, 201 bp, Homo sapiens
agagatcacatgcttcacaaggtaataagatatcacaaggtaaatggaggcagggcgagatcacaggaccacaggactggggcaaaattaaaattgctaaygaagtttcaggcatgcattgtcattgataacatcttatcaggagacagggtttgagagcagacaaccagtctgactaaaatttattaggtgggaatttcc

SEQ ID NO: 10424 - DNA, 201 bp, Homo sapiens
tcacaaggtaataagatatcacaaggtaaatggaggcagggcgagatcacaggaccacaggactggggcaaaattaaaattgctaatgaagtttcaggcaygcattgtcattgataacatcttatcaggagacagggtttgagagcagacaaccagtctgactaaaatttattaggtgggaatttcctcatcctaataagc

SEQ ID NO: 10425 - DNA, 201 bp, Homo sapiens
tatgtaaagttacctaacccagttcttagcataattagttgctgtagttccaggcattcaatagatagaacagattttaaactactttaaagactagtgtraggctggcctatacttagttaagaatttgttaaagtttgatgatttggttgaaaaaatattctggagtgtgatggttaatccctctggagaaccctgact

SEQ ID NO: 10426 - DNA, 201 bp, Homo sapiens
tttgtctttctgtgcctggcttatttcacttaacataatgacccccagttccatccatattgatgcaaatgacagaatctcattcatttttatggctgaayagtactccattgtatacatgtatcatacggttttttttactattatactttaagttttagggtacacatgcacaacgtgcaggtttgttacatatgtata

SEQ ID NO: 10427 - DNA, 201 bp, Homo sapiens
atgacagaatctcattcatttttatggctgaatagtactccattgtatacatgtatcatacggttttttttactattatactttaagttttagggtacacrtgcacaacgtgcaggtttgttacatatgtatacatgtgccatgttggtgtgctgcacccattaactcatcatttacatgaggtatatctcctaatgctat

SEQ ID NO: 10428 - DNA, 201 bp, Homo sapiens
tccctcacctcttcccctaccccacaacaggccccggtgtgtgatgttccccttcctctgtccaagagttctcattgttcaattcctacctatgagtgagracatgcggtgtttggttttttgtccttgtgatagtttactgagaatgatatcatacattctttattcattcatctgttgatggacacatagtttgcaggg

SEQ ID NO: 10429 - DNA, 201 bp, Homo sapiens
ttgtccttgtgatagtttactgagaatgatatcatacattctttattcattcatctgttgatggacacatagtttgcaggggtacatgtgcaggtttgttrcatagctaaatatgtgttatgggagtttgttgtcagattatttcatcacccaggtattaagcctagtacccattagttatacagtaatttcttaatacat

SEQ ID NO: 10430 - DNA, 201 bp, Homo sapiens
cacttgaacctgggaggccgaggttgcagtgatccgagatcacgctgctgcactccagcttggggacagagcgagactgcatctcaaaaaaaaaaaaacayacaaaaaaggtatatatgactatagccctttttcttcataaggtttatagtcttcaacgatagagtgacttttatgtttttctaccagaagattcgaagt

SEQ ID NO: 10431 - DNA, 201 bp, Homo sapiens
tgatgctcaactttcatgctgttttatttgtttttttcttgagacagagtctcagtcattctgttgcccaggccggagtgcaatggtgtgatcttggcttwctgcaacctctgcctcccaggttcaagtgattctcctgccttggcctcccgagtagctgggattacaggcgtgtgtcacaatgccaagctaatttttgta

SEQ ID NO: 10432 - DNA, 201 bp, Homo sapiens
tgcagaaggtgagtgacaggccggtggtgctggtaaagtctgtgctgaggcagtaggagagctgatgtcaatgacaaggcaacccttgactgcagccctgrcacctgtctggggaatttagactttagtgacaatccttgacctgccatgcaaatctggagctataccattgaattattgcccgtgattgggtgtggaaat

SEQ ID NO: 10433 - DNA, 201 bp, Homo sapiens
tgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagc

SEQ ID NO: 10434 - DNA, 201 bp, Homo sapiens
tagcaattccctgtttgccactttcaactctttgttgatctaattattggtatgtctacccaagaaaatcttaagcttatttggggactgtggtcttgttwtatatatcatctcccgagatactagaatagcttaagtacccaattattattcagtaagtgcctgtttactgttggactttcttgaaaattcatatagaat

SEQ ID NO: 10435 - DNA, 201 bp, Homo sapiens
aaaagtttataaatttaaattaatggaaattgctgttgatgaaaccctctagaggataatacatttctgatatgcctatagggctccgtatttaagctaawctcctgcccaagatgcaggatgatgaagtcctttatttcggccatcagacctattaaaaccacgagtatccctgtgagtccacaagtcaggctacaatac

SEQ ID NO: 10436 - DNA, 201 bp, Homo sapiens
tatggagctatccagggtgctgaacgtgctctgcaactcagtccccttagtctctgggcttgacctattttttccattgttgtttcttatcttcacctttkattccctacccatactgcctgctctgattgctctttgtatgatctcatcaatcatatgtgacagatttttgtcccgacccttgctatgccctacattcta

SEQ ID NO: 10437 - DNA, 201 bp, Homo sapiens
aaatttgcaaattgagaataataaaacatcctcacactgaagattcctgccagaattatatgagataatgcatatccaaagtttagggcagaaactgaaasctagccaacattttaaaaatgtgaattattgtcattaacttatcctttcggtgcttcacctctccatacattttaagatactctggtcattatgagtact

SEQ ID NO: 10438 - DNA, 201 bp, Homo sapiens
aggattattttatggtctgcttcaggggagaagagtgagagaaagtcaaagagatctttctgcttctgctgctttctcaaatgccaagttgctgtattttrgggtagtatgtcctgaaccccatcaggtacttgacatttcatgaaggtaagctgatcaatctttcatccatggcactcattaatgtctcaatttgaaatg

SEQ ID NO: 10439 - DNA, 201 bp, Homo sapiens
cactttataataagacagataaggcagtcagtatacagaggtttggttttatggccagaactaacatttattcaatcaatgagagagatcaattagagcarcattacttctacagtgggaaaatttcagagcccctgaaatagaacattattgttaaattatcaaatatgttacagttgttgctagtataatgaccctttc

SEQ ID NO: 10440 - DNA, 201 bp, Homo sapiens
attttcaaaataagcaataacatttaaagcatatttgaatatacagatgtttggatcactgatatcctaagaattctatagtctctgctgattttaaagtygagattagattgttcttgtatacccagagaagcatagctctaaagggaaggtgttctggggaaagaaaagaaaaaaatgacgttttcatcatcacactga

SEQ ID NO: 10441 - DNA, 201 bp, Homo sapiens
tcactccatctgttttcagccccactgctggctctgccttcagaaatatgtgatgcctccaagttctctaactttatagggttctacagcaaaatatcctkgtttactactggcttctttctctgtaaaaacttagctttccacttttttctgtcctactgtcaattaccacacatctatacacttttcatcttccaaatc

SEQ ID NO: 10442 - DNA, 201 bp, Homo sapiens
aatgtacagtatggaatatgttcattatctcagtaccatgtttgggctcataaaaataaaaatagcagacatgagtgtggcctttattcatttgttcaacrggcttttactgcttgcctatcatgggaatggcaagaaacatcatttcagttaactgaaaggacaaatacaatattcttagtgatctccttccttcagttc

SEQ ID NO: 10443 - DNA, 201 bp, Homo sapiens
aaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggt

SEQ ID NO: 10444 - DNA, 201 bp, Homo sapiens
acaatgtctcactgtgacccaggctgaagtgcagtggcacgatctcagctcactgcaacctctgcctcccaggttcaagtggttctcctgcctcagcctcrtgagtagctgggattacaggaatgcaccaccatgtccggctaatttttgtatttttagtagagataggatatcaccatgttggccaggctggtcttgaac

SEQ ID NO: 10445 - DNA, 201 bp, Homo sapiens
gttctgacactgatttggggtcaagtctggggttctgaatcaggagcctgtgtttgatggggagtagatgccagaaggcattgacaagtggcaccatgcargcgaataatgcaagaagagtcaccttgtgggaaaattgatgcctgataatctgtcccaccagggtgtcaagtccgagagtgagaatccatcaattaaact

SEQ ID NO: 10446 - DNA, 201 bp, Homo sapiens
ctgtgggacggactttagagaggacagacttgagcacaggggtgtggagaattggttatggaagaaattcccaagcgaaatgaatatagttggaggaaatktgaagagggtggggagtttcctgggcctctgctggaagagcagaatgtaagagttgagaatgttaaaccagcttgcataacgttttgctgaacagtttaa

SEQ ID NO: 10447 - DNA, 201 bp, Homo sapiens
acttaaagcatacagtgccgtaataaaaatacactttggaagtcagttattcacttttttccataggctgttagatgagaaattatagaatatatggtacyctgttgggaatttatactaaaggattttgttttaaagataccaactctccatttgaataccatttctcagctcattttaaacatttacccaattaaaaaa

SEQ ID NO: 10448 - DNA, 201 bp, Homo sapiens
tttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgt

SEQ ID NO: 10449 - DNA, 201 bp, Homo sapiens
tcctaatgacacttaccacatggggttgttgtgaggattaaataagagcatgcaagtaaggttttacatagtgcattccacataaaaagcactcaataaakgttagctattattactgttttcagtcactccaggcgagctatattgtaaaaaaccatacttccattgcttcttcactagagcctagcaaatcattgtttt

SEQ ID NO: 10450 - DNA, 201 bp, Homo sapiens
agtatcttgcctgtaataatgctcaacaaatatttgattaatgaatagacaggcttttatgaatccatgtgtaatgttaagttctatgaattatgtagaartagtaaaagcaaataaagactcaattacaattttaactcttcaacaagatgatcaaatccttgaggattagaaattaattaaaaatgaactcatccttta

SEQ ID NO: 10451 - DNA, 201 bp, Homo sapiens
attgttccatctaactggaattttgtaccctttggtcaaacatctctctaatcccacccgcctacaccacctcagcacctggtaaccaccattctactctytcctgctatgagtttgttttttttttagatttcatatataagcgaggtcgtgcagtatttgtcttcctgagcatggcttattttacttaacataatatcc

SEQ ID NO: 10452 - DNA, 201 bp, Homo sapiens
gccgtctgtatgtctccctgtaggaaatgtctatttagatcctttgcttattttttaattgggttatttgtttacttgctatgaagttgtttgaattcttyatatattttagatattaaccccttatcatagaatgacgcattttaagacaaggaatgaatcttgtgaaagcttaattccctgtcctaattcctcaccctt

SEQ ID NO: 10453 - DNA, 201 bp, Homo sapiens
ctggatacttgttgaatggctttgaccaaaatgctgatactgacatggacaatgaagtccaaactgaggtggtctcagatggagatgaggaacttgttggsaactggagtaaaggtgactcttgctatgctctaaaaaagagactggtggcattttgcccctgctctagagatctgtggaactttgaacttgagagagatg

SEQ ID NO: 10454 - DNA, 201 bp, Homo sapiens
cattttctgaagagaaattcaagccagctgcagaaatttgcataagtaatgaaccaaatgttaatcaccatgataatggggaaaatgtctccagggcatgycagagaccacaacagtccctcccatcacaaacctggaggcctaggagggaaaaatggtttcctgggccaggtccagggctcccctgctgtgtgcaacttg

SEQ ID NO: 10455 - DNA, 201 bp, Homo sapiens
tcctccagaacccagaatggtagatccactgacagcttgcattatgtggctggaaaagctgcagacactcaacagcagccatgaaagcagccaggaggggsactgtaccctacaaagccacaggggcagtgctgtccaagccatgggagcccacctcttgcatcagcatgccctggatgtgagacatgtagtctaaggaga

SEQ ID NO: 10456 - DNA, 201 bp, Homo sapiens
cgtgatcatgttttgaattgtgagggcatgagatttgtgaggggccaggggcagaataatatggtttggctatgtttgcacctaaatctcatcttgaattktagttcccataatccccatgtgttatgggagggacccagtgggaggtacttgaatcatgggagtggttaccctcatgctgttctcatgatagtgagtgag

SEQ ID NO: 10457 - DNA, 201 bp, Homo sapiens
gtttacagacatcttctttattccagctcaacagcccaaattcttttcaccttctgtaaagaagagtgactggaagagagactaagttaattgagataatkaataagtgagtgagagaataaatgaattatagaggaggaaccaaaagcacagagctggaagtggaacaggaggttctcagcaattttaaaagtgaaggca

SEQ ID NO: 10458 - DNA, 201 bp, Homo sapiens
ccaaaagcacagagctggaagtggaacaggaggttctcagcaattttaaaagtgaaggcaccgtagcagtggaagtatataaagggagtaaagtcaggctkggaaaacagaaggcaaaaatagtgttcatctagactgtgtgtcagattacttctaatatccttcaaggtacttgagtgaggaataatttcctcttatgtt

SEQ ID NO: 10459 - DNA, 201 bp, Homo sapiens
tatataaattatgtatgtaaaatatataaatataaattacatatgtaaaaagtacatagccatgttttgactcataaagagcattcattaaatgtggttayaatttttagaagacattatcagtaatattatcagtaatagaataagacctacaaaaaagggtaggggagagagtttcatgttgtataaggggagtgttga

SEQ ID NO: 10460 - DNA, 201 bp, Homo sapiens
gttgtctttccaaatttgtatgatgtcatcagcagcttaatagagcattagatgagaatgtctgagcattactatgctgactttgtaaaattgtaatccaraagcaaagaatcttgacagcttagacagttggtttgatcttattattaatgaacagaagatatatcttaggctattttaaaagtgaatttataataagat

SEQ ID NO: 10461 - DNA, 201 bp, Homo sapiens
atatttcattggtcagaagttagtcagagggtacctagttgcaagggaagctgggaaatgtagtctggctggcattgctttgttgcactaactcagtcctrtggaaaaggagcacaaatatttggtggacagtaaatgatctgtgtcatatccttattactcagatccatagtaataatgtctgtttttatctccttttct

SEQ ID NO: 10462 - DNA, 201 bp, Homo sapiens
gcctgatacagagttcagtatatattcagtatatatagtacctgatacagagttcatgatattcaataaatatcatgagtgatcaaacacatattctctgycttcttctcttcctcccttccttttttctctttttcttgcttcttttatatctctttctttttttctgatcccaaacactttagagtctttaatttgagc

SEQ ID NO: 10463 - DNA, 201 bp, Homo sapiens
cacatattctctgccttcttctcttcctcccttccttttttctctttttcttgcttcttttatatctctttctttttttctgatcccaaacactttagagkctttaatttgagctagattctatgataagtgattgaagaatcaaagacatatttaaccttggggaaagtcataatgggaataaaggaaaaaacattaata

SEQ ID NO: 10464 - DNA, 201 bp, Homo sapiens
ttaaccttggggaaagtcataatgggaataaaggaaaaaacattaatataaagtattagtaaacatttctaaattactgatttcattaaaatatttaacartcttatgaaagactaaagaatcattttgagttcatctactaggcatggacaagccacttcaggaagtttaatatccttctttgtgcctttgggtttaatc

SEQ ID NO: 10465 - DNA, 201 bp, Homo sapiens
aactggatactgtagtggtggaggatgtctaacttcgttttgtgtttcacagagtttcaagagttttcctgtaagcctctttagtctttgtatatttaatrtgctccaatcctacttacatctcaactgtgttctttctgatggcgatggtgatgatagtgccaatcatttatttagcactaacaactgtgtgctcgacac

SEQ ID NO: 10466 - DNA, 201 bp, Homo sapiens
gtgacaaaaacaggagttacttttgcaccaacctgataactcttcaaaatgtttggtgaggctggactcaaacataagtgcatggatgcctgatttttttyccccagtattcaagaacctcagggttttcctgaatgtgctatagacattccagggacctcctaagttttgaacattgcattattatgaagattaggtcca

SEQ ID NO: 10467 - DNA, 201 bp, Homo sapiens
acacacacaccccagatttggcatgagaagaacaacgctgaagtcgatatctgcctattttgtttataatggtgtgaccttgggcaagtcacttaattttkcaatgtattttctcatctataagatgggagatatcttatatcctaaggctattgattatgtcagatggaatctcatctgagaaaataccttagaaattgt

SEQ ID NO: 10468 - DNA, 201 bp, Homo sapiens
ctgtaaatcctttaaaattttattatccatctcttcactggggaaatgtctagatacattttcctaagtggttccatctttctgtaaatggctattgaccygctgagtgcagttttgctttcagagaagcattgcacttggtgtgtgatttgagtttgggatcatgaccttatttcctttgcacttgattgctttacttca

SEQ ID NO: 10469 - DNA, 201 bp, Homo sapiens
aaaaaatttctgttgttttaagccagtgagtttgtggtaattttttaatggcagccatgagaaacgaatacaacaaggaacaggataatctacaaaatacrtgaattatacaagagcatcagaagtttgtggaaatttagtataaaaaacacctcttattgaaagtgtgattgttactatacagtcagtccagaagcactg

SEQ ID NO: 10470 - DNA, 201 bp, Homo sapiens
tggtaattttttaatggcagccatgagaaacgaatacaacaaggaacaggataatctacaaaatacatgaattatacaagagcatcagaagtttgtggaartttagtataaaaaacacctcttattgaaagtgtgattgttactatacagtcagtccagaagcactgaattatgaaaatatcattgcctggtatgtgtcag

SEQ ID NO: 10471 - DNA, 201 bp, Homo sapiens
tctcaatgtatttactccttcagtatttataacaatcaggaagctgtaattattgtccatattttactaatgaagtaactaaaacttagagaagataagcmatttgtctgaggtcatgctctagtagtgagcagagccagaatctgaactctggcatgatgactatagcgtctgtgtttttatgcattactgataggtatg

SEQ ID NO: 10472 - DNA, 201 bp, Homo sapiens
ttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaaca

SEQ ID NO: 10473 - DNA, 201 bp, Homo sapiens
tatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaa

SEQ ID NO: 10474 - DNA, 201 bp, Homo sapiens
atggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaa

SEQ ID NO: 10475 - DNA, 201 bp, Homo sapiens
tggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaag

SEQ ID NO: 10476 - DNA, 201 bp, Homo sapiens
ggctggaatcatgttatctctgctctttcttgactattctgacacagcaggcaacttaatttcaacaactcggtaatgcccccatcttctgtgtgtgtgtktgtgtgtgtgtgtgtgtgtgtgtgtggtgtttgctaagaaggagtcacacggctgcttttgaattcagctgggctttaggaagctgcataaaaacaaaga

SEQ ID NO: 10477 - DNA, 201 bp, Homo sapiens
aagcacttgccgctttaccttgtgcttttatgttatagagatgatttctctccttaaacctcatgaaccaatatcttctagctttaaacttttttctgcakcttcctcacctctcttagccttcatagaattggaaatagtttgggccttgctctgggttaggctttggcttaagggaatgttgtggctggtttgatcttc

SEQ ID NO: 10478 - DNA, 201 bp, Homo sapiens
gacatgatttgtgttgccttcaaagaattacaataatgacatcaaagatcactcatcaaagatcaccatctcagatataataataatgaaaaagttttacrtgttgagagaattaccaaaatgtgatgtagtgacatgaatcaggcacatgcagttagaaaaatggtgtggattgacttgctcaaccaacggttgccccaa

SEQ ID NO: 10479 - DNA, 201 bp, Homo sapiens
agcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctc

SEQ ID NO: 10480 - DNA, 201 bp, Homo sapiens
gcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctct

SEQ ID NO: 10481 - DNA, 201 bp, Homo sapiens
cacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctc

SEQ ID NO: 10482 - DNA, 201 bp, Homo sapiens
actgacactaacatttttgaacccatctatgcccatttccatttttagttctacaaatgttctgacaccattttttaaaaaatcacaacaccccaaacagkgggttctatttttttttctattgttatagatgagtaaactgacacctaaagagggcccttagcttgtggctggcatctcaggaccaaaatgcctgcgttt

SEQ ID NO: 10483 - DNA, 201 bp, Homo sapiens
acaagtccaaggacatcaaatgactcgcccaacatcactagggcatgtgggctgaatgaggatgttcagtctggtcacatcaaaagccctagctcttttcsctataagctagaaataatattccatcccttttctcacctacctcccagcaaaaacaaatgacataaaaatatttttttctatctgcttctgctcatgata

SEQ ID NO: 10484 - DNA, 201 bp, Homo sapiens
ccaacatcactagggcatgtgggctgaatgaggatgttcagtctggtcacatcaaaagccctagctcttttccctataagctagaaataatattccatccyttttctcacctacctcccagcaaaaacaaatgacataaaaatatttttttctatctgcttctgctcatgatacctttaaaatgccttattcatcaattca

SEQ ID NO: 10485 - DNA, 201 bp, Homo sapiens
ttaaagatgaagcctactatggcagaccatccacatccacttgtgaagaaaacattcatcttgttcatttcctaattgaaaagcctaggttattaacagcrgaaacagtagctaacaccacagacatctcaactggttcagcctacacaattcttactgaaaaatttaagttgagcacactttctagttgatgggtgccaa

SEQ ID NO: 10486 - DNA, 201 bp, Homo sapiens
ctgcttggatttatactctgcctccacctctcactggcaatgtagctttgggcaagtcacatatcctctgtatataatttttctcatttgtggggtgcagrtataagtggtggctatcttggagggttgcaaagaagagcacttccttggccaatagtgtgccctctgtcatgaatatttccctgctatcattgtaactta

SEQ ID NO: 10487 - DNA, 201 bp, Homo sapiens
atcacttctgggcctttaaagttgctgcttttcccacctagagcattttcccccaagatagtcacagggctggcaacctctaatcttttagcagcttgaaygtcattcctcaaaaaagcctccctgactgctggttctgcccttgccctggtcactctctagccctgggctttatttcattttctttatggatcctatcac

SEQ ID NO: 10488 - DNA, 201 bp, Homo sapiens
ggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaa

SEQ ID NO: 10489 - DNA, 201 bp, Homo sapiens
ggaaccacacacagttcccctggttgagccacaaattggtatgtttttttccttatgtacaggttttttttttattatactttaagttttagggtacatgkgcacaacgtgcaggtttgttacatatgtatacatgtgccatgttggtgtgctgcacccattaactcgtcatttagcattaggtatatctcctaatgctat

SEQ ID NO: 10490 - DNA, 201 bp, Homo sapiens
tccatttttacagcttccttacattatagatgatgttacctctaagatttttttcttttttcttttcctttcttttctttctttctttctttctttctttyttttttttttttttttttttttttgagacagagtcttgctgtgttgctaggctggagtgtagtggcgcaatctcagtccactgcaacctccacctcccgg

SEQ ID NO: 10491 - DNA, 201 bp, Homo sapiens
ggtataaattaaagcagtctggggaaacccaaacatatggtcaacctaatgatacctgttttcctgcataaaggggttataattgtactaatttatggtgyaaactgggtgctaaagctagtgatgagtttctctgctagaaaaatgttccaaagaaataaaccaagacagttaatgcagagttttggtagaagggataac

SEQ ID NO: 10492 - DNA, 201 bp, Homo sapiens
ggaacaaaaaacactggggcttacttcaggagggatggtagaaggagaaagaggagcagaaaaaataactattggatactagggttattaccttggtgatkaactgatctgtgcaacaaatcctatgataggagttcacctatacaacagacctgcacatgtacccttaaaccgaaaattaaagttaaaaaaaggaaagaa

SEQ ID NO: 10493 - DNA, 201 bp, Homo sapiens
ctgtgtgtaacagtcttgagctgctgatgaaagaaggtgtagaagagtgttggtgccaagatctggagtggagtggtaggatcctgacctggagcacccargaatgactgtcctttgtgcacaggtgatagacaaaactgggggaatgaggagttgaacatggaggtatatgaggaaggctcatccgctcttcagaaatcc

SEQ ID NO: 10494 - DNA, 201 bp, Homo sapiens
gaaggtgtagaagagtgttggtgccaagatctggagtggagtggtaggatcctgacctggagcacccaggaatgactgtcctttgtgcacaggtgatagayaaaactgggggaatgaggagttgaacatggaggtatatgaggaaggctcatccgctcttcagaaatccagaaacctaagtgtgaaaacacagatttgagg

SEQ ID NO: 10495 - DNA, 201 bp, Homo sapiens
tttgggaggccaaggcaggcagatcacctgaggtggagagttcaagacaagcctgacaaacatggagaaacctcgtctctactaaaaatacaaaattagcygggcgtggtggcgcatgcccgtaatcccagctattcaggaggctgaggcgggagaatcgcttgaacctgggaggcagaggttgcagtaggccgagatcac

SEQ ID NO: 10496 - DNA, 201 bp, Homo sapiens
ctgggaggcagaggttgcagtaggccgagatcacgccattgcactccagcgtgggcaacaagagcgaaactccatctcaaaaaaaaaaaaaaaaaaaaaaragagagagagagaaaagaaatatctgtgttaggaaaaaagctaggaaaagctaaattctggtcatttcataataaaacgaataatgaaacaaacagaaaa

SEQ ID NO: 10497 - DNA, 201 bp, Homo sapiens
atgccattctctgaaaatggcaatatacgcttacaattatttgtagcatagcattctacactaaaaagatgaaataaagaagttgaaattttctttatcarttaggatagctaatgatcttctgtggcaacaatcagcatgtcttacagcttaaaacaacaacgtttacttctcatccaccttacatcctatctttggtgt

SEQ ID NO: 10498 - DNA, 201 bp, Homo sapiens
tttttattttagttttacttgaaaaaagtataaattttgattttctgtattaaatcacttattcaaacaatgatttattcaacagaaagcattgaacactrtatttcttttctgacaaccacttctccaattctctgacaccaactgggtgcccaacaattttattcaattctgatactacctggagttagcacagatccc

SEQ ID NO: 10499 - DNA, 201 bp, Homo sapiens
tggagttagcacagatcccccaggttaaggactcagtctcacaagacttctgctactctagacaccagacactgtacatggagtgctcgggctacccacasttttgtgcagctgaccacaaattgggggttctcatgaccccctccacccctcagtttccataattcagtagagccactcacagaaccacgacatgttctt

SEQ ID NO: 10500 - DNA, 201 bp, Homo sapiens
ttcaaaggaatagcctttggccttgagtgctgcctcgagcccacaagcaccttctcatggttgagcacaccctattgcttgactcagtgaaatacattgawtatcctgccaacactttttgttgtacatctctttgccctcaggctagctacagaaagaaaaagagagagagaatacatttttacatttcctgttcttcat

SEQ ID NO: 10501 - DNA, 201 bp, Homo sapiens
aagaaaaagagagagagaatacatttttacatttcctgttcttcatgttgaatgaggcagtttatcttctgaacagctgctttgaaggtttgagtatgttmgatgcactaaacataacagcatagaaatgaaaaaaggaggttggcaaactaccttcttatcttcttttaaggcttttgaaggatttaagttgtttcacct

SEQ ID NO: 10502 - DNA, 201 bp, Homo sapiens
aggcagtttatcttctgaacagctgctttgaaggtttgagtatgttcgatgcactaaacataacagcatagaaatgaaaaaaggaggttggcaaactaccytcttatcttcttttaaggcttttgaaggatttaagttgtttcaccttttagtggcatcacagagaggttgagatttcacttagagagaatggctttgatg

SEQ ID NO: 10503 - DNA, 201 bp, Homo sapiens
agtctaaagatttgaaatttaaaagttttcaggctagagaacagaacttgatgtaatttctagaagtgaaataactcttgttaaaatcagatgctgctggyacgcaatccaaaagggattgtttagaccctagaagcttcaaataaattgagtctcagaaataggggggaattgagtcacacagttctgattgtttttgtc

SEQ ID NO: 10504 - DNA, 201 bp, Homo sapiens
tcaattgttaagcaacctatagagtttagagcagaaaaagctacaaaatgaagtaaatttttatagtggtttctagtgagaaacaatgtatgccctaggtrcagtgggccatggagaacatttattacattcttcttgtatgaacactgatatacgaagaaaataaaagctcagcttttgccttataacactacacttgcc

SEQ ID NO: 10505 - DNA, 201 bp, Homo sapiens
gcttggtgcactgaatcttgagaaatgatcttgaatgacctccaggatttaaatatagttattgaaaggggccgaaccaatgagatgattcacagcttccrcatggagccatctctatatgctaagtacgaggccagtcctcataaaaacccgccaaggagggcagtagcaccattgttaccagcacagactcctcccttt

SEQ ID NO: 10506 - DNA, 201 bp, Homo sapiens
ttaaatatagttattgaaaggggccgaaccaatgagatgattcacagcttccgcatggagccatctctatatgctaagtacgaggccagtcctcataaaarcccgccaaggagggcagtagcaccattgttaccagcacagactcctccctttcctagctgtgtgaccttaaggagaaatatacactccagaaatctgctg

SEQ ID NO: 10507 - DNA, 201 bp, Homo sapiens
ccagcacagactcctccctttcctagctgtgtgaccttaaggagaaatatacactccagaaatctgctgcttcttctctgaaaagggcacaacaatagtcrcccattgtagagaggattaatgggataattatattatgtaaaactcactgaagtattttgtttacatagggactattcaataaacataaaaattataatt

SEQ ID NO: 10508 - DNA, 201 bp, Homo sapiens
gctcatgcattttatgatcctatgtgggttatttaagctttttgtgcctcatctataagattgagaccattatgatattgatttcataggtactttgcagrcaggattacctatctgagagaaacttgatttatttctttgatgcatgcaaacttaagcttgccaatgctcatatttgtgcatttttccccacacaggaca

SEQ ID NO: 10509 - DNA, 201 bp, Homo sapiens
tttcataggtactttgcaggcaggattacctatctgagagaaacttgatttatttctttgatgcatgcaaacttaagcttgccaatgctcatatttgtgcrtttttccccacacaggacagtgcagtcgttaaggcaccatggttagtgtcatctctacatgcctcagcctatctcaaggtctcctttggacagtttgcaa

SEQ ID NO: 10510 - DNA, 201 bp, Homo sapiens
tccccacacaggacagtgcagtcgttaaggcaccatggttagtgtcatctctacatgcctcagcctatctcaaggtctcctttggacagtttgcaaatgartgcctgcctgagtctctatatctgagggagtcctctgcctgggggagcttatctgcccatgctcaagacatgagggctagaatttgtagataaatacaac

SEQ ID NO: 10511 - DNA, 201 bp, Homo sapiens
ccacagcaatagtggggttgttaaccagctttcctcccttctctgtctcactgccccacttcctcaatttgctctctgggatcttcccccaaataaatgayatgctcccaaatccttgtctcaaggtcttgttttaggaggaaccccaggcaaaggtagttacagattttagagcaggacttcctcctgcaaattctgact

SEQ ID NO: 10512 - DNA, 201 bp, Homo sapiens
atgtcatggaggtttgttatacagattatttcatcacccaataattaagcctagtacccattagttatttttcctgatcctcttcctcctcccaccctctrccctccaaaaggccccagtgtgtgttgttcccctctatttattcatatgttcacataatttagctcccacttataagtgagaacatgcagtattcagttt

SEQ ID NO: 10513 - DNA, 201 bp, Homo sapiens
ttctctctgtatatagtcacagagctccagggcatgtagtacttagaattttgtttttgctcattgcacaggaaatggtatgaaactgaggtaattcatasacacataatttgaatataaagaagaaaatgatagaggcatctggatgacctgatatttaatatagtaaaaggaaaatgttttcctaagcaaaatgagtgg

SEQ ID NO: 10514 - DNA, 201 bp, Homo sapiens
attaattaatttttttaaaaagccaaggaaatcatttggctagagagtgtgagcttgagaattggatagaagtaggggaagttaggctctgtggcactggstggtggaaagtctgcagtcagcactttgatcaggtcaaacccagtaatatttttgaactcttatttttctctgtcaggtgccagcaagcaaaactgagta

SEQ ID NO: 10515 - DNA, 201 bp, Homo sapiens
tttgatcaggtcaaacccagtaatatttttgaactcttatttttctctgtcaggtgccagcaagcaaaactgagtaaggaaataatagtttatggccttayattttagttagtttgagtacctgttgacaggtggtccaatttttgtgtttaatttagaagaaattctgaaggatgaggtttaataatcacaattgaagta

SEQ ID NO: 10516 - DNA, 201 bp, Homo sapiens
aaggaaataatagtttatggccttatattttagttagtttgagtacctgttgacaggtggtccaatttttgtgtttaatttagaagaaattctgaaggatraggtttaataatcacaattgaagtagtggatatgggatcagagtctgattgcattggatacaatattccaagatcactgaatgatacaactcctgcaaaa

SEQ ID NO: 10517 - DNA, 201 bp, Homo sapiens
acttgtacagtaggactaaagcagacaagcatagaatgcatgccattaattcttagccttgaggcataccttctcaataattaggagaatgaaaagaggtrttttttatatatccttccacctttatatatattttttattgttcaatgaagtagaaccctgtataaagaggagttcagggaatctattaaaaatccaggg

SEQ ID NO: 10518 - DNA, 201 bp, Homo sapiens
ttgtgtgttgcctgagggcaggagcaatgtcatcctttttgactttctggcacttaaaacagaatgtggctcatagttggaggtcagtacatatttgaatrgaagaatgcatgaaaatataaacgttagactcttcccttatggttattgttttagtttataaagtagatgtaaatatagcccaagataacatagcaattt

SEQ ID NO: 10519 - DNA, 201 bp, Homo sapiens
gcaatgtcatcctttttgactttctggcacttaaaacagaatgtggctcatagttggaggtcagtacatatttgaatggaagaatgcatgaaaatataaaygttagactcttcccttatggttattgttttagtttataaagtagatgtaaatatagcccaagataacatagcaatttggcaattctccatgaattttctg

SEQ ID NO: 10520 - DNA, 201 bp, Homo sapiens
cagaatgtggctcatagttggaggtcagtacatatttgaatggaagaatgcatgaaaatataaacgttagactcttcccttatggttattgttttagtttrtaaagtagatgtaaatatagcccaagataacatagcaatttggcaattctccatgaattttctgtaatagaatatttcagtaagcacagtatacttcctg

SEQ ID NO: 10521 - DNA, 201 bp, Homo sapiens
tgttttttattttaagtggtaaagttgctcttttaattcaaatttgttttttaattgacttataaacttgtatgtatttatagtgtacaacatgatgcttygaagtgtcaataatcaaatggttaaatctagctaatttaatcataatttaaatagctagatctaaccattttgttattgacacttcaaaacacacaaaca

SEQ ID NO: 10522 - DNA, 201 bp, Homo sapiens
tgtatttatagtgtacaacatgatgcttcgaagtgtcaataatcaaatggttaaatctagctaatttaatcataatttaaatagctagatctaaccatttygttattgacacttcaaaacacacaaacacacataatgaaatggtcaaatctagctaattaacaaatacattacctcacatagttatcatctttatggtga

SEQ ID NO: 10523 - DNA, 201 bp, Homo sapiens
cactgaacttctggctctagaatagagaccctgctaaatgtatcatctctcagcagtccatttctattaagtcttattctttaaaggccatgaggtatttktaaacacgagagctttccaaactttcattaaaggaaagtgtccctttcccagacaatgcttccagctcagtcagatgcccaagcatgaccagaaggagac

SEQ ID NO: 10524 - DNA, 201 bp, Homo sapiens
catggatgaagagaacccagggggtgtctttgcacacatgatgctctaaagcattttcagatctcctctatgggcccagcaagagtgctgtttctgaggargaaggcagattgctggacggattcacaaaccacggcagctccaactctcctaccgatgcctttactccaggtgcctcagccagtagcaacaggtctccct

SEQ ID NO: 10525 - DNA, 201 bp, Homo sapiens
gctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctccta

SEQ ID NO: 10526 - DNA, 201 bp, Homo sapiens
ctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctag

SEQ ID NO: 10527 - DNA, 201 bp, Homo sapiens
taaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctagg

SEQ ID NO: 10528 - DNA, 201 bp, Homo sapiens
aaacttaaagtgtaataataataataataataataataaaagaagaaatagacaatgggcttaagtgttcactcacctcctgtgcttccctgggcctacgkttatggctcctaggcatatgggagaggttgagtcagtcactgtggcttagaggctgcagtgccttatcaatttctggcattgaattatgactagaatttg

SEQ ID NO: 10529 - DNA, 201 bp, Homo sapiens
tggttccagaacttcaaaggaactcaaatttgaggatgctcaaatccctgacaaaatggcatagtatttgcatgtaacctatgcccaccctctcacatacygtaaaatcatctctagattacttgtaataaataatacaatgaaaatgctatgtacacagttgttactgtttcgagaatattgacaaggaaaaagttctgc

SEQ ID NO: 10530 - DNA, 201 bp, Homo sapiens
tcactataaaagacgccagaggaaaaaagagtacatattgtatggttacatttatataaatctaaaaaatgcaaactaatctctagtgacagaaaacagawccctggctgctagaggagcagggagaggaagggagtacaaagagccatgagaaaacttttgaggataatgtatatgttgcttatcttgattgtgttgatg

SEQ ID NO: 10531 - DNA, 201 bp, Homo sapiens
ttactaaaaatacaaaaaattagccaggtgtggtggcaggcacccgtaatcccagctactcgggaggctgaggcaggagaatcacttgaacccaagaggcrtaggttgcagtaagtccagatcgtgccattgaaaaaaaaaaaaaaaaagaaacaaagaaaagaaaagaaaaagaaaaaaatttctagtctctctgatctc

SEQ ID NO: 10532 - DNA, 201 bp, Homo sapiens
acctgatgtttttagtttgctggcttcagtttcttagaggcaccctattgggccacatgagagattatagaattatgttgtgatcatggtgggctattatytctgcaaactctcctgacaccatcagtgcaccaggaaggttggataatcctacgtggatgtggagaaatctcaacctttttttatttgacattaggattt

SEQ ID NO: 10533 - DNA, 201 bp, Homo sapiens
agtttaacagtcaagaatgtggttctttaggacattttctctttagtgtgcctggagcttctaaatcttatttaaaccttctttttgaaatagatgttgcrtatctttggctgtaagaggaagtcaggacttgttctctctgcttccagacccactccccagccatgtagactttatatttgaaggtccagagtgattttt

SEQ ID NO: 10534 - DNA, 201 bp, Homo sapiens
ggacattttctctttagtgtgcctggagcttctaaatcttatttaaaccttctttttgaaatagatgttgcatatctttggctgtaagaggaagtcaggasttgttctctctgcttccagacccactccccagccatgtagactttatatttgaaggtccagagtgatttttcttttttttttttttttgagatggagtct

SEQ ID NO: 10535 - DNA, 201 bp, Homo sapiens
gtggcgcaatctcggctcactgcaggctccgccccctggggttcacgccattctcctgcctcagcctccggagtagctgggactacaggcgcccgccacckcgcccggctaattttttgtatttttagtagagacggggtttcaccgtgttagccaggatggtctcgatctcctgacctcgtgatccgcccgcctcggcct

SEQ ID NO: 10536 - DNA, 201 bp, Homo sapiens
ctcggctcactgcaggctccgccccctggggttcacgccattctcctgcctcagcctccggagtagctgggactacaggcgcccgccacctcgcccggctrattttttgtatttttagtagagacggggtttcaccgtgttagccaggatggtctcgatctcctgacctcgtgatccgcccgcctcggcctcccaaagtgc

SEQ ID NO: 10537 - DNA, 201 bp, Homo sapiens
gaaacactggtcctgttacaccattgccctcctggggagacacaagggcaagtatatctggccatagctatcacttgccaattagcctggtgactagatayatgttttatctctatgtatcaaccagagcaaatgtggggccagaatgggaccaaaatggatgtcaccaatgggttgaccagtttagggatgaaggagtca

SEQ ID NO: 10538 - DNA, 201 bp, Homo sapiens
ctttttatctttgttcagcacacacgtgctctttttattttctctatgtctcacagctctcagagattatcaatttgctccctacgctttaatccattctrtaagttccatccaactttttgttgcttgctatgacaaaatcgaataatcttaaataatgcagcaaacacacgttgcagcctgtttaagatattttaagag

SEQ ID NO: 10539 - DNA, 201 bp, Homo sapiens
tttattttctctatgtctcacagctctcagagattatcaatttgctccctacgctttaatccattctataagttccatccaactttttgttgcttgctatracaaaatcgaataatcttaaataatgcagcaaacacacgttgcagcctgtttaagatattttaagagttctttttgatctaggagataaaacacaaagtt

SEQ ID NO: 10540 - DNA, 201 bp, Homo sapiens
cagtacagcaggttcttgtaagcaggttcttaaaatctcctcctggctacatctttagactcatttcctacctctcataaaaatgccctccactaccctaygacacggaagtactcgacatttgctgaacttgcatgctctcttaatctctatacgtggcagtttttaaaatctcttgtctacctggagcactagttctgc

SEQ ID NO: 10541 - DNA, 201 bp, Homo sapiens
aaaaagcataagctttgctttctctaacaagtattacttgaacaccactatcttcttaaccccaaactcagacccaaatgtgcatgtatatatgcacacayacactcccaatagcttctctctttccctgtgttccttaggtataatgcaaagaactcatagtagtattaaagcacttaaaacattgtattacatttttat

SEQ ID NO: 10542 - DNA, 201 bp, Homo sapiens
agccaacataagaagagttaccctaacagaatatagaccacagagttcttcccttcaagtatggattcatcatacatccttcaaacctgccaagtacttcrctttctttctctctaccaacctgcttcttaccaaccttctaaagtcctgttcttgattcaccctaggctcacctataaccttcagaagccctgtctctga

SEQ ID NO: 10543 - DNA, 201 bp, Homo sapiens
aggaaatttgaaatagaaaaacagagctgaggaaagaaataaagatgaatcaaaaattaaattggagttatatgatggttcagggagcaacacatgtgtaragaaggaaatgagaggctggaactttggggaatcccagagttaagtaatagacaggggaagaggcagggaggggaggttgctcatgaaagttcatacatg

SEQ ID NO: 10544 - DNA, 201 bp, Homo sapiens
gcttctgtgagtggagtgaaatttaaggtgcctaaagaaagctaacaggaaaagtctgaaggttgagaaaagaagcaagatcactgttaaaaaaaaaaaatatatatatatatatatatatatctcaaagaatctagaaaaaggataggaagtggagtcagaggagagtttagtcttggacaaggtggcagggtccttact

SEQ ID NO: 10545 - DNA, 201 bp, Homo sapiens
gacattccagagtttccttgtgagttacaggtttggttaggagggaagtggagctaactgttgaagaatagagattggccaaatctctggaatttcagaarcatcaactttgggaaacggaatttgctaatggagtggagtctgatgcagttcttcacttattttcttctggtatgcagaccaaaattatctgagaatgat

SEQ ID NO: 10546 - DNA, 201 bp, Homo sapiens
agtaaaatgaagggttattctttattgttctcagaaaggtggtttgagaatcacctgtgtggtgggctaagtattgtttcctaaaaatttgatgtctaccyggaacctcagcattgtgacctgatttgtaaatagtgtctttgcacatgcaattagttaagatgaggtcacactggattatggtgctccctgattcctatg

SEQ ID NO: 10547 - DNA, 201 bp, Homo sapiens
aactaggaagggacaaaaatgattctcccctggagcctttatgacctgctcacaacttgattttagacttctcaccagaactgaaagataacatattttcrttgaaagctactaagtttgtgataatttgctacagcatccctaggaaagtaataccacctgcatccggaatatcaggaatcttattaaaatgccacttca

SEQ ID NO: 10548 - DNA, 201 bp, Homo sapiens
aatcttattaaaatgccacttcatagtatccatcccagatcttctgaatcagaaatactgagactagagccctgagatttaaactattaacattatttatstttcttatgaagttttaaatgtgagaaccactggcctaaatgatgccttaacagctctgaacaatctgaaagttaaaatgacaggactattttatgcata

SEQ ID NO: 10549 - DNA, 201 bp, Homo sapiens
gaatcagaaatactgagactagagccctgagatttaaactattaacattatttatgtttcttatgaagttttaaatgtgagaaccactggcctaaatgatrccttaacagctctgaacaatctgaaagttaaaatgacaggactattttatgcatatagacgacatctcccccggtgaagtgtgttacttcccatcctata

SEQ ID NO: 10550 - DNA, 201 bp, Homo sapiens
gcaattaggttatgcaacattgggcaattgactgaacttctttctgtgtcagttttctcaagggtaaaatgtggttgttaatgggacccatgtgttagtcmgctctgctcagttatgctgcagtaacagatgcctccctggaatcctagtgacttaaatgagcagagctttatttcccaccggcattaatattcatcctag

SEQ ID NO: 10551 - DNA, 201 bp, Homo sapiens
taatattcatcctagttctgctgcagtgcttcttcatgcctcttcatttctggaccctgcctgaagaggcagctctgatttgtcgcatcctggatttgtgrccaagggaagagagctagcagagccatgtggtggccctcagaccttctaagtggttcacactatttctgctcacattttcttggctgtgaagcacataag

SEQ ID NO: 10552 - DNA, 201 bp, Homo sapiens
tcacattttcttggctgtgaagcacataaggcaaaatgcctgacataagaggcagaaaatgtaaccctccagaaagggtggacctattcggaagaggctgrtaggaaaagacagcaaatattgtcaaaaataatgtaatcaaccacagcaactttatgggattgacgtgagtattaagtaagttaacataggtaaagcact

SEQ ID NO: 10553 - DNA, 201 bp, Homo sapiens
tttcttggctgtgaagcacataaggcaaaatgcctgacataagaggcagaaaatgtaaccctccagaaagggtggacctattcggaagaggctggtaggaraagacagcaaatattgtcaaaaataatgtaatcaaccacagcaactttatgggattgacgtgagtattaagtaagttaacataggtaaagcacttagaat

SEQ ID NO: 10554 - DNA, 201 bp, Homo sapiens
cagaaagggtggacctattcggaagaggctggtaggaaaagacagcaaatattgtcaaaaataatgtaatcaaccacagcaactttatgggattgacgtgmgtattaagtaagttaacataggtaaagcacttagaatagtgtcttatgactattgtctggtggtctattattaacggggtcttgtgcaagtatgtgaaga

SEQ ID NO: 10555 - DNA, 201 bp, Homo sapiens
gaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactc

SEQ ID NO: 10556 - DNA, 201 bp, Homo sapiens
aatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactct

SEQ ID NO: 10557 - DNA, 201 bp, Homo sapiens
ctgtgagaacaaaccagagaggaaggatttttcagacaggctgactagggtttgagtcccacagctgtatgaccttgacaggtcacagagctttgctctgyctcttgattcctaaagctggggtatagtagatcagctgcatgctacaaaactaaatgagaccacgtatgcaaagcaactggtacttctttatatatggta

SEQ ID NO: 10558 - DNA, 201 bp, Homo sapiens
aaccagagaggaaggatttttcagacaggctgactagggtttgagtcccacagctgtatgaccttgacaggtcacagagctttgctctgtctcttgattcstaaagctggggtatagtagatcagctgcatgctacaaaactaaatgagaccacgtatgcaaagcaactggtacttctttatatatggtactttcattccc

SEQ ID NO: 10559 - DNA, 201 bp, Homo sapiens
ccctccatttcttctctccccctcaacccatccactcatttgtttatttaatttattcagttttatttatttgctcactagtttttttccaatacattgarcaccctcttggtgcaatgtgccatgcttagttgttggggattacaaaggtagaatattctacctcaaagggcatagaagtgaatttttttttttaaaaaa

SEQ ID NO: 10560 - DNA, 201 bp, Homo sapiens
caaaaaggtcaattcacaagaatacagacttaaattagaaatgtattaggggatggtaggcagcaggtcttatggcatatcctcgttagaatctctttagytcaatcacattcagcttcaaaatctgtgactttagtgataaacagtaagatcacacgatcagactcaaaagcactataatacctaaaaatcattgtaaga

SEQ ID NO: 10561 - DNA, 201 bp, Homo sapiens
aaacaagagtagaatcaatatccacaaaaggatcttcctgcctatccctgagaaaattgcccttatctcttgaaaagtggtttcatggagagagattatcrcaagaaagcttgagcctgtccccagcttaccactgctgagcactgctgtaaatttatggcttgaggtagaggtttggcaatacattggggacaatattct

SEQ ID NO: 10562 - DNA, 201 bp, Homo sapiens
agagcttccagtatgtgttgaagagctttcaggtttgtaccatgtcattaggacttcatgtgatctggactctgcctacatcaccagctttgcatgattgrctccttcctaaatgcaccttctcagagaagccttctctgatcatctcatttagtatctttctacccaaccaactgctcaggacaagagtagagaagtcac

SEQ ID NO: 10563 - DNA, 201 bp, Homo sapiens
agaagtcacctcaaagaggccttcctggaacattctacaaagtagccagtcctcagtcctcactccctacccccaactgcttttcatcgtattaccctgcyttattttagatagggttgacagaactcaaccctatctaaaattatctcatgttccttaatttgtgtattgtctatcagattttctcaccccaaagtagac

SEQ ID NO: 10564 - DNA, 201 bp, Homo sapiens
tcatgttccttaatttgtgtattgtctatcagattttctcaccccaaagtagactgtaaaccatgtaaggcaggacccgttctgtcttgtttatctttttrtcctccacaatgaggatcagaatgagcatcagaatgtgaccacagtgcctggttgccttctgatgctcaattagcatttgtgaaagatgtgaatagatag

SEQ ID NO: 10565 - DNA, 201 bp, Homo sapiens
tgtagaagacttcaagaaaaatccctgcaccttccacacctgttgtaggaggtatggcagctattcctgagccttaagtactccagtaagaatgaaatgawctatttgaggtgttctgccaaacgggctctaaaaataattatgatttaaaatgttttttttttccagtgaatatgaacgctttaaaactaagtttgtaaa

SEQ ID NO: 10566 - DNA, 201 bp, Homo sapiens
cctctttgaataaatagaaagatgttcaggtaaaaccaagtgattatgatacagatctcaccccctccctccccaacctccacccaagcaaaagtttccartggttccccatacacttttggaaacagagctttgtggcatatggaaggaatttctaccccctgcgtatgagcaaacccatctggtttagttggtttggcc

SEQ ID NO: 10567 - DNA, 201 bp, Homo sapiens
ttactattgtgatttctatggtcgtgaatcctagtaggaccctgtgttaatggaaatgtcaagttaaggcatatgtgttgcaaagttcttttctcgtcctrttggtggatactctctaaaagccagactggtgtatcatgccaaatggccaaattattctatagaaaaaatactatggtaaatttcctatatcttaaagga

SEQ ID NO: 10568 - DNA, 201 bp, Homo sapiens
aaatactatggtaaatttcctatatcttaaaggaattcgtctggattctaaaactttgagagattaatgactgctaactacagcttcctgtaaatgattgyttactgccattggcatttgaaaaccttatatctaagataaaagaaggcactatttttttcattactgtaccattatcctttatgtttgaattgagacttt

SEQ ID NO: 10569 - DNA, 201 bp, Homo sapiens
tctttggcctggtgggatttacatttagaatgtggaaagaaacattcagagctccacacaatcaataagtatttcctaagagtctgttctatgtcagcagyatgctagaattgcagaagataaaatggaaacagatgagattacctgtttcctcaaataatgaaccaattaagcagatcagataggactctggtatttgaa

SEQ ID NO: 10570 - DNA, 201 bp, Homo sapiens
agtatgctagaattgcagaagataaaatggaaacagatgagattacctgtttcctcaaataatgaaccaattaagcagatcagataggactctggtatttsaaaacaggaccaaaatatataatgagattctaattttgatgggtgagattacaatttgtcaatcagaagagagaattacccatttgggctggagaaatca

SEQ ID NO: 10571 - DNA, 201 bp, Homo sapiens
ccaccacgcctggctaattttttgtatttttagtagagatggcgtttcaccgtgttagccaggatggtctccatctcctgacctcctgatccacccgcctyggcctcccaaagtgctgggattacaggcgtgagccatcgcgccaggccttacatgctatatcttataagtcttccctctctgatattctagagcaggaca

SEQ ID NO: 10572 - DNA, 201 bp, Homo sapiens
agcatgaatattctgtaatttggggtcttataatttaattttatattcatgagcctgagtttctatacttctggaatcaggaaatatagtaagatatgtaygtgcatgtacaggtgtgtgtgtgtagagaaggatagcctgtggattaaggaagagcgtctaggcacatatccagtgcccagtaggcattagaaactgtta

SEQ ID NO: 10573 - DNA, 201 bp, Homo sapiens
tttgtaaattgcactttcttttaccactaataattaaaaagcagggccaagtcacgaaatgccattatccagtaatttgattttttgaaattaatgaaackctttcattttcagacgtgtccccccaaccccccgaacttcactgctgatggaagaaagcagccagaaggataaagaaatttgagaggggaaaagtgctgt

SEQ ID NO: 10574 - DNA, 201 bp, Homo sapiens
ttgctgagctcttagttttgaccaggaacctcatgtgtggaaatggtgaggacccaaaccttgaccccaaagcaaatgtctcaaatacaagcccctccccscagaagttaggaatgctggctgtgctcagacccctctggtagccactgggggacatatagaagacacaagaggtggcctctacttaaaaagagcccacat

SEQ ID NO: 10575 - DNA, 201 bp, Homo sapiens
agcacagtgcttgccttatatggaattttcagtagtcttggttttggcttgttatctttctccccagttacttctctttcccctgaagtttgaaagaagckgctgtgaggtatgaatatatttgccccttaagtagaaaggaggttcagtttgcagacagcattcagaggagatgagtgaaaggtttccatcactactatt

SEQ ID NO: 10576 - DNA, 201 bp, Homo sapiens
gcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttctt

SEQ ID NO: 10577 - DNA, 201 bp, Homo sapiens
tctttttctttcctttttctttctttctttttttttgagacggactcttgctttgtcacccaggctggagtgcggtggcatgatgtcgactcactgcagcytctgcctcctgggttcaagcagttcttctgcctcagcctcccaagtagctgggactacaggcgtgtgccaccacgccaggctaatttttgtatttttagt

SEQ ID NO: 10578 - DNA, 201 bp, Homo sapiens
cccatcattttccagcccagctccccttcctggtaggagtagctatagccaatttgacagtagatgtttctttcagtcactttattaatttagagcatgcraatttagattatgttgctttgtattttcacagcctgtctgatttttaacactaagcaattttatttcctagttatttgttagcagatttatgttgcattt

SEQ ID NO: 10579 - DNA, 201 bp, Homo sapiens
tttccagcccagctccccttcctggtaggagtagctatagccaatttgacagtagatgtttctttcagtcactttattaatttagagcatgcaaatttagrttatgttgctttgtattttcacagcctgtctgatttttaacactaagcaattttatttcctagttatttgttagcagatttatgttgcattttgattttt

SEQ ID NO: 10580 - DNA, 201 bp, Homo sapiens
ggagtagctatagccaatttgacagtagatgtttctttcagtcactttattaatttagagcatgcaaatttagattatgttgctttgtattttcacagcckgtctgatttttaacactaagcaattttatttcctagttatttgttagcagatttatgttgcattttgatttttatatttaagttaaccaacatctttttt

SEQ ID NO: 10581 - DNA, 201 bp, Homo sapiens
taacatgtaaatctaatttttgtgcttatagggaatataagaaattttatttttatttttttagagacagcatctcgctgtgttacctaggctggagtgcrgcctcaaactcctgggctccagtgatcctcctaccttagcctcctgaatagttagcactataggtacatacctctatgcctggctaatatttttttttta

SEQ ID NO: 10582 - DNA, 201 bp, Homo sapiens
gaaaagcttatttttgcaaaagagggctatgatttgtattgcatctaattcttgagtattactaactacaaccacccaatttataccaaaagatgaaacayaaatattttaaatcctaccattagcccatatatgcaagtttttagaagctgccctttcctcaagacattttactaccatgtattagaaaatagtcaaaac

SEQ ID NO: 10583 - DNA, 201 bp, Homo sapiens
atttataccaaaagatgaaacataaatattttaaatcctaccattagcccatatatgcaagtttttagaagctgccctttcctcaagacattttactaccrtgtattagaaaatagtcaaaacaaaaaaccaaaacaaaaaccaaaacagattaatggttgatgatgaatttaaaagtcacccccttatgttttgtagtgt

SEQ ID NO: 10584 - DNA, 201 bp, Homo sapiens
aatttttgagatggtatatataaaatgaatgacacataataaatattggtttcctttttttgcagggtagaaactcaggtgcttatctcatttatgctgtyccccccccccccccagctatcttattccttatctgatgaattatctcaagtgtatcaaactagttgacatggtcaccacatcctttactcattctctttt

SEQ ID NO: 10585 - DNA, 201 bp, Homo sapiens
atttttgagatggtatatataaaatgaatgacacataataaatattggtttcctttttttgcagggtagaaactcaggtgcttatctcatttatgctgtcycccccccccccccagctatcttattccttatctgatgaattatctcaagtgtatcaaactagttgacatggtcaccacatcctttactcattctcttttg

SEQ ID NO: 10586 - DNA, 201 bp, Homo sapiens
gatggtatatataaaatgaatgacacataataaatattggtttcctttttttgcagggtagaaactcaggtgcttatctcatttatgctgtcccccccccycccccagctatcttattccttatctgatgaattatctcaagtgtatcaaactagttgacatggtcaccacatcctttactcattctcttttgctaattac

SEQ ID NO: 10587 - DNA, 201 bp, Homo sapiens
tagtaggtactcgataaatggtaggcttattgtttacaaatattattttatgtcaaacatctaataatactgcatgtctacccatgcagcacaacaaaccrtgctcagcctgttcctgtagatgatccactgtctcttgagatactaaatgaattttacaggtcttcctgaatccaacaattctttgcagtgtaaacaatc

SEQ ID NO: 10588 - DNA, 201 bp, Homo sapiens
tatagtgtttagaagattgtagaatggcagtaattccatttatcctggaataattaatcatatgaagtcaaatcacaatataagagcacatattagaaagygtaagatactggtcaaatgttacagaatttttattatgccatcagttcttcagatttaaaagttaacaggaatcatccattaactctatgtcagtgtttt

SEQ ID NO: 10589 - DNA, 201 bp, Homo sapiens
acctcacttaagagagttttaagagaagcagtaagagcatcagcaaaaagaaattacataacgagttggggaaaatgtccctatccctatctacagctctrtgtgcagtttggcattactcatcacatgcattacagagagctccgaccttcctctgagtatggttgattgttcaaagccggatattgtggcttgatggct

SEQ ID NO: 10590 - DNA, 201 bp, Homo sapiens
tgtcattggaagtttgtaccactgtgaataagcccttgcaagagatcccaggagcattttagggttctgtgtaagatggtggggaggtaaagggagagcamaaaacactggagacactgcaaaaaggcatcatttttattctgaatctcttgtgtagagcatgagacccccaagaaggcctttgagcattaggtagtatga

SEQ ID NO: 10591 - DNA, 201 bp, Homo sapiens
actgcaacctccacctcccagcttcaagcgaatctgctgcctcagcctcccaagtagctgggattacaggtgcccaccaccatacctggctaatttttgtrtttttagtagagatggggttttaccatgttggccaggctggtctcgacctcttgatctcaggtgatccacccacctcggcctcccaaagtggtagcaaaa

SEQ ID NO: 10592 - DNA, 201 bp, Homo sapiens
aagcgaatctgctgcctcagcctcccaagtagctgggattacaggtgcccaccaccatacctggctaatttttgtgtttttagtagagatggggttttacyatgttggccaggctggtctcgacctcttgatctcaggtgatccacccacctcggcctcccaaagtggtagcaaaattatttaaaaacttgctaatttagt

SEQ ID NO: 10593 - DNA, 201 bp, Homo sapiens
atttttgtgtttttagtagagatggggttttaccatgttggccaggctggtctcgacctcttgatctcaggtgatccacccacctcggcctcccaaagtgstagcaaaattatttaaaaacttgctaatttagtactcttcagctctcaagtatgagtagcaaaaaagaaaaaaatcttgaaactagtatttgattttatg

SEQ ID NO: 10594 - DNA, 201 bp, Homo sapiens
aaagaatatacactagttaggacttaaagtcagaggaagctttacaatagctttcagtttcaaagtatagagggcccttgtggcaatactgttgttttagwcattatgtttaattgtcaagaaagatccactatgtatttctctgtaaatggaagagagagagaagggggcaggactcaatctgaatgcaagacaatccaa

SEQ ID NO: 10595 - DNA, 201 bp, Homo sapiens
ccttgtggcaatactgttgttttagacattatgtttaattgtcaagaaagatccactatgtatttctctgtaaatggaagagagagagaagggggcaggaytcaatctgaatgcaagacaatccaaggagattgaagctccttaggactggatttagcggattaaactagacaactacatctcttccctgactttactatc

SEQ ID NO: 10596 - DNA, 201 bp, Homo sapiens
attcttgtaatgacttgacagtctctttgtttgtggcaggagctgctttttttttcgattatttggggccgtcttactctttccctgttttataggaaaarcttttagttttttgtttcctaacattggggtgtggactattactcacaagctggctttttcagctacaacctgtgagtatagatagtactaattaccatg

SEQ ID NO: 10597 - DNA, 201 bp, Homo sapiens
acaagtatgttttagatggatgaacgatggaagcacattcgagagcttggcttaattgggaatctacaagaagctcaatgtggctgaaataatgtgtgtgkggggatatgatagcacatgaaatgggagtggtaggatagagacaggtaatgacagacttttcctgtaaggagttggactttatcccaaggatgctgtgag

SEQ ID NO: 10598 - DNA, 201 bp, Homo sapiens
ataaattatgagaaataaaagaataactcttttttgtattaggtgattaattagaatcttcctattccatctttaattataacttctcttagcaggttttrtttctgatgtttaatgactttttttctagaaatgtaaggtgtccctctgcccagatggtgaacacgtggtcaggggatccaggatccattggatctgggt

SEQ ID NO: 10599 - DNA, 201 bp, Homo sapiens
tgtttaatgactttttttctagaaatgtaaggtgtccctctgcccagatggtgaacacgtggtcaggggatccaggatccattggatctgggtgctaagtrctggctattttgagaaagtcaatcaatgtattgggttcagatgccttggaaatctcaagattctttaaaggcattttagaacagagttagaattagtcaa

SEQ ID NO: 10600 - DNA, 201 bp, Homo sapiens
ttgtatcacattctccattgtattttttgttataaaatatagtacttgacctactataagttcctcaaaatgctttctattgtggaaaataataagagagwcataaattgcagtgaacttcccattattgttcttgtgtccttttcctccacattatacgagagaggcgtacaacacaactgtgtcagtgtggcacactac

SEQ ID NO: 10601 - DNA, 201 bp, Homo sapiens
attctccattgtattttttgttataaaatatagtacttgacctactataagttcctcaaaatgctttctattgtggaaaataataagagagacataaattrcagtgaacttcccattattgttcttgtgtccttttcctccacattatacgagagaggcgtacaacacaactgtgtcagtgtggcacactaccaaaatgca

SEQ ID NO: 10602 - DNA, 201 bp, Homo sapiens
tgattattgtcctttctagcagaattgctgatgatctttattgagagtctccttgatgaaggcatacactaaggacttggcaggttgtatctccattgtgrctacaaccttagctgatagatactgttgtctgtttcataggtgactttataggtcttgcatatgttctttcatttaatcttcacaccatatgatgcagta

SEQ ID NO: 10603 - DNA, 201 bp, Homo sapiens
atttatatacatatgtataaaaataggaattggctcacatgattatggaggccaagaaactccacagtccgctgtctgtatgctggagaataaaacagttkgattctaaagccctgggaatgggggtggcaggggcagaagtggcatgatagtgtaagttctgctctgattcgaaaagcccaagaaccaggagcacaagtg

SEQ ID NO: 10604 - DNA, 201 bp, Homo sapiens
gctatctcacctcaagcaaagaaagcgaattcctccttcctctgcctttttcttctattcagaataggaccacaacagattggatgatgcctactcacacyggggaccatctgctttattctcttcaccagttaaaatgctaatctcatttgtaaataccctcaaagacatacctggaaataatatttcattattattata

SEQ ID NO: 10605 - DNA, 201 bp, Homo sapiens
gagcaaagtcacgtcttacatggaggcaggcaagagagaacttgtgtaggggaactcccctttataaacccatcagatctcatgagacttattcactatcrtgagaacagcatgggaaagacctacccccatgattcaattacctcccaccgggcccctcccacaacatgtgggaattaagggagctacaattcaagatga

SEQ ID NO: 10606 - DNA, 201 bp, Homo sapiens
ctaacaccattgacatcttattcagtctttccagacacatttctgttgtcttgtcactttctgtagtatacaaagaaagtcaccatcttttctcaaagggwtatgtgactattttcgtgagagttattcacatatcaagagcaaaaataacttataccattcctatacaggaacttcctaaggcctttggatgttttaaga

SEQ ID NO: 10607 - DNA, 201 bp, Homo sapiens
tattttgaatagaaccctcacgctataccaaatacaatatcagaaattagagatgtaaaggtgaccaagacagacaaggcttctgcccttgagaggcttayggtccagtaggatttgaaagacagtgaggaacttaatagttctgacaaaaaacggatgcactgaccagtggaacaggatagagacccccaaaataaactt

SEQ ID NO: 10608 - DNA, 201 bp, Homo sapiens
atggaaaacagaatggaggttcctcagaaaactaaaaatagaattaccatatgattcagcaatcctgcttctgggtttcagtccaaaataattgaaggcastacgccaaagagatatctgcattcccatgttcattgcagcattaatcacaatagctaaaaattagaagaaacctgggtgttcatcctcagatgaatggat

SEQ ID NO: 10609 - DNA, 201 bp, Homo sapiens
tttgttttcttactattgagttgtttgagtttcttacatattttagataatagtcccttaacagattgttttattcagccttaaaaaaaagtgggaaggcygggtgtggtggctcatgcctgtaatcccagcactttgggaggccgaggcaggtagatcacgaggtcaagagactgagaccatcctggccaacatggtgaa

SEQ ID NO: 10610 - DNA, 201 bp, Homo sapiens
gcttgaacccaggatgcagaggttgcagtgagccgagatcatgccactgcactccagcctggtgacagagcaagattccatttaaaaaaaaaaaaaaaaargaaaaaaaaagaaaaaaaggctggaaattctcttatttgcaacaacatggatgaacccggaggatattatgccaagtgaaataagccaggcacagaaaga

SEQ ID NO: 10611 - DNA, 201 bp, Homo sapiens
gccaagggtccagcaggaagcgcaaaggaactcgaagataggggtgggcatgaagtattaaggcagtggtccaggaatatgagcaggcatctgaaccaccyggagggcttgttacaactcagattcctcaattctgcccccagtcagtaggtctgggtacagccttaaagtgtttttctcataagcttccaggagatgcag

SEQ ID NO: 10612 - DNA, 201 bp, Homo sapiens
ggagatgcagatgctgctggtttaggagcaacactctgggaatcattgtgttaggaactaaaaacaggagagggctgtagcactgtgagctagggacatayggtaagaaatgagactggagaaggaggcaggggctcctaggagctcaatcttgaaaggaggttcaaggttagttccagattgttgagaagttgaaagttc

SEQ ID NO: 10613 - DNA, 201 bp, Homo sapiens
gggaatcattgtgttaggaactaaaaacaggagagggctgtagcactgtgagctagggacatatggtaagaaatgagactggagaaggaggcaggggctcytaggagctcaatcttgaaaggaggttcaaggttagttccagattgttgagaagttgaaagttctattaagtccttagtgacaatactgttgttcttggat

SEQ ID NO: 10614 - DNA, 201 bp, Homo sapiens
aagatatggaaaaggcttcgtctttagattcaatcaacattcaaagaattattgtgttttcccagagtttttgctgttttactgccttttacagtaaaacyttccataaaccttccatgtgtttctgattattgagtacaattgaattactagccaattgtatggtgagagctgtttggccagggagcccctgtggacttc

SEQ ID NO: 10615 - DNA, 201 bp, Homo sapiens
gtctcaaaaaaaaaaaaaaaaaaaaaaaagaattcatttttagaatacctagagcagcagtgtgctgtagtgcaacggctttcaaacttcagactgcattygaatgtcctggaagcttgtaaaaacagatgtgtgcctccctgcaaaagtttctaattcaatgggtctggggtgagctccaagcgtttgcattcctgacac

SEQ ID NO: 10616 - DNA, 201 bp, Homo sapiens
cttatgagaagagtgaagagatgtgtcttgcttaacaacactaaatattctcccacttgctcactccctgtgttttttctttagattagaatagcgactgrgaaacaataaccacagcagcaaaccatttcaggcaatatttttgttgtaagggcttcagttcttcatgaattaaatcaccttatcttattgaatttaact

SEQ ID NO: 10617 - DNA, 201 bp, Homo sapiens
taaatcttttcattatagcagacttgggaaactgcctctctaacaggagctacttgcctagtcccccacctggagattggaccacggcttctgtgattggwtagatacatagatacatgcaaatgatgaagttcacatctattttttttttttttttttttttttttgagacggagtctcattctgctattgcccgggctg

SEQ ID NO: 10618 - DNA, 201 bp, Homo sapiens
atgaaaacacttcagtttattactacatatccaaaaactgaaacttactcaacagggaaatagctaggtcttatattttccaaaataaggtactaaatccrtcatgtgtaaaaaagttaatcatatgtaggcatgacttgtaaggctctaaaaatgtctgcattttagggtattcctttttcctagcattggttcttttat

SEQ ID NO: 10619 - DNA, 201 bp, Homo sapiens
aacatagctgtgcaaagctgatattctttagagctgattgtcttgtataagagtgactcccttgtatggggttaggaaacaaaaatcctctgattggaaayccaagtgtaattgatttgctaattgtcttacatagttttagatatgaccttccacaatgttatgtaatggtaaagtcatggggagtttcttttgggttga

SEQ ID NO: 10620 - DNA, 201 bp, Homo sapiens
ttttgggttgacttttagggctgttttgattctgcaatctaatcatcccagaagaaatgttgagttaatgtagaagtcagtatgatctgtggaagaaaacrtaagtaacattctccaagataatcttcagttctcgtgaaacatttaaaattgagggagctggctattcagagggtgagcaccacctgaaaatcaacttaa

SEQ ID NO: 10621 - DNA, 201 bp, Homo sapiens
aatattgtcactgtcagcctgctgttgagtttttctttccttcaaacatcgaaaaatgttgtgtagaatagaaccctcctgcatgcacccacacatgtgcraaagggttgtcatttttatggactttgtgaaaatagcagttttaaacatttcatacctatccttaacaacattgttggcttttaccatgtacatgacaac

SEQ ID NO: 10622 - DNA, 201 bp, Homo sapiens
ggctttgtggggtgaagtaaagggaatgaacgtgggtcctcagcccacccttaggagctggccaccctgtgctacattgctggtcacacactgcaggatgyctgttggagaaattcctaggttcacactggcatgtggtaatagatgttctttgcttgcaacaaatcaatagcaagcagctgtggatagtgcagatagtgg

SEQ ID NO: 10623 - DNA, 201 bp, Homo sapiens
tagaaacatgaacagtgtatagcgaggagtcataaggtggagtaatggcagctgtccccagggttgagactctatgaagagcagctgcttttaggatggtkttcattgaagatgagccttgaaatttttttttttttttttttttttttttttttttgagacagaatctctctctgttgcccaggctggattgcagtggtg

SEQ ID NO: 10624 - DNA, 201 bp, Homo sapiens
ttttttttttttttttttttttttttttgagacagaatctctctctgttgcccaggctggattgcagtggtgcgatctcagttcactgcaacctccgcctyttgggttcaagtgattctcttgcctcagtctcctgagtagctgggattacaggtgtgtgccacacaccacgtccagctaatttttgtatttttttagtag

SEQ ID NO: 10625 - DNA, 201 bp, Homo sapiens
gaaaatatatgctgcagtcactgttaacattctgcatgtttccttccggtcttcattttaagcattagcatggttcagatcacattctgtttgacattttygccctgctttgtttggtttaacactataggctatgcatttttcaagatataaaaaaaaattagatttcccaacttctttcaatagaatgcatgttatggt

SEQ ID NO: 10626 - DNA, 201 bp, Homo sapiens
ttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatc

SEQ ID NO: 10627 - DNA, 201 bp, Homo sapiens
ataacagtttaacatctgtactgatattagactaggatgcttaattccatgtgggcaagtcttcacagacaatcaaactgcataaaaacatagaactgggmaagggaaattgtgttcttgatgattatttgcatcatattgtggaattcagaacatttcaggtcttccttcttaacactcagatgaggccatttagaatta

SEQ ID NO: 10628 - DNA, 201 bp, Homo sapiens
tctatggaacatctgtgctgaacaaaaatctacaggttcagagggcatcttctgtactctgggcccccgctaacaataaatgtcagtgccagtcacaggtwcttctcccatagagctaaatgtttctcgggtgggcctgttaaacagtgtccttttataacattagaaagacacatgatttttttcccctaacttttgccc

SEQ ID NO: 10629 - DNA, 201 bp, Homo sapiens
gtgacggcaataatccacttagagcctattgcttcacagaagacaatttttgtattaccatgttagtcacatacaggtgcaattccaacatatttttcaayatggacataatttcctatagttatttccacatctaaaggcacaagaaagatctaaattactttactttgtcttgtaaaatagaaataataaatataattt

SEQ ID NO: 10630 - DNA, 201 bp, Homo sapiens
ttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttaca

SEQ ID NO: 10631 - DNA, 201 bp, Homo sapiens
acctccaccccttgggttaaactgattctcctgcctcagcctcccgagtagctgggattataggcgcccaccaccacacctggctaatttttgtatttttrgtagagatggggtttcaccatcttggccaggctggtcttgaactcctgacctcatgatccacccgccttggcctcccaaagtgctaggattaaagacgtg

SEQ ID NO: 10632 - DNA, 201 bp, Homo sapiens
cataatcagacaggggtatttcatatcatccatttccagtgagaactgtggtaaaattctgtcctttttcccatttttggctgctgtgattgaaacccgtyttataaacagaaaagggtagtttgagttattttaaaaaataagaatccttcagtctctgttgcccattttctcctctatgaataatttctgcagacaggt

SEQ ID NO: 10633 - DNA, 201 bp, Homo sapiens
ctgctcttttctcttaaagggcactctaaagtgccttcccagtgtgtaggaacaggactgaaagggccgtttttcttggctgctggtgactttccaaagcragtgtctttcccttctcaccttgtccatggccccttgtgccctttatttgctctttctgcctgatgtagcagccacaagctgagagggctttctgtgaag

SEQ ID NO: 10634 - DNA, 201 bp, Homo sapiens
agcagctttgtgcagtgggaaggaaatgtttatgttattatacacctgggacctctaagtccacaaggttcactttttattgtacacctgggacatccttwtctacacttctggctcaatttgtttttggtttggtttagaaggttttcttctccctaaaatctcccttaagtcttaggccctttttatgcagaaatgcct

SEQ ID NO: 10635 - DNA, 201 bp, Homo sapiens
aaaatgtttggtaaatagagaaaaaggggccaggcatggtggctcatgactgtaatcctcgcactttgggaggctgaggcgggaggatcacctgaggtcakgagttcaagaccagcctggctaacatggtgaaaccccatctctactaaaaatacaaaaattagctgtgcatggtggtaggcacctgaaatcccagctact

SEQ ID NO: 10636 - DNA, 201 bp, Homo sapiens
aacccctaaccacattgtccatattgcagggtttcctaagttcacaccaatgaaccaatctctgtttatgaaatgcgctctgcctgtgcttgcattttacmcacacacacacacacacacacacacacacacaccactctacatctttgccaattcataaccaatcacctcaattatggagggtgatagtcttttctttct

SEQ ID NO: 10637 - DNA, 201 bp, Homo sapiens
tctaatactagattgaatgtaataagtaccatcagaagtggcccaaactgtggttttttaattctgaaatgcaaggttatgtgactaattagaaaattggyttggcagtgcctaaacaccggaagcatcacacaatagaactcttataaagggtctttatttcaaacatgattatgcatttgttcaaatctatggcataca

SEQ ID NO: 10638 - DNA, 201 bp, Homo sapiens
tgtatttctgggcacctctcctgctaagcactttggttgatggagggcagcgggtggctttgaggtcatcaggatggacactcagtaacagccctttgcctttttttttttttttttaacttcttttttgcttccagggtgacattatctgggtctagggactgaaacagtttgggaaatgttgtcttctgaaaatggaag

SEQ ID NO: 10639 - DNA, 201 bp, Homo sapiens
atcaggttcctcccacaacacatggggattagggaactacaattcaaaatgagatttggatggggatgcagccaaaccattatcaggaggggtgcccagcrttgtaagaagggccttctgtgcagagggaacagccagtgcagaattcattcttcaagtggctatgttccttttatttattttatattttgcacttcctaa

SEQ ID NO: 10640 - DNA, 201 bp, Homo sapiens
agctgcttcctttcaatgtgcaactcaagaaaatgacttgccatccattcttacatacagagggtggctaccatttgccactgaaacaccatattctatarcttcaggccatcaatgggaagcatcttccttttgcttccctctctcctttctctctttttttcttctcacctgtgtgctgaaacacaagtgcctcaaatt

SEQ ID NO: 10641 - DNA, 201 bp, Homo sapiens
tcagtgttcaaaatcccaaaatattattctcatcagcaaaatattgctcctacacacaaggtacctcttctccttttttcacttgctaataataatggcargtattaatataaggtatttgttgagcaattattaaatatgtcatctctaacacaacagtccaaaaagacaggcctaagttcttctactttatagatattg

SEQ ID NO: 10642 - DNA, 201 bp, Homo sapiens
gaatggcagagtgaaatccaattagcaagatctgcaaaagaggcacatgtgccagaatcatgcgtgatcccagaaaaaaaagtatatatatatatatatatactatatatatatatatatatatatatattatatatatatatatatatatcatagcacattcttagcctacccacctcccactaccccaaaaagcaggac

SEQ ID NO: 10643 - DNA, 201 bp, Homo sapiens
tcatgcgtgatcccagaaaaaaaagtatatatatatatatatatactatatatatatatatatatatatatattatatatatatatatatatatcatagcmcattcttagcctacccacctcccactaccccaaaaagcaggacaacattttccatatattctattgaagtttttttttttttttaaacttgttggcacag

SEQ ID NO: 10644 - DNA, 201 bp, Homo sapiens
ctaatttatacaatggggatgataatattgtttatcctattccataatgttttatgaggaaaatttgaaataatatatgtaaatcgttttactgtaacatrtacgaaggatccaataaatattggctcttattattatgttgaggtatgctgaaagttagtggcagaaacaggaccagaacattgatacccaactcactac

SEQ ID NO: 10645 - DNA, 201 bp, Homo sapiens
ggatggggatgaggctatgctcagccagtctgggagatctctaggggaaaatgacataggaaaaaatagtgataaatatgcttaaaagaaggcaaggaagmaagcaaggaaggaagaaataaagaaaaagagagagaggaagaaagagagaatgaaaagaagggggttgggagggaggaaataaaagaaaaaagaatagaa

SEQ ID NO: 10646 - DNA, 201 bp, Homo sapiens
aagcaagcaaggaaggaagaaataaagaaaaagagagagaggaagaaagagagaatgaaaagaagggggttgggagggaggaaataaaagaaaaaagaatrgaaaggaagaaaggaaagagagaggaaatatggtatatcagttattctgcatgatatgtttgagttgagtttgtggtggttacttgccccagggtatcaa

SEQ ID NO: 10647 - DNA, 201 bp, Homo sapiens
caaaagaagtctccaattaatttgtagccagtgtaaccatatagcatctatttgcttagttttcaataataataatactggttctgattaaataaggcatrttgtcaaacttattatttgcaaacatattactgttgtaactggtaattgctcagatctctttcggttcctgccccgacacccaaaagtcaagagggtgga

SEQ ID NO: 10648 - DNA, 201 bp, Homo sapiens
ccacctgcctcagcctcccaaagaatagaattgcaggtgtgagccaccacgcctggcccattatagaacatttagcagcattcttagcctctacatagtaratgccagtagtagcccccccaacataattgtcacaataaaaaaatctctaaactttgccaaatgtcttttggagagggccacaattgttcccagttgaga

SEQ ID NO: 10649 - DNA, 201 bp, Homo sapiens
tggtaatcctaaggggaggtcagggaatggacttttcagttaactgctcagaggcaattgtttgttttactttatataatcgaacttttataaaacttagmatattaaatccagcaaggttaaatatttagccttttgttaactttgtaaaataaaaatagaacttaaatgattcattataaagcaattatcttagaaaat

SEQ ID NO: 10650 - DNA, 201 bp, Homo sapiens
cactataaggttcacaaggactgaaaactatttgatcttctcatttttggaagaaagtgagaatcgtaatatacttgcgaaacagattggattccatctgrtgtagccaaattaatccttctttaatgattgtttatattgtgtatccaaaatcaaactcagtatcaagagttaatcaattacaatttataatcattttgg

SEQ ID NO: 10651 - DNA, 201 bp, Homo sapiens
aacagtgtagcatagctcatattaccaaatatctgcatgttagaggcttatgtgtttatgagtaggcaggtgtcttcatggaactctggtatcttccagawgttcataggtatatctggaacgatgagtatctggccaagtaatatatggaatcaggaatatgtctctcctaaagagttatattttgatcaacctcactct

SEQ ID NO: 10652 - DNA, 201 bp, Homo sapiens
gtagcatagctcatattaccaaatatctgcatgttagaggcttatgtgtttatgagtaggcaggtgtcttcatggaactctggtatcttccagatgttcayaggtatatctggaacgatgagtatctggccaagtaatatatggaatcaggaatatgtctctcctaaagagttatattttgatcaacctcactcttactgc

SEQ ID NO: 10653 - DNA, 201 bp, Homo sapiens
tatgtctctcctaaagagttatattttgatcaacctcactcttactgcagtgggcaagcaggtacaacctagagttttccaaaccgttcagattatgaaayctgtcgttagtaatatattggaaaactcaattatagtgccctaaagagctataataagaaacacagtttggaaaatacaagtctgagttagtaaccaaga

SEQ ID NO: 10654 - DNA, 201 bp, Homo sapiens
aggtaaaatcaaagttttattcatgtacagtggttaagaatgaagatattaagataaattattttaagtgaggactgtccttttaataggcctcactctayagccttgtctcatttttcattttcacaaggttcttgatgtattcttttcattatataaaacgtgccatatttggtcttttcatgaaatgtatctgatatt

SEQ ID NO: 10655 - DNA, 201 bp, Homo sapiens
attttaagtgaggactgtccttttaataggcctcactctatagccttgtctcatttttcattttcacaaggttcttgatgtattcttttcattatataaarcgtgccatatttggtcttttcatgaaatgtatctgatattctcctttgacagccattcacgtgaaaagaaaaggtcctatttctgtccatcacctacatg

SEQ ID NO: 10656 - DNA, 201 bp, Homo sapiens
tgtccttttaataggcctcactctatagccttgtctcatttttcattttcacaaggttcttgatgtattcttttcattatataaaacgtgccatatttggycttttcatgaaatgtatctgatattctcctttgacagccattcacgtgaaaagaaaaggtcctatttctgtccatcacctacatgcacatattcatagaa

SEQ ID NO: 10657 - DNA, 201 bp, Homo sapiens
catatttggtcttttcatgaaatgtatctgatattctcctttgacagccattcacgtgaaaagaaaaggtcctatttctgtccatcacctacatgcacatrttcatagaaatcatagatttttggtaaaatatgctatatacttatacagcatcttaatctcagaaacccaaagggtttagatccataactgtaccatatt

SEQ ID NO: 10658 - DNA, 201 bp, Homo sapiens
cctctacttctatatctaagtattgctacttctagttggatgtaaaatgcatccttctcaatttatttttgtttgtgggggatggatggaactaactgttyccccactactttataaacaaatataaaatgtggatgtgtaggtattttaaatgctaacagtagaattttagtatctagttaataaccctattggttggaa

SEQ ID NO: 10659 - DNA, 201 bp, Homo sapiens
cattaggccatgtaagagaaatataattctgtaattattcagaactcagttggttgtttatatggtattcagcaagatacttcccccccacctccaacttyttataacacaatttcaaagcaccaatcgtcttcctcttttaaagtaacaccatgactgattgccttaaatttatatatgatcttgttctaatgtcctttc

SEQ ID NO: 10660 - DNA, 201 bp, Homo sapiens
atttatatatgatcttgttctaatgtcctttctaaaaataagaaaaaaatattccacaagtaaaacgagagtatgatagatacttcaccatggtgctggtrtatgtagacttgcgtgagggggaggacatggaatggtatgttctccattcatctctagttttatttcctagatgagttatgggtgaatactgtgacaaaa

SEQ ID NO: 10661 - DNA, 201 bp, Homo sapiens
ttccaaatttctgagtttacttctaataatgggtatgctctccttgctatttttatctctagataattgttgactgcttgtagttttttcttgttgggcaygaatgactggcttcatcttccaaaagtgttacaaaacaccagttatttctttgagctttagacttttcctttgcagaaaggagccttatttacatccaaa

SEQ ID NO: 10662 - DNA, 201 bp, Homo sapiens
taggaaatttacactgcttctgagggacaaggcagcttttggacccaattatgcatgcctctgaaacacatgttctgcaccacaccattttttctgttatrtttgagagataaaaagttgtccgtctgtctacctctccaggctaatgtctcaccacattcaatcaaacttctccttccccaggccaggattcatgcagtc

SEQ ID NO: 10663 - DNA, 201 bp, Homo sapiens
ggaaaagtctcttgttgtgaggcattacccagagttctttgtcttaaaaccaagagaattaaggagcatggacagaaagggtgaggttggagtgaaagttwaataagtgaagaaagaaagctttccaccacagagaggggtcccggaagagggttgccatttttacagttgaatgcaaaagaaactgatgagggctgggtg

SEQ ID NO: 10664 - DNA, 201 bp, Homo sapiens
tatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgt

SEQ ID NO: 10665 - DNA, 201 bp, Homo sapiens
tggttctctaaatattccaacgattcctatcattttctgtaggagtacctgcaaaactggaaggctaggctgatggctttttctccattaagcagtaaacrcgttaagcaagcttgagccaggttctggaggaggtcatcttgcaaggataaaaaacattgcatttattggatgaatacttaatgcacggtttgccttatc

SEQ ID NO: 10666 - DNA, 201 bp, Homo sapiens
cactcctgctataaccattctcagcattttcttccagttttttccttctagaactactgccaggtgaactacaaattattttcttgatttgcagcccatgyaccaatgagaaaatgcctatggtgtcttttgattttatggttcattgcttaggccttgtcataaaaaccatggcgtctctaaaaagaaaatataaaacaa

SEQ ID NO: 10667 - DNA, 201 bp, Homo sapiens
aattattttcttgatttgcagcccatgcaccaatgagaaaatgcctatggtgtcttttgattttatggttcattgcttaggccttgtcataaaaaccatgrcgtctctaaaaagaaaatataaaacaaaaacaacttcctcttggccagagtttatcaaacctatgcccataatggcatagaaatataggaaatgagacaa

SEQ ID NO: 10668 - DNA, 201 bp, Homo sapiens
tcttgatttgcagcccatgcaccaatgagaaaatgcctatggtgtcttttgattttatggttcattgcttaggccttgtcataaaaaccatggcgtctctwaaaagaaaatataaaacaaaaacaacttcctcttggccagagtttatcaaacctatgcccataatggcatagaaatataggaaatgagacaatcctactc

SEQ ID NO: 10669 - DNA, 201 bp, Homo sapiens
aaaatgcctatggtgtcttttgattttatggttcattgcttaggccttgtcataaaaaccatggcgtctctaaaaagaaaatataaaacaaaaacaacttyctcttggccagagtttatcaaacctatgcccataatggcatagaaatataggaaatgagacaatcctactcccccaatccccgttttctgtttatttgtt

SEQ ID NO: 10670 - DNA, 201 bp, Homo sapiens
ttatcaaacctatgcccataatggcatagaaatataggaaatgagacaatcctactcccccaatccccgttttctgtttatttgtttgattcctgccaaarcaaagtgaccttgagggggcaccggctcagtgtttgctttttctggcgttacccacacccctccttcttcatctcctactgctccccattcagctcctca

SEQ ID NO: 10671 - DNA, 201 bp, Homo sapiens
tcctactcccccaatccccgttttctgtttatttgtttgattcctgccaaagcaaagtgaccttgagggggcaccggctcagtgtttgctttttctggcgytacccacacccctccttcttcatctcctactgctccccattcagctcctcaacaatcggcaatcactctgcccttctgctccaaatttatgaccgggagc

SEQ ID NO: 10672 - DNA, 201 bp, Homo sapiens
tatgatggtccctgagaaaggacaatgagtagaagaagcaaggtgcagagaggatctaacaatttttgcatggacatgagatttggagcaaggtctagaarctcatatcagcaaggagtaagtatgcttgtggcttaaagattatggtcctcaagacttgctcctggactggaaatattcccctaattttttgcctaaatg

SEQ ID NO: 10673 - DNA, 201 bp, Homo sapiens
gaggatctaacaatttttgcatggacatgagatttggagcaaggtctagaagctcatatcagcaaggagtaagtatgcttgtggcttaaagattatggtcytcaagacttgctcctggactggaaatattcccctaattttttgcctaaatgaaatgtgctacaggcctgagtatacctaaatcagcttcatttttctgtc

SEQ ID NO: 10674 - DNA, 201 bp, Homo sapiens
tggactggaaatattcccctaattttttgcctaaatgaaatgtgctacaggcctgagtatacctaaatcagcttcatttttctgtcaaatccctccctgtwtgcttcttccagtgatatgtcatgcagatgtccacaggggacataggatcttgtagtgcaaaaaacatgagactttcatcagacaatcagtcttgactct

SEQ ID NO: 10675 - DNA, 201 bp, Homo sapiens
taataagtgttcccaatatatagattttatttcatctagttgaatttagagagtagcaagccactcccttcctgccccacccccgaaaaaaaaaaaaaacrcaccaccaccaacaacccacttttagtgtggcaccatatctaagaaggtattctccaagacttctttatgtgaagtagttcagccttggcagagttaaaa

SEQ ID NO: 10676 - DNA, 201 bp, Homo sapiens
tatatatctaaaaaaggacctgtattcacaacatatgaggatctcctgcaaatcaaaaataaacacaaacaataaaaataggcactttataaaaaagataygtgaatggtcaatagtcccatgcaaagatattccacatctttagtaatcaagaaattgtatattaaaatcacagtgatgtatcattttataccaactaaa

SEQ ID NO: 10677 - DNA, 201 bp, Homo sapiens
ttctgctatgattagattattccagaagcctcttctggaggaatctcttacatttgcccttcatctatgggattctgcactttcgcctttctgtttctgtsttgtcctgagatatctcatgtagaaatgaattgatggccctttatactgcggttggactcttcattcagattttttcaaagcacattataaactctaatt

SEQ ID NO: 10678 - DNA, 201 bp, Homo sapiens
aattaaaataatcttcttgtagtcacacatcaaatcaatgtcagtgcaaacacttgaaccaccagttaatgcagccccatttctttttatattgacaacarcacagtggttgaagctgaaatagaacctcagttcatacttatagaatatgccatgctgcacttaacacatggatctacagggagaaggaaacagaagtga

SEQ ID NO: 10679 - DNA, 201 bp, Homo sapiens
atgaaggactagagactttagttaactttcctagggtcacacaggtaggaagtgacagagctgggatttgatccagggctccctggctccaaagctcttgmttttagccatgatactataatgcattgaataatgggcgatatctacctttccttgatggtcaggaagaaaggtcaaaagaaaggttgttagagctaaaat

SEQ ID NO: 10680 - DNA, 201 bp, Homo sapiens
cctactccagcaggtttcccagtcaaaatatgcctttgggaatgcagagaactgaaggccctggctgagcaaaccccagctggagagacagactggggatyctatctgtgtatagcatgaagaatttattctaaacacttggatatagagccaatgccacttacaagctttcctttaagaatcctaggccagttgttaaca

SEQ ID NO: 10681 - DNA, 201 bp, Homo sapiens
caagaactttgtaccttatgggtactgaagaagtgaaatgtttaaagaagccgaattatatgatttcttttgacttcaaaatggaaaatacatgtcgataytgggggagaaattaggaggttcttgccataatacaggtggcatatgatggtagtcttcaggtaatggcagtaggaatgcatagaagaacacagatatgaa

SEQ ID NO: 10682 - DNA, 201 bp, Homo sapiens
cacattagccagcaaggcataaaaggcaaagagagagataagaaagatgatgttaatctagagcctaatgaaaatgtgggagttcataaggagtgatcaamtacgtaaggtgataattgtggatatgtttcgatatcagaaaacattgcttttctgtgtgatagtgctttctttataattaatgtggatttagtgtgtgtt

SEQ ID NO: 10683 - DNA, 201 bp, Homo sapiens
tgaaaatggcactataaacaaaatggtttaggaaccagtgtagagagcaggagccaaagatggaatccagagtcacagcatgagggatgagtaaggaagaygactaaactggtagattttagaatgagctatagcagtatcaccaaaaccaagagtggagagaacttcaagaggaaagacacatttggaccttttaggtaa

SEQ ID NO: 10684 - DNA, 201 bp, Homo sapiens
cccccagccttgacctcccaaagtgctgggattacaggcatgagccaccgcgcctggcctcaggccctattctaataaaacttccaggtagatgcttgttstccttctctgtgagtccaaacaaggtctctagttattgattctcatattattgcagcttctacaaatttcaccctcaagtcagctttttggcttttctga

SEQ ID NO: 10685 - DNA, 201 bp, Homo sapiens
tatgtcggtggactaacgcagcatgcctaatgccagagtgggcagaaagaataatagctgttgtttcagtttacctgtactaatttatcacaccttacccrgagactccagctccactttctgagttttctctgtctggaggtgaaacacacaagcacataaataagtaggaagctgttaggaaatcctctttgtcactac

SEQ ID NO: 10686 - DNA, 201 bp, Homo sapiens
gctcttattgcccaggctggagtccaatggcatgatcttggctcactgcaacctctgcctcccgggttcaagctcttcttttgtctcagcttcctgagtarctgggattacaggtgcataccaccatgcccggctaatttttgtatttttagtagagatgaggtttcatcatgttggtcaggctggtctcgaactcctgac

SEQ ID NO: 10687 - DNA, 201 bp, Homo sapiens
acttcttctcttcctctagctttagggactggactcagcattttggtttcatttcttttttgaaaagtaaaaagaaaatttacaaaactataaaacaagttatatatatgtatatataaaactagcatattaacaaatatatatgggtaattatataaaattatttatacatatataattacccatatatatttttcataa

SEQ ID NO: 10688 - DNA, 201 bp, Homo sapiens
cttcttctcttcctctagctttagggactggactcagcattttggtttcatttcttttttgaaaagtaaaaagaaaatttacaaaactataaaacaagttatatatatgtatatataaaactagcatattaacaaatatatatgggtaattatataaaattatttatacatatataattacccatatatatttttcataat

SEQ ID NO: 10689 - DNA, 201 bp, Homo sapiens
actagcatattaacaaatatatatgggtaattatataaaattatttatacatatataattacccatatatatttttcataattacccatatatatgtatakgtatatatatataattacccatatatatgtatgtgtgtatatatatataattacccatatatatgtgtgtgtgtgtgtgtgtgtgtgtatataattaccc

SEQ ID NO: 10690 - DNA, 201 bp, Homo sapiens
tagcatattaacaaatatatatgggtaattatataaaattatttatacatatataattacccatatatatttttcataattacccatatatatgtatatgwatatatatataattacccatatatatgtatgtgtgtatatatatataattacccatatatatgtgtgtgtgtgtgtgtgtgtgtgtatataattacccag

SEQ ID NO: 10691 - DNA, 201 bp, Homo sapiens
ccatatatatgtatatgtatatatatataattacccatatatatgtatgtgtgtatatatatataattacccatatatatgtgtgtgtgtgtgtgtgtgtrtgtatataattacccagaattaaacacctttaggtgtaattagagtacattaaaatttggcatactttcctttagttcttttctaaattataaaagtaac

SEQ ID NO: 10692 - DNA, 201 bp, Homo sapiens
cttgcttttttctttcaacactgcatttttgatgtataggtccctgatacactgggtattcttcagacggataacatttgatttagattctgaaagagggrtaagattttgccaggtcaagaaaggaaccggtcaggtagaacattagtttacgtattagcacttacttcataaaggcatggaatagactgcggaaaatca

SEQ ID NO: 10693 - DNA, 201 bp, Homo sapiens
agcctggcatccattagctcttctttctgatgctctccctctgcctccccttttgctgtgcagaagctctttagcttaattagatcccatttgtcaatttytgctttggttgcaattgcttttggcgtttttgtcatgaaatttttgcccacgcctaattcctgaatggtattgcctagattttcttctagagtttttata

SEQ ID NO: 10694 - DNA, 201 bp, Homo sapiens
ctttttgcttaggattgacttggctattcaggctcttttttggttccatataaatttaaattttttttctaattctgtgaagaatgtcaatggtagtttartgggaatagcattgaatctataaattactttgggcagtatggccattttcatgatattgattctccctagtcgtttatttttatcctctctgatttctca

SEQ ID NO: 10695 - DNA, 201 bp, Homo sapiens
gtattctttctgtagtaattgtgaatgggagttcattcatgatttggctctctgcttgccttttattggtgtataggaatgctagcaatttttgcacattsattttatattctgagactttactgaaattgcttatcagcttacgaagcctttgagctgagccgatggggttttctgggtgtaggatcaatgtcatctgca

SEQ ID NO: 10696 - DNA, 201 bp, Homo sapiens
gccagttttcagggggaatgtttccagcttttgcccttcagtatgatattgactgtgggtttgtcatatatgactcttactattttgagatatgtttcttyaatagctagtttattgagaattttaaacatgaagggatgttgaattttttgaagtacttttctgcatctattgagataatcatgtgatttttgtctttag

SEQ ID NO: 10697 - DNA, 201 bp, Homo sapiens
ggaatttaacacatgaacccattcaacacatgaacctttgggggcaggacttaatttgacccttaacatgaagtgataaaaatattttttagacttgatamttgtagctcttgtttgatggctgaagtatcaagaagattatgagaacagacatgaggctatgaatatgttgaaggattggaattttggatcactcaaatg

SEQ ID NO: 10698 - DNA, 201 bp, Homo sapiens
ttgtttgatggctgaagtatcaagaagattatgagaacagacatgaggctatgaatatgttgaaggattggaattttggatcactcaaatgtgatccaaamcctctggacacccttaccctttctagatatattttttccccttaaagaactcaaaggagaacaaagacctggaaaaatatctgtggatatctggaagtaa

SEQ ID NO: 10699 - DNA, 201 bp, Homo sapiens
aactcaaaggagaacaaagacctggaaaaatatctgtggatatctggaagtaagcactgtactagaggttatcttgtatttgtctctagtttttatgttcsattctcagaggcaggtatttcattgtacaaggtgcaataattatggagtatacattttatttaatcacataggaagtggtttattataaaagagaaagaa

SEQ ID NO: 10700 - DNA, 201 bp, Homo sapiens
aaagttagaaaagagggaaagactgagaccctcaatgttaaataacattttataatgatcacatgctgagtcaaaggcaaaagcaatttctaagtcgcctrcttaattctctagaccatgcctgctatcttatatttatatcttaataaatgtacatatgctgccttgctgttttggggacaatgggaagtataaatttga

SEQ ID NO: 10701 - DNA, 201 bp, Homo sapiens
atgcctgctatcttatatttatatcttaataaatgtacatatgctgccttgctgttttggggacaatgggaagtataaatttgatctttcttgaattctcyacatttaaagtctccacttgtcacttgaattaacatagtattttagcatttaatttcctggggataccagatgttttattttgtgagtttgttttattta

SEQ ID NO: 10702 - DNA, 201 bp, Homo sapiens
ccacctttgctcaaattggctcagtgatatgattttaatactaagcccacacccagttggtatgaagacattaagtaattaattaattcaataactatttrctgatctgaacaaagtggacaaaaaaccctgtctctgtggaattttcttccaggcatgaggggcttgggaatgggtaacaagtaagtaaattatgtaact

SEQ ID NO: 10703 - DNA, 201 bp, Homo sapiens
tacattaggtatttctcctaatgctatccctctgctagccccccactacccaacaggccccagcgtgtgaggttcccctccctgtgtccatgtgttctcaytgagaaacacattttttaaatacataaataaatatcacccttttgtcatgtatcttcataagcaattgacccaaccaatggatttgcagtcagtgaaaac

SEQ ID NO: 10704 - DNA, 201 bp, Homo sapiens
gactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaa

SEQ ID NO: 10705 - DNA, 201 bp, Homo sapiens
gtttagaatgcacaaaatctagacatggcattgaggcatctagatattgcctttacctatttcctgtaggaacttgctccagattagtatcttaaagacamattggcatttatttttcttacacacattgcattgtgccatgtaagaaaattacagattaaatcagcattttcctcctgcttgatgtgaataaaatcaatg

SEQ ID NO: 10706 - DNA, 201 bp, Homo sapiens
cttctcttcattgcagctggcatatcttgttgtgtttatgagtctgacaggcaaacatatctgaagcatatctcatatgctgatctgtgagggagataagycccttgttttgcttgactggaaacaaaataagcaggtggcagaaaaccctgcattgatttctgcttgggctaaaacacccagaataagatcaagtccccc

SEQ ID NO: 10707 - DNA, 201 bp, Homo sapiens
gcctctgctatttgatcattgatcatttgacttaagtttgcaaattgttgtagggaagtgtaagtttctttctgctttaacaaagctacttttacttattwtaattttataagctattagcactattttgtgatagaaaaaactaaaaatcaaatggtgtcagagcttaaaaatctcttacttcatttgccgtgtaatctt

SEQ ID NO: 10708 - DNA, 201 bp, Homo sapiens
gtatttatattggttgaaatggcaagataatgagtctaaaagattttcccttctgatgttattttttttgttgttcagaatgacacttgaaagatgcctargatttctactgctgctcttagaatcacaggatctcagggtaaaatcaaactttagaggtcattaatttcaaccagccataaaggtctttttgtcaaactt

SEQ ID NO: 10709 - DNA, 201 bp, Homo sapiens
gagaaaccgtatctctactaaaatacaaaaaagcagccaggtgtggtggcatgcacttgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaa

SEQ ID NO: 10710 - DNA, 201 bp, Homo sapiens
aggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctc

SEQ ID NO: 10711 - DNA, 201 bp, Homo sapiens
atttgaatttaatgttcaagagaggggaaggcataaatatataaacatatatgtttcatacatatgtgtatacatatatatgtttcatacatatatatatmcatatatacacatacttatatatacatacataaatatatttatatatccacttaaaacatatacaaaactacctatacatatatacatctatatatcaca

SEQ ID NO: 10712 - DNA, 201 bp, Homo sapiens
tttttccaccattgctggcatgtgtgcaagtgggggacccagggaatagagactacaatgtaaaaaatggtttcgctgttatcgttgtcatgttttcctaygtaaaaaataggataatgtgacttttgctgttgatagatgtttcttcaagatcccagtagagtattttgtgactggaaaatttctagaatcttgaaggca

SEQ ID NO: 10713 - DNA, 201 bp, Homo sapiens
ccttttgcaagtggttctcctgtctagcctgctacctctggactctctcccctgtatgcaaggccccagtaaaaccccaggtctcatttgctggctctggktctctccttcagcctcttgaacatgctgccatccccggtggagtcaataggaagtcggcacaacagacaaggaagagctgtcaccttgcctgataaaata

SEQ ID NO: 10714 - DNA, 201 bp, Homo sapiens
tatgtcatgttgaaaatgtgccttcctggttaaaaggatggatatttggaaacaaggcagtttgaatcacagcacaactatttaattttaaaagacacttytttctaacctatataattcttaattgttctggacatgtaggctatttcagtgaaatttagaaagcaaggccatttcctacagctaagccctttaatgata

SEQ ID NO: 10715 - DNA, 201 bp, Homo sapiens
ggttctagattagctatgataatactcatccccttatgcagaaaagctgcttttagacttctcattgcttcccagttaatataacatagggattattaaastctctgagtatgcatttctagatgtgtatagcattagatgaaaattccttaggcctttggaaattcttcctttcccttttagagaagaagatattatcct

SEQ ID NO: 10716 - DNA, 201 bp, Homo sapiens
ggaatgtcaagataagaaatttgcattgatctaacaggtaataagaagctccataccatattctttttacctgtatgtaaaaatcaagaggagttaatacragtagtattttattaccaaaatagaagttgcatctggctcagactcagcctctgattcctcaggaggtttttcccacccctttccctattcctgctttcc

SEQ ID NO: 10717 - DNA, 201 bp, Homo sapiens
gaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctact

SEQ ID NO: 10718 - DNA, 201 bp, Homo sapiens
ctgtatgtgtgcatttttaaagcaaccctttgtaagaatgagtggatttagcaaagtagatgcgattgaatcacaatggaatacatgcctcttactcggtytaaagtcccttggttctgcaaagttttttattctcttttcaaaccttatgcaattgtgacttcatctaaattattgatacagttctaagggattagtatc

SEQ ID NO: 10719 - DNA, 201 bp, Homo sapiens
tcgatgattaaaaaaatgagcctttttaaacaagaaattcctgctcatacatttggcttctgagagagagaaagagagagagagagagagagagagagagwgtgtgtgtgtgtgtgtgtgtgtgtgtgtgtgtgtgtgaaatggggaaaaatatcaatgcatcaaaatggacaggtcattttgttgaatgtaactgaactc

SEQ ID NO: 10720 - DNA, 201 bp, Homo sapiens
ttttgattttttaattttattctattcttttttttttttgtagagccagaatctccctctgtcacccaggctggagtgcagtggcaccatctcggctcackgcaacctctgcctcccgggttcaagcagttctcctgcctcagcctcctgagtagctgggattacaggcacatgctgccacaacctgctaatttcttttgt

SEQ ID NO: 10721 - DNA, 201 bp, Homo sapiens
gaatctccctctgtcacccaggctggagtgcagtggcaccatctcggctcactgcaacctctgcctcccgggttcaagcagttctcctgcctcagcctccygagtagctgggattacaggcacatgctgccacaacctgctaatttcttttgtattttagtagaggcggggtttcactgtgttgcccaggctggtctctaa

SEQ ID NO: 10722 - DNA, 201 bp, Homo sapiens
ctcttttttttaatgagcaatcataagttattatcaactagcatgcaggtaataattttcttatcttgttacttgtgttccaccactaataactatgagaytgcaggcagtttttaacttctctgagccatggctccttccctgtagaattatgcagtacttcttgtgaaaattgagataatgtgtaaaaataaaaaaaaa

SEQ ID NO: 10723 - DNA, 201 bp, Homo sapiens
ccactgacaaatctagttctgagagtgtgcttcagagaaatttagatttttgagataattttgatatatagtaatgagaatctcagccttatggcagcctktatgctttcagccaaggtggaatcctggccaaaatgattttttttttttttttactttctgccatggtgcctggaatttcttcaatatagactcatttct

SEQ ID NO: 10724 - DNA, 201 bp, Homo sapiens
taacttggcttgagagtgtctgatacttacactcacaaacaaaactatagagttttagaactcagagcagtgcttcccattgagatttctggatgccacartggtgcctgcaagaggaaactcatcggagtgctttcatcagcaaggaactggaattcctgaccagtgataagacaagatgactgtggcagcttcagatat

SEQ ID NO: 10725 - DNA, 201 bp, Homo sapiens
actcagagcagtgcttcccattgagatttctggatgccacaatggtgcctgcaagaggaaactcatcggagtgctttcatcagcaaggaactggaattccygaccagtgataagacaagatgactgtggcagcttcagatatatttacaatttgacattcaaaggccaaaggggaaaaaagatttttcccctgtatctcac

SEQ ID NO: 10726 - DNA, 201 bp, Homo sapiens
ccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaat

SEQ ID NO: 10727 - DNA, 201 bp, Homo sapiens
aagacacctacacatgttcacatctagggtagtattttcaaaaaatggagttactttgaatccccgatcgtctctttcttttactcaatttcaagttaatrtctaatgtaaaacttttataaatagcaaagagacttatacttctctagctttgcaatatttagtcttgctttttcttgttggcacggtgtgccctttacc

SEQ ID NO: 10728 - DNA, 201 bp, Homo sapiens
aaatgagttgttaataaatatcagctttacatcaagagtttaacagaaacatattcctgaacaaatttccattgccttctaaaagggttatttcttggtcygcagagctgctaatctgtaggttgcattcagtctaggctatcagaataggtcaccccatgggacttgatgatagtattgtcacttagatggcaaacaagg

SEQ ID NO: 10729 - DNA, 201 bp, Homo sapiens
atattcctgaacaaatttccattgccttctaaaagggttatttcttggtctgcagagctgctaatctgtaggttgcattcagtctaggctatcagaatagktcaccccatgggacttgatgatagtattgtcacttagatggcaaacaaggcatgaaataccttttcatagaactaaacaccctcaaatggggacatgaaa

SEQ ID NO: 10730 - DNA, 201 bp, Homo sapiens
atcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagatttt

SEQ ID NO: 10731 - DNA, 201 bp, Homo sapiens
tttccccatgtttccttccacccccaaattcttaccccatttcaggcagagctgagcaaacataagccttctctgaagtattgagggaaagtctgctaaayggctaaactacttaaggagctaacagaaaaggttgtatcagagaaacagtggagaaacacaggtttctaattatatctggcactggagagaatgtcaaag

SEQ ID NO: 10732 - DNA, 201 bp, Homo sapiens
gtgaaagtaagagatttaaaataggttctcaactcctgataaaaacacgaatatttatttatttagtctagcttttctttcttctcttatcgttatgattrttattactactactacttttctgacttttcttttcctaacctactagtgtttaaacctcccgaagacagaggtcagttctgctttgatcaccactatata

SEQ ID NO: 10733 - DNA, 201 bp, Homo sapiens
gacaatgtaaggtagccctgtattttcaagggtgatttttagaaaatcctaatcatttttcctgaagtactttgtgtgaatactcatgaaattatagacaraccaattctcttttgcttagaatgaaaatcatctgttatgccttcatcatcagtgaatgttttgggaacttcaagactatatccatcatccagagttttg

SEQ ID NO: 10734 - DNA, 201 bp, Homo sapiens
gccattctcctgcctcagcctcccaaatagctgggactacaggcacctgccaccacacctggctaattttttgttcttttagtagagatggggtttcaccrtgttagccaggatggtcttgatctcctgacctcgtggtctgcccgcctcggcctcccaaagtgctgggagtacaggcgtgagccactgtgcctagccaga

SEQ ID NO: 10735 - DNA, 201 bp, Homo sapiens
ttcaaaaccagaagccaaaagaagttatagtttattttaagcaatatccacaaaacctaatatagtccacttctgagtaatcatttaattatggtattctrtcattttatttttaaaaaatatgctgagtacataaacatgactaaaatatcaacacattctttcttcctacacataactattaatcttaaatgttccaag

SEQ ID NO: 10736 - DNA, 201 bp, Homo sapiens
gcagtcatgagtattgtagcatgtaggagtggactgctgagagaagggaagaaggatgcattttgcattcacttgtacatcagccttgaagcctggctggyggcaatattgtggacaatagatctttcaaacaaatagacccttgtctgttccttccttctgtaattgttggcagagttctttgttatgtgtctggtttct

SEQ ID NO: 10737 - DNA, 201 bp, Homo sapiens
aaatttaaacaatgtgaaatgcagtaccttgaaaaaagccaggctagtctctggactctgtagtttactttctaaataaaaaatatcctattgaccataarcaaatgaacaattcacctgttagcatatggaccaaatataggccaagatatgtagtggtagagttacaagtaaattttttgatgtgaagtgtcatagaat

SEQ ID NO: 10738 - DNA, 201 bp, Homo sapiens
accccctcttgactttttgtgtctttagtctcttaatcggcctcgacttcttttccttgacctttaaattgtctcctttatcctaaagcaaatcaaaattrctcctgataatgcaaaggtataaaattactatgatgtcttcacatcactactaacttttttgaaaagtagtcttcattctctacctctacttcctcactg

SEQ ID NO: 10739 - DNA, 201 bp, Homo sapiens
tatctttgacttccatgcaacttttgatactcttaatcaatggttctgaaactttttttgtgcatcaggatcactggtgagttattaatagttaaaatacrgatttctgaattcaacacccagagttcctaattccgtcgggctaggatgtagactgaggatttgcatttctaacgagttcccagatactgtccacgctgc

SEQ ID NO: 10740 - DNA, 201 bp, Homo sapiens
aatggttctgaaactttttttgtgcatcaggatcactggtgagttattaatagttaaaatacagatttctgaattcaacacccagagttcctaattccgtygggctaggatgtagactgaggatttgcatttctaacgagttcccagatactgtccacgctgctagtctgggggatcacaaatcaagagccatgccttgat

SEQ ID NO: 10741 - DNA, 201 bp, Homo sapiens
tcgcttgaacctgggagacggaggctgcggtcagccgagattgcgccattgcactccagcctgggcaagaagaacgaaactctgtctcaaaaaaaaaaaaraaagaaaaaaagcccaaactaaacatatccttccagtaagagaatcctttattgccagtaatggtaattatttgataaggtgtgtctctacccccttttg

SEQ ID NO: 10742 - DNA, 201 bp, Homo sapiens
atctgcagacctctaactctctcctgcatgccctttctctttcatagcttccatctctaagctgtaatggatgcaaaattactgcagcattttgttctgcygggctgaccccattacgcatacaccacagtcataaagctctggcttagttactgtttgcatgttcaagactactctgaggcagggaggtgtgaagtttgg

SEQ ID NO: 10743 - DNA, 201 bp, Homo sapiens
ttttcacaaacttagcttgttttaatcaacagtaaaaatgaagagtgatgttgttgttagcaatcttatttagtgttcaaattattatcaaatggccagcragatctcttttaaatgggctccttattctttcagcactttatttgatatttgtggccacatacttgtattttgcaataaaaaaaaatttagattctttgc

SEQ ID NO: 10744 - DNA, 201 bp, Homo sapiens
tctactctcccagcacaatcggtggtcattttgagtgaccacatcatttatctccaaaccaggacaccttggagaacacaagaggatactgttaaataaaygtgagtgtataataaacacacagtgggacttccccaggcaaacagggactcttaggggatgtatgatcaccttaacatgttttctgtctggagggaaatt

SEQ ID NO: 10745 - DNA, 201 bp, Homo sapiens
acacttcaccactggattgttgcaatgcagtcttaaatagccctcgaatatggactcaaccacatcttgcaacaagattgtcatcagcacccctttcactmtgcttggcctctatatactttactcttagccttctcctgaattagtcttagcccagtaacatcttgtgctgatgtcagtcttctggttgaccaagtaaac

SEQ ID NO: 10746 - DNA, 201 bp, Homo sapiens
gccttctcctgaattagtcttagcccagtaacatcttgtgctgatgtcagtcttctggttgaccaagtaaacgtattttttcatttcctctttttttgctygtctttttcatctctcgctgatgattgtcaactgcaatgacaccgtacttttatacactgcatgatgtatacttactcagaatttttcttattgccaaat

SEQ ID NO: 10747 - DNA, 201 bp, Homo sapiens
gctttgtttacctaagcaagcctgggcaatggcgagtgcccctcccccagccttgctgccaccttgcagtttgatctcagactgctgtgctagcaatcagrgagactccgtgggcgtaggaccctctgagccaggtgtgggatataatctcctggtgtgccgttttttaagcctgtcggaaaaacacagtattcgggtggg

SEQ ID NO: 10748 - DNA, 201 bp, Homo sapiens
atagcacatttacaattttaaattttgatcacattttgaagtaatattttgaatatattgggttaagttaaatatattattaaagttaattatacctattwctccttttttggggtggctgctagaaaatttaaaattatatatttgctttgcattatattcctcttggactgtgttggcctagatcgtttattagcttag

SEQ ID NO: 10749 - DNA, 201 bp, Homo sapiens
ccaggaggtggagcttgcagtgagcagagatcgtgctgctgcactccagcttgggcgacagagcaagattccatctcaaaaaaaagaaaaaaaaaaaaaargaaagaaaaaagaaactgaacaaatacgttatttactgaaggagtaaatatgtgtgacaaccagtggtgtcctcattccgtatctccatcttcagagaat

SEQ ID NO: 10750 - DNA, 201 bp, Homo sapiens
aaggagtaaatatgtgtgacaaccagtggtgtcctcattccgtatctccatcttcagagaatgcttgtgtgccttcaaatttatgacattttcctctcacsccttagtggtgaagaaactgaaatattgaccccatccccaaaaattaataagttaagtgtaagtggtacctgtggtccatttgaaagggaatatctgaat

SEQ ID NO: 10751 - DNA, 201 bp, Homo sapiens
ttaaagacatagtgtcatttggactttttatgatgcagtactatcttgtcacagaagacttcaggatttctcttggttagcaagtcaacagagacctgtgyatctaggcctgcatatatgcatgcatattgttacttgatgtattcggttataagaaaaggaagtcagtcctagttaataacaccatccatatgagattta

SEQ ID NO: 10752 - DNA, 201 bp, Homo sapiens
tggcatatatacatatatatgagatatatatgtatataatgtatatgtatatataaaactggcaacagaaacacaggaaatgatatgaaaaaattattttkttcatttggaacgctgtatttgttgtcatttttgaagacaataaaattgtcattcgaaccaaacccatttgtttcattatctattaatttctatctcttc

SEQ ID NO: 10753 - DNA, 201 bp, Homo sapiens
gttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaa

SEQ ID NO: 10754 - DNA, 201 bp, Homo sapiens
ttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaa

SEQ ID NO: 10755 - DNA, 201 bp, Homo sapiens
tggttcacccccattatacctcctgagtataagtggataatgatttttttaaatcataagagcgccatgttgcaattgttattatcaccccacctcactgkgtgtgtgtgtgtgtgtgtgtgtgtgtgtgtgtgtgaagttaaatgatctttaatagtggtttgttaccaaaaaatccatgtaagctcaagtcacctaaat

SEQ ID NO: 10756 - DNA, 201 bp, Homo sapiens
tttacttttggcccttttcctcttttaggccatttccttcctttccctctaccttggacagctagtttcaataaacaaaaccttgtccttattactaccayttttagaatgccttaacttgcccttaatgcctagcctttcaacaggtggattcttgtgtgtcctgaataaacatacaaacacatagaaacacacatacac

SEQ ID NO: 10757 - DNA, 201 bp, Homo sapiens
gggtgagtggcaagagtggctgttggcaacctgtgaagtggcatgcatgccaggttaagaagttggagataatttggtagcatttgagctgcaatagatcrtgtcagagagaactatgccatgaccagatgtatgacttagataaccctgacagccatggggtggacaaatggctagggttgagactgcagccaaactctt

SEQ ID NO: 10758 - DNA, 201 bp, Homo sapiens
catataaaagcagttacggcagccctctgcactgtattttcatagggttctgtttttatcttacttaactgtaaggtccttgagggcaaaaacagtcaagyctttctcattcatcctttgcaaacccagcaccctgattcccaacagagtagaactcagcacatatttgatgaattagattgaatttaaatctatatatag

SEQ ID NO: 10759 - DNA, 201 bp, Homo sapiens
tcttaaatcaagcttgaagggaaattgattgaaaagaaaacaccattatgggaaaacaattcattttcttccccatgacagaaggtagacttttgtctatrctgcagaataaatatgatctggctgattgctttaagatctggaagctcagaggagtcataatggctttgctcactctttagagggaaattaccttccatt

SEQ ID NO: 10760 - DNA, 201 bp, Homo sapiens
taccttccattttggagacatttgatacaaaggttttggttagctttcaaaaagtaatattttttctccctgtgtgattatttatattagctagatatagrtgcatgaaaacttgcaaatatttctgtgtgcagttgtgtgtttctactgaagtaccctccagacagggagtaagcagattttttttaaaacttttctata

SEQ ID NO: 10761 - DNA, 201 bp, Homo sapiens
cttgcaaaaaactcggatgcatgtctcctgagattggaatggacaaggaacaaatgtacttgtttgtagtacttctagaatgtctccctaaatcatcttaraagcagaaatcttacccaaaatatgatgcttgccaatatattgtttaccacccatcatgctctgaaccatcatgcctcttgtctgggtagccttgctcta

SEQ ID NO: 10762 - DNA, 201 bp, Homo sapiens
tggatgctggaagtgggcgatcttgggaaagcctcattgcctcagtgccctatttaatttcgcccatttaagataggagagaataagcttctatacttgasgaacctagtttcttgtgaagagtgattgttaggaatcttttctcttttagcacttagttaacgaatacctttcaaaccaaatcaagaggcaagaccccct

SEQ ID NO: 10763 - DNA, 201 bp, Homo sapiens
tttcaaaccaaatcaagaggcaagaccccctccaactttgtccagaagccttcacaagcagaggcatattttgttttgtatcaaatgcttctcattgtccrtattcaggaggcaggcaacagtggggtcctttttgaagtgaccagggatggatgcaggcagcaaggcatcgttgctttccagatgccacctttactataa

SEQ ID NO: 10764 - DNA, 201 bp, Homo sapiens
taggcctcagttctttccctagattgagattaaaatagctttccttgcaatcatccagatgccaatttaataaacattctctggccccttccacatataamccctggactgccttactaatttcttagcattcttctccttttctccacaaatcctccctttaaagagtgtttttttcccatgcctttcttattctttttt

SEQ ID NO: 10765 - DNA, 201 bp, Homo sapiens
ctactgagaagatcagacctcccagtaggagatccaccacataagctaaaaataagagctgctacttctctgcagataccattaacccaattagataaataaaaaaaaaaaagaaaaagaaattacagcttcattaagtaacaccagaataaactccaagaaggcaaaccaaatcagttatacaatttaaaactttactca

SEQ ID NO: 10766 - DNA, 201 bp, Homo sapiens
ttacagcttcattaagtaacaccagaataaactccaagaaggcaaaccaaatcagttatacaatttaaaactttactcaaaaatcaaaatgatttgaaacsaatggtcacttaaatgaaggcagaagctgcatggcagccattattggagccagcaattcagcagaagtccaaaggtccagtgcagcagtacatgtgacag

SEQ ID NO: 10767 - DNA, 201 bp, Homo sapiens
gagaccctgaaatgacacctgtgggcttgcattttattcttggtcactgctaaaccatttttcacttccctctgtttcagtaacctaaaaatctagggttsacaaaacaatgagattaaggaagccaactgataactattgtaataggataggaaatgtttcctgatttgggaaggatgggcaaggaggtggagaatgagc

SEQ ID NO: 10768 - DNA, 201 bp, Homo sapiens
agagaagaaggtgaaagaacaaaatgactgtgaagctaagaaatccagatttggaaggagtagcatcctcacagatgctcacagaagtccatatgacactscttgcattgcctggggctttatggaagaagcagggtcacgcaggattagtcattgcccaaagagcgaagagcatggaactcgccaatagcctgcaaactc

SEQ ID NO: 10769 - DNA, 201 bp, Homo sapiens
gaaaatgaaattttacaatttggattgctgttcaggaagcaaggttaaacaaataaacaaaaataaacaatgacaaaagccttttaatgaccattctggattttttttttcattttaaaaatgaatgctcaatgtttcttcctcctagtgtattgctttacttccttaacagaatcctattttattaagaagactgtgaag

SEQ ID NO: 10770 - DNA, 201 bp, Homo sapiens
agccagagaaaaatgaaaaattccagaagtctacagaatccaagtaaagaagactttgtttggaattggcagcaatgacttccactagtagcttaccatgytagtgtaattaatctcactcccatttctacttctttttatggcagaatttcttaacctcagcactgctgacatagtgggtcatatacttcttcattgtga

SEQ ID NO: 10771 - DNA, 201 bp, Homo sapiens
gtgatacttttctgcttattttggtgttaattggtatctgccattgttgctggtggtcatgttattgttgttgctttgtcctttagtaaaggttccttctytgcttagagacaggacatgcttagaaccctttgggtcttaataaaacctcttttaatattcaaggtatagcagtgagatataaaaatgattgcatattga

SEQ ID NO: 10772 - DNA, 201 bp, Homo sapiens
gcattgaatcaacatctctatcagcttgtcttcctggagaaggatattttttggaggttctggtcaagctcagtggttactgaagctgtcgggagtcttaycaccttggggtcactgtggaaaccagaaaataaatggacaaagctgggattgctttttggctagtataatatttccagaatccctgaggcttgcttttaa

SEQ ID NO: 10773 - DNA, 201 bp, Homo sapiens
tacctgttagactggtgagagaactctaggtactttgttgggaaggatgatggagaagagagaagtgaaaatatgaaggattacttataacaaaagacttkagaaatattttaggcttgagaagcattttataagggaaagatatttgtgatggggactagtaagtaccacttttcacctattgccatttgaaaattgact

SEQ ID NO: 10774 - DNA, 201 bp, Homo sapiens
aaggtcctgaaaatataaccatactaatgcattctttttgacattattacctgaagaaaactgggtgccctttaaagaggttttaagattaggaaacaaarttaggaggagcaaaatcagggctgcaagatggttgcctaattatttcccatcaaaactctcacaaaattgctcgtgtttgatgagaagaatgagcaggag

SEQ ID NO: 10775 - DNA, 201 bp, Homo sapiens
gaacatcccccaaaactgttgccatgacctttgttcttgactaatctgcttttgctttgatttgaccacttctacctcttggtagccattgctttgattgygctttgtttttagaatcatagtgatgaagccatgtttcatctcctgttacaatttttcaaagacatgcttcaggatgttgatctcacttgtttaaaattt

SEQ ID NO: 10776 - DNA, 201 bp, Homo sapiens
ttgtttcaattttagcagaatttgtattgctctgataggagcacttttaaaacaaatgccttttctcttactccctcaaactagatcatgttcagacatgytataacaagttagtacaagtttattttgctacaaagccaaatagaaatttatgcatttttttcttatatgcgttttccacgaacttttggaagacccctc

SEQ ID NO: 10777 - DNA, 201 bp, Homo sapiens
tcttgggaagaggtcatgacaacgcttcaaccagagataattaattatttgctatattctgtaactagcctgtttatacaaatagctggtgtgctcagtayaacatagcagtgaatctatggaaaaggaatctgtaaataataatgcaagggaacttctcttacgtctattgctaaggggattatcatagcattcaatttt

SEQ ID NO: 10778 - DNA, 201 bp, Homo sapiens
gggattatcatagcattcaattttaagccatgtaacctggaatgcttactaaatgtgtaattcttgttcttcctcttcatataatgcacagacttgaattsctatattgagagaataacttacctcttttaaataataccataatttgccttgaaggtagggaagaaagagagtgaagtggggaaaatttcaaaattctgt

SEQ ID NO: 10779 - DNA, 201 bp, Homo sapiens
gcttatctcaagacagtaactttcaaaggggggtttgaatagtctttccaactgtagctacattacctgaggcaattagtttacttattttttgtttttgttttttttttgtggttagcttttctttttttttaatttattattattatactttaagttttagggtacatgtgcacaatgtgcaggttagttacatatgta

SEQ ID NO: 10780 - DNA, 201 bp, Homo sapiens
attaaaaagtcaggaaacaacaggtgctggagaagatgtggagaaatagtttacttattttttaaggcaagcaaggtgggcctgattgttacatgaattaycaaatctaatgacaaagccaggtgccctggtactgaggctgtgtctcctctactccccatttcctcccctttccatcactattttctccaccctgcctat

SEQ ID NO: 10781 - DNA, 201 bp, Homo sapiens
ctcctctttttccttctactctcttctatcctcccattcttttatttctcctctcttacatcccttccactccctttccttctcttcctttttttcttctstctgtctctctgcatgtgtctgaattaactcttgagtcagcatttaaatttggtaattgaatgttatgggtctttatgggcttcactttgggagaactgc

SEQ ID NO: 10782 - DNA, 201 bp, Homo sapiens
ggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaac

SEQ ID NO: 10783 - DNA, 201 bp, Homo sapiens
gtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacc

SEQ ID NO: 10784 - DNA, 201 bp, Homo sapiens
tacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacct

SEQ ID NO: 10785 - DNA, 201 bp, Homo sapiens
agtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttct

SEQ ID NO: 10786 - DNA, 201 bp, Homo sapiens
cattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccgtaacttatctatctgagctgaaacagaatcaatga

SEQ ID NO: 10787 - DNA, 201 bp, Homo sapiens
ctcctgtttcttccctccactctacctaggctggtttcctccctgttgactgtcctatcatgcgtgttcatctttgtattcttcttgaagcctgtgatgaytttcactacattctctaccttcgcaaatgcagcatttccttcaaaagtcagttccaagtctttcctggacacaaaaatcaccacttatgtttctgtatgt

SEQ ID NO: 10788 - DNA, 201 bp, Homo sapiens
ggtgcctgttttactccaatgacaaaaaaaatccaatctaatattttttcaccttttctttctctgcctcagagttgataatacttacctttgtcactttygtctcacctaggtccaggcatgagcatagccctgcttcatttcaacttagcctatctttatggccttcaggtctcctctcatctggaattgagttctgta

SEQ ID NO: 10789 - DNA, 201 bp, Homo sapiens
gaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaagg

SEQ ID NO: 10790 - DNA, 201 bp, Homo sapiens
aattgctataaagaaacaataacttgctagggaaaaaaaaaaacaattaactgtgaagcatgtatccctgaatctgaatcatggccataatacttattagwcccccaaatttgagcttccattgccttacttgtagaatggagaaaaaaaattcctcttgaggtgtcagtaaaagaagatgaatgtatccctcatgtttat

SEQ ID NO: 10791 - DNA, 201 bp, Homo sapiens
caggaggtaaaggctacagtgggccgtgttcatgcccctgcactccagcctaggtgacagagcaagaccttgtctcaaaaaaaaaaaaaaaaaaaaaattmcaataaaagatatcattgccaaattcaatatgtaaattatatatttggaaatgtaataaaatgtgtccatgagaattacaagtagttataaccaaaaacc

SEQ ID NO: 10792 - DNA, 201 bp, Homo sapiens
ataagaagttggaaggtaggcaatccagacctcatacaatgactccatgtggtaatcacaaactgagctcattctacctgtctccttagctgtcctgactrtataggctttcatcctcatatttgtcacttcatgttcactgaatggcttctccaccttaaggcaggaaataaaagaaaacaggaaggtgaaagcaaaaaa

SEQ ID NO: 10793 - DNA, 201 bp, Homo sapiens
agatgttttgtattcatatgattggcatgaatttaaaagtgtggtaactcctattgccgtttgagatgtagaaaaattttaaattgttacagctttttttwaaaaaagattaacttttgaatggcagtttctattgaaagttttatatatatatatatatatatatatacacacacatatatatgctttgatcagaaatcc

SEQ ID NO: 10794 - DNA, 201 bp, Homo sapiens
taactcctattgccgtttgagatgtagaaaaattttaaattgttacagcttttttttaaaaaagattaacttttgaatggcagtttctattgaaagttttwtatatatatatatatatatatatacacacacatatatatgctttgatcagaaatcctaattatgagactctcatagaaataaaaataccagtatctagct

SEQ ID NO: 10795 - DNA, 201 bp, Homo sapiens
actcctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctat

SEQ ID NO: 10796 - DNA, 201 bp, Homo sapiens
tcctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctatac

SEQ ID NO: 10797 - DNA, 201 bp, Homo sapiens
ctattgccgtttgagatgtagaaaaattttaaattgttacagcttttttttaaaaaagattaacttttgaatggcagtttctattgaaagttttatatatatatatatatatatatatacacacacatatatatgctttgatcagaaatcctaattatgagactctcatagaaataaaaataccagtatctagctatacat

SEQ ID NO: 10798 - DNA, 201 bp, Homo sapiens
ttatatatatatatatatatatatatacacacacatatatatgctttgatcagaaatcctaattatgagactctcatagaaataaaaataccagtatctarctatacatacccaatattgcatcatattttgcggtggtttaaaaaaaaaaaaagaggaaagattaagtaaatgttcactaatagaaaaatggaattaagt

SEQ ID NO: 10799 - DNA, 201 bp, Homo sapiens
atttccttttttttttttttttctgaggcggagtctctctctgttgcccaggctggagtgcagtggtgccatctcggctcactgcaagctccgtctcccgsgttcacgccattctcctgcctcagcctcccgagtagctgggactacaggcgcccaccaccatatgcggctaattttttgtatttgtactagagacagggt

SEQ ID NO: 10800 - DNA, 201 bp, Homo sapiens
ctcacattttctgtggtatcgtagaacagaaattgttctaaaggaatggaaaaacaacatttactttcatcaaattgttgtctagcctcttgattgagttrtagctattgttactaatttattgctagtttttacaacatgcccatgatttttttctgtttcagactgaaagtaaatctgaatagatgaaatctaatttaa

SEQ ID NO: 10801 - DNA, 201 bp, Homo sapiens
gaggaacccagcaatttgcgtttcaacaagccctcccagatgattctgatgttatagcaattcttaacttgcttaagaatttggaaagtcttacaaataarggcaggactgggtggagaaaatggagaggtctgattatctttcatgtaatccccacataatttggtgtctgcaggagacacttttatttgtttgctataa

SEQ ID NO: 10802 - DNA, 201 bp, Homo sapiens
ggtattgattgtgcattatcagtttagctcacacactgacaattacatgtagcgccaaggtagccgtgacaatgtagtccagttgccatagcaatgaaagraggcctattgctgctacctgcaacctgctttatagtgataaacgtgctgcttatttcattttaattgaaatttgaaatcatagtctctagcaagaaataa

SEQ ID NO: 10803 - DNA, 201 bp, Homo sapiens
gtattgattgtgcattatcagtttagctcacacactgacaattacatgtagcgccaaggtagccgtgacaatgtagtccagttgccatagcaatgaaagamggcctattgctgctacctgcaacctgctttatagtgataaacgtgctgcttatttcattttaattgaaatttgaaatcatagtctctagcaagaaataaa

SEQ ID NO: 10804 - DNA, 201 bp, Homo sapiens
aattagctctcatgtttttgcattcttaattaactgctattttttatttccctaagtccctcatcttaacagcttaccctgcatggtgtactttatataayagagactttaatggatttacttgctgagtttagttcatatctaaaaactcacagcagatatcataaggtacttgaaaattagaatcacagggcgctgtgg

SEQ ID NO: 10805 - DNA, 201 bp, Homo sapiens
acctcagaaaatgtgcacagggtggggcatctcatgtgaaaagcatctcaatcattgattccagccacatgccatcataagctctttaaggagagatcctrtattttatattaccctcattaaatcttactccccaccataggtttctctctgtcctaaatatctgcttttagaaggagtaaacatgacttgggaattaga

SEQ ID NO: 10806 - DNA, 201 bp, Homo sapiens
tctttctgtttcgtccttgccttgactgttaattagctcagtggatttttatgtcatgaatgcatttgttttctaatacatcttcattttaatgtaagatrgttgaaaagaaggaccaagtcctctgagaaccccatagtacaaagtaaaatgcctcacatctgacaaatgctcagtaaacatgagtagtgggaaatcttg

SEQ ID NO: 10807 - DNA, 201 bp, Homo sapiens
ttgcctagagctctaacaacctaccctccacatagaagctgctctctgcttcaggcttcagatccttaaatatgggtggggtccttcatttagtgtcaaakaattgattagaaagctcctgcaatgtaagctcattaatgaaaccattttggcaggccagatgatataattagcccaaacaagatatgaaatctacagtgt

SEQ ID NO: 10808 - DNA, 201 bp, Homo sapiens
gatacacatggtgaaacattctaattgtaaaagattcatagagcaaacaattctgtaacatctatttccatatgatttgagcaatttcacacttgggaattttttttttttttttttagatggagtcttgcactgttgcccaggctggagtgcagtggcacaatcttggctcactgcaagctccagctcctgggttcacgc

SEQ ID NO: 10809 - DNA, 201 bp, Homo sapiens
gggttcacgccattctcctgcctcagcctcccgagtagctgggactacaggcgcccgccaccacgcccggctaattttttgtatttttagtagagacaggstttcaccatgttagccaggatggtctcgatctcctgacctcgtgatccgcccaccttggcctcccaaaatgctgggattacaggcgtgagccaccaccgt

SEQ ID NO: 10810 - DNA, 201 bp, Homo sapiens
agtagctgggactacaggcgcccgccaccacgcccggctaattttttgtatttttagtagagacagggtttcaccatgttagccaggatggtctcgatctyctgacctcgtgatccgcccaccttggcctcccaaaatgctgggattacaggcgtgagccaccaccgtacccggcccatacttgggaatttttactacagc

SEQ ID NO: 10811 - DNA, 201 bp, Homo sapiens
agtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcata

SEQ ID NO: 10812 - DNA, 201 bp, Homo sapiens
atctccattttagagatagcagttatagaagaggcatctggagctaaaacagattaaatgaccttttccctcaggttcagagtaagtgtcatattgcaccmcagaataattctgtgctcaccataatgatttacccttctaaaaggtaatataatgcaatttcagaaattaatgattcttaaaaatgtgtaagcataagaa

SEQ ID NO: 10813 - DNA, 201 bp, Homo sapiens
caggaagacccttttgagattttcagcaatggacttttcttggatgagacggaagatgctctcagctggtgtgactaaattgtttgcgacttgaggacatrggtcatgccctctgtgtgtaccactcactatatcctcatcacagttcctgcataaagcagagattcagaagggtcagtcgagaacatggatgacaaccca

SEQ ID NO: 10814 - DNA, 201 bp, Homo sapiens
taaattgtttgcgacttgaggacatgggtcatgccctctgtgtgtaccactcactatatcctcatcacagttcctgcataaagcagagattcagaagggtyagtcgagaacatggatgacaacccaacactgtaacccagcagcttgtgtcttggtgtaacattggtaggttttgtttgcctttacatttttaccataaga

SEQ ID NO: 10815 - DNA, 201 bp, Homo sapiens
ccataagaggtcaactagagtttctatcttgttacaagttcattacacaggtatcccttattccttcattcaacattgcaaagaaaacatctgtaacatgmtttgagtcattaagagacattgcatacagtcaaaaaatagcatgaatttattaaattcagtactttggctgataaattgagaggaaacctttattgcaat

SEQ ID NO: 10816 - DNA, 201 bp, Homo sapiens
tctgtaacatgctttgagtcattaagagacattgcatacagtcaaaaaatagcatgaatttattaaattcagtactttggctgataaattgagaggaaacytttattgcaatttggtggtgatagtggagagtctctttccaaatataagacctagcattaagaagtatttccaagtctcctattttaggaatctcaaatc

SEQ ID NO: 10817 - DNA, 201 bp, Homo sapiens
tttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatg

SEQ ID NO: 10818 - DNA, 201 bp, Homo sapiens
ttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgc

SEQ ID NO: 10819 - DNA, 201 bp, Homo sapiens
gagaacagtctttatagcaaggttttctttacacagagcaaccatgcacatgtagttaatggatctccagacaaaggccatttcttccctaaaacaaagcyaacaaggcaattgagccaagtaacttcaaactccccagaggggacagcagccattcttaaatccaccatacttttgaatagctatcattggtcattatct

SEQ ID NO: 10820 - DNA, 201 bp, Homo sapiens
gccatttcttccctaaaacaaagccaacaaggcaattgagccaagtaacttcaaactccccagaggggacagcagccattcttaaatccaccatacttttkaatagctatcattggtcattatcttccaaatggctttgtaagtgtctaggcataatgtgattgctttggaaattctccatttttcagggtgctgggaagg

SEQ ID NO: 10821 - DNA, 201 bp, Homo sapiens
atttcttccctaaaacaaagccaacaaggcaattgagccaagtaacttcaaactccccagaggggacagcagccattcttaaatccaccatacttttgaayagctatcattggtcattatcttccaaatggctttgtaagtgtctaggcataatgtgattgctttggaaattctccatttttcagggtgctgggaaggaca

SEQ ID NO: 10822 - DNA, 201 bp, Homo sapiens
aagtaacttcaaactccccagaggggacagcagccattcttaaatccaccatacttttgaatagctatcattggtcattatcttccaaatggctttgtaartgtctaggcataatgtgattgctttggaaattctccatttttcagggtgctgggaaggacatgaacagacacttctcaaaagaagacatttatgcagcca

SEQ ID NO: 10823 - DNA, 201 bp, Homo sapiens
gcacatatacaccatggaatactatgcagccataaaaaatgatgagttcacgtcctttgtagggacatggatgaaactggaaatcatcattctcagtaaastatcacaagaacaaaaaaccaaacaccgtgtattctcactcataggtggtaattgaacaatgagaacacatgaacacaggaaggggaacatcacactctg

SEQ ID NO: 10824 - DNA, 201 bp, Homo sapiens
ccataaaaaatgatgagttcacgtcctttgtagggacatggatgaaactggaaatcatcattctcagtaaactatcacaagaacaaaaaaccaaacaccgygtattctcactcataggtggtaattgaacaatgagaacacatgaacacaggaaggggaacatcacactctggggactgttgtggggtggggggagggggg

SEQ ID NO: 10825 - DNA, 201 bp, Homo sapiens
acgtacacatacataattgtctcattgagtttcccatctccactaagtcatggtcactgttttgccttggttatggcaactaaaagccaatggagattaayggaaagccccccaggagaaaatactcttttgcggtctttggatgaaggcctgagtatcagcaggactggagttctaaagaaactgctatgcccattgcat

SEQ ID NO: 10826 - DNA, 201 bp, Homo sapiens
ttctttagagatagttgtcaagattaaagtgcttagctcagtgcttgacatagggtaaatattcaacctatagtcaatcatcttaagtactcttgtctcaycgaggaaccatcaggaggtgtaggtaatatgcaaccttgaattagatgtaataaaatggaccccacaggaagtatttggggatattttaggcatattttc

SEQ ID NO: 10827 - DNA, 201 bp, Homo sapiens
cagtggcatgatctcagctcactgcaaactccacctcccgggttcaagagattctcctgccccagcctcctgagtagctgggagtacaggcacctgccacyacacctggctagtatttgtatttttagtagagacagggtttcaccatattggccaggctggtctcaaactcctgaccttgtaatctgcctgcctcggcct

SEQ ID NO: 10828 - DNA, 201 bp, Homo sapiens
tcctgaccttgtaatctgcctgcctcggcctcccaaagtgctgggattacaggcgtgagccaccacgcctggctatgtacaattcttaaaataagctaaartgataaacttaccctatggctttgtcatagaagggttttaaagacaaaaaaaaaattgaaaaaaattgaacttctgagaagaatggtgatattatagata

SEQ ID NO: 10829 - DNA, 201 bp, Homo sapiens
tgtaattagcgcaattttcagaggatatgtttatatcaagaatattcctgtgggagaaatagaaacttttaaggagaggtttctaggattcttagacaacyaaaactttcgtttgactcagaccctgatattacattttcccaggattcctctcacttgtgctgttttcagtgattgctcaggttatttcgaatgatggca

SEQ ID NO: 10830 - DNA, 201 bp, Homo sapiens
ttcctccctctgttcccagaaagaactaagaacggtctagctttgagctaaattgtacagctgactgtttgttttgggaacttccaaatgaacatatttgrtgttgcactggtgcatcccaggaacagaactgtctgaccagaagagcaattctgcttctggaaatttctagcacataagaagatagctggagggtatgtt

SEQ ID NO: 10831 - DNA, 201 bp, Homo sapiens
tcccagaaagaactaagaacggtctagctttgagctaaattgtacagctgactgtttgttttgggaacttccaaatgaacatatttggtgttgcactggtkcatcccaggaacagaactgtctgaccagaagagcaattctgcttctggaaatttctagcacataagaagatagctggagggtatgtttgtctgtatagtt

SEQ ID NO: 10832 - DNA, 201 bp, Homo sapiens
ctttgagctaaattgtacagctgactgtttgttttgggaacttccaaatgaacatatttggtgttgcactggtgcatcccaggaacagaactgtctgaccrgaagagcaattctgcttctggaaatttctagcacataagaagatagctggagggtatgtttgtctgtatagtttagaggctggctggtgctataaaggaa

SEQ ID NO: 10833 - DNA, 201 bp, Homo sapiens
ctgtttgttttgggaacttccaaatgaacatatttggtgttgcactggtgcatcccaggaacagaactgtctgaccagaagagcaattctgcttctggaartttctagcacataagaagatagctggagggtatgtttgtctgtatagtttagaggctggctggtgctataaaggaaagtaagaaaagggcaaagatatcc

SEQ ID NO: 10834 - DNA, 201 bp, Homo sapiens
accagaagagcaattctgcttctggaaatttctagcacataagaagatagctggagggtatgtttgtctgtatagtttagaggctggctggtgctataaasgaaagtaagaaaagggcaaagatatccttcagaggattcccccagaagaaagtagcagttatgaagttttattcctgaggtaggacaggcagtcagaccc

SEQ ID NO: 10835 - DNA, 201 bp, Homo sapiens
ctaggtagaatgaagatacaatataagctaatcgatgatatcctcctataaattcctttggcagatctatttactatggagatccctagtggagaggatgrccttaaggaattgggaaataaaatagttaacttgagataggttgaaagagaaaataattcctgagaaaggaacacaatactgcttgaaaatagtactaat

SEQ ID NO: 10836 - DNA, 201 bp, Homo sapiens
agattaaatgaggcaaaagtgactgcatcacatttcactgtctatagaggctattggcagatttatgcaggctgagttaagtgaatgacttgatagcctgkatcacatctatatgtgtttttcacaggcatcatgtcttagttagttttatgttgccataacagaatgccccagactgggtaactcaaaatgaacagaaat

SEQ ID NO: 10837 - DNA, 201 bp, Homo sapiens
acttgatagcctggatcacatctatatgtgtttttcacaggcatcatgtcttagttagttttatgttgccataacagaatgccccagactgggtaactcamaatgaacagaaatttatttggctcacagttctggaggctgggaagtcttagtgcatgaaactgacatctgacatgggcctttgtgctacatgatcccatg

SEQ ID NO: 10838 - DNA, 201 bp, Homo sapiens
ggtgcatggtagtcaggggatgaggtcaaattaggcaaatgtgacttcatagccctgctgtaaccagctggaaaataagagaatgaacagacaaaaatagwcttgtaccacattaatgacatactgattatttgaattagttaattttgctaggagtagagataataagagtgtggttctcagttgctgcttaccccgaac

SEQ ID NO: 10839 - DNA, 201 bp, Homo sapiens
ttcatgaaagacttctttgtagcatgcgatgctatttgatagcattttacccactgtaggacagctttcaaaattgtagtcaatcctctcaaaccctgccrttgctttttcaactaagtttatgtaatattctaaatcatttgttgtgatttcaacaatgttcacaacatcttcaccaggagtagattccatctgaagaaa

SEQ ID NO: 10840 - DNA, 201 bp, Homo sapiens
cacttctgattccactctgccacacatttctctgtgagtctgttaaaatatggataatccaaataacttctttctaatgtgatttatatgaaatggaagcrtgttctccttcccccttatgtgctcttgttttgaattgcaaatattcagttttgcatatatttaaaagttattttgacagtatgtaatgtagatttaaaa

SEQ ID NO: 10841 - DNA, 201 bp, Homo sapiens
caatatgtggaatagtgagggtctcagaacagacagaggacctgggccttgaaggccagctgcgtcatctggagatgaagatggaaggaaatggggatcaytgaggatgaagaagaaaaggagccctaaaggtctcttacagtcatcattttgtccgtagaaacacatctctgggaaggaatgagttaggtttttcttatt

SEQ ID NO: 10842 - DNA, 201 bp, Homo sapiens
ttgaaggccagctgcgtcatctggagatgaagatggaaggaaatggggatcactgaggatgaagaagaaaaggagccctaaaggtctcttacagtcatcaytttgtccgtagaaacacatctctgggaaggaatgagttaggtttttcttattctttcttcattaataaaaatagaaaaacaggtggtgaaacaaattgga

SEQ ID NO: 10843 - DNA, 201 bp, Homo sapiens
gtgtcctgctaacctgttctgatattcaatggcacttgttacccaggagttcttttttaaatcactatctgaaatccctattgctctcctgtgagctgtatttttttttttttttttttttttttggctttcctctgtttatcctcaggggacagaaagaacatatggcaactatctctcaagtaataatccttcaatttt

SEQ ID NO: 10844 - DNA, 201 bp, Homo sapiens
tttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgt

SEQ ID NO: 10845 - DNA, 201 bp, Homo sapiens
gttgttgatttggggaagaggtatgagccaaatggacattggacaaggaattaaaatttataattgccgcgaatagtaacttttccttagctgctgcttcrtacttgaaaatggaatgccctgtagcttgggaaccgaattttatggtggctctgcttttgtgatatttcattcaatccatttaacagttagttgtatttt

SEQ ID NO: 10846 - DNA, 201 bp, Homo sapiens
ttcagtaggtctgcaatggatctcaggaatctgagaacccccaccccgccccaagcgaacatgacacttctcttcgaaaaacactagcttcaattgtagaraaaaccaaaagtgcacatgaatggaaatctgggacatagtaagacaaaagagactgaagtaggaatagcaagcatttcaaaggaaaatgaggctgtccct

SEQ ID NO: 10847 - DNA, 201 bp, Homo sapiens
ggtactcaaccttgtagatgaagataagtgaggaagaaccagttattagagtatcaatggcattggtcatttggttataagcgtaagtgaatttccccttsaatttaccctgtgagttgctatttaatggtgttggacagttacagataagtttggtagaacttttctctttgtttccttaagggttttgcctttgggtaa

SEQ ID NO: 10848 - DNA, 201 bp, Homo sapiens
cctcagttttctcatctttaaaatggggctattaagagtacttctctgtattgtcattgtgaattatgaatcaatacataaaatgagtttagaagaatgaytggcacttcacaagtgctcaatgttaaattgtttttattgggaagaaatgaaaatacttccttgcttaatgttggagaaaagaatcactaacccatcgca

SEQ ID NO: 10849 - DNA, 201 bp, Homo sapiens
tgaactttccattaacattcaatctttcacttatatgaaaaatattttccttcctcctctttttcctcttccgtactttctccaaattcaggaggcagatratggtaattgaaagttctagggacacactgtgagctcaaggtccagaaaggttagggaaagtctttattttgaactgtaggtatgttttaattccttctg

SEQ ID NO: 10850 - DNA, 201 bp, Homo sapiens
aaaggttagggaaagtctttattttgaactgtaggtatgttttaattccttctggagactagcactcctcagggatgctgagactggcactggtgctaccrgatattaaacagaatggatttaaagtattctcctgtattaagaagattattttcaaaagaaagctctattttgtagttattgtcactttcctaaagatat

SEQ ID NO: 10851 - DNA, 201 bp, Homo sapiens
tcggtttctgatagaagctgggataaaaaaaggaggtagcaaaaaagtgtgaataggacaagtctgagactcaaatgataaaaggtagctctgcaaggacsagacaagcacatctaagtcagagaattgttaatacaaaagagtcttatggcaaaaataagattggtttatttgagaacaacaacaaaaaaggtcagagag

SEQ ID NO: 10852 - DNA, 201 bp, Homo sapiens
atctgttttggtaccagtaccatgctgttttggttactgtagccttgtagtatagtttgaagtcaggtagtgtgatgcccccagctttgttctttttgctygggattgtcttggctatacgggctcttttttggttccatatgaaatatgaagtagttttttctaattctgtgaagaaattcaatggtagcttgatgggga

SEQ ID NO: 10853 - DNA, 201 bp, Homo sapiens
cagaaccttgggactagctgaagggccgctagacctaatggcaggggtaactatttttgcaattgtgaatattcagcatgcacaggcttcctatcagctcycccaggagctctctgagagatggaccctgtgaggaaacatctttaaatgaacaccttagtagagaatgatcctgttaggtgaataaaaggctgattacat

SEQ ID NO: 10854 - DNA, 201 bp, Homo sapiens
ttcctatcagctctcccaggagctctctgagagatggaccctgtgaggaaacatctttaaatgaacaccttagtagagaatgatcctgttaggtgaataamaggctgattacatacccagaggtgagccataatgaggctcagagtaactaaatgcagcaatctgctgcactttgtatctggacttgagcctgagcatttc

SEQ ID NO: 10855 - DNA, 201 bp, Homo sapiens
gagatttcaacagctaagtgcaaaagaaaattttaaaatacttagtattaaaatttttaacttgctactactttattggtctcatataaggacatgaacamctggggaagtaattggaaagggaaggaacataaaaaatattttatattctgtgaggtaaaaactgaggctaaaacataaataatttggcccaggtcatat

SEQ ID NO: 10856 - DNA, 201 bp, Homo sapiens
ctgtaatccgtgatttggttctaagagcctataatgaactccagttaattcagatgccatttagagaaacttggtcatattctaccttagaaaactcttgraataactttagttcttttgaaaattgcagtggtccagacatttttactctagtataactgctgtgtgtgtgtgtgtgtgtgtgtgtgtgtgtctgttgat

SEQ ID NO: 10857 - DNA, 201 bp, Homo sapiens
tactgcaacctccacctcctgaggttcaagccattctcccgcctcagcctcccgagtatctgggattacaagcacctgccatcacgcctggctaagttttrtatttttagtagaaacagggtttcaccatgttggccaggatggtctcaaattcctgccctcgagtgatctgccttcgacctcccaacatgctgggattat

SEQ ID NO: 10858 - DNA, 201 bp, Homo sapiens
ataggtgtaagccagggtagctttttaatactgctccctctctcttaggtattcacagtgcatattagcaaattaaatgttctgtgaagtcttgtattaartacatcttttaatattttatttaagacttcccaaattcacttgaccattcactttgtaatattccttgacagaatacttgttaatatccagctcctggga

SEQ ID NO: 10859 - DNA, 201 bp, Homo sapiens
tagtttcaaatccagacacccaatacacacacttccactcaccttcacgttctcacaaacttatacaagaaagtactcaatgatgtatttctaggcattaratatttatatggtgtatataggtaggtatatatatatatgtatgtgtatttatgtgtgtgtatatgtacatatgttcacatacatttatgtatatgtatg

SEQ ID NO: 10860 - DNA, 201 bp, Homo sapiens
ctagggaggctgaggtgggaggatcactttaacctggggatcaaggctgcagtgaaccagattgtgccagtgcactttagcctgggtgatagagtaagacmctctctaaaaatatatatatttttaaaagtgtgttagatctgcatattataaaatgacatgaattaagattcttcctccgtcatttatttctgttaaaaa

SEQ ID NO: 10861 - DNA, 201 bp, Homo sapiens
taaatattactatattactaatgtatcttaattttcttttttacaaagatcctataatatcagtaggtctagaattaggtcaagaatctgcatttttaaaraggcattccagcggcttctaaggcaggtggtttctagacaaactttccaaatactgagtgaaaagtttattcatgttgtgtttccattatttatgtgtaa

SEQ ID NO: 10862 - DNA, 201 bp, Homo sapiens
tacttgaggatttatcttgtaccagaaacttttacatgctttacattcatgttgaaaattaaatgctggccaggtatggtggctcacgcctgtaatcccarcactttgggaggctgaggcagacagatcacttgaggtcaggagttcaagaccagcctgggcaacatggtgaaacctcatctctactaaaaatacaaaaat

SEQ ID NO: 10863 - DNA, 201 bp, Homo sapiens
tttcctgtatttcagatgaacaaaatgagataatgcattcatatactgattcagcaaacatttattatgacttcccatgtactgggtactatatagatatkcgagattaaaacaaagaaatacaatgtaaaaattcagattcttttaaggattccaccgtctactaggggaaacagatgcaatgatgtcatctataatata

SEQ ID NO: 10864 - DNA, 201 bp, Homo sapiens
tacatggagttaaatacaatacccttagtggaattgtttggtacaaattgtggtggcattgactctgtccgaggttctgcttacattctgtatgcctggakgctagccgatcctctccatccagtggaatccagccttgtctttatctagcataaacctcacccttcccttgtgatctccaaacatgtgaacagccttttt

SEQ ID NO: 10865 - DNA, 201 bp, Homo sapiens
atttcattatattatctcttttttctcccttctacacttttcatttaccaccactccccaccccctgctacctaaatatctttatcccaatggaagatgcrttaccaaagattcacagtttatggaccagaagaaaaatgtggcttctaagtaagtcctgcagtcttatttctcacttctgtcattgacagccactaaatc

SEQ ID NO: 10866 - DNA, 201 bp, Homo sapiens
agttgaagtccacatatgataacatttctgcctccacttaaaaccctccagacagcccttcaatgacctcggcttacaatacaaatgtgttatgattttcyaggcccttcttcatctgctctcccttccttttgagcattatcccatttcatgcccccacacagattctagccataccccatgacttacaatttcccacaa

SEQ ID NO: 10867 - DNA, 201 bp, Homo sapiens
tgagggctggggcagtcagcaacacaatttttccactcacttgtggagctagaacataccttccctctgttttgtaaagatgagcctcctccctttcttasaacatttggagaacttcataactttcaatataacattcaagacatacttcaagagttgcccagccacatccattagtctaggtggcacctatgtggttca

SEQ ID NO: 10868 - DNA, 201 bp, Homo sapiens
gtaataaatgaagtaataaatggttcttcaacatttctgggtcacgaagttctttaaaaatataaagaaatctttggactttttttccagaaaaaaaatgyatacccaaagtaaattgaatatagttttggaaaggagtttttatcttatcctaccatagatattatgtactacacaactccgggggcacaattcacagac

SEQ ID NO: 10869 - DNA, 201 bp, Homo sapiens
gtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaacc

SEQ ID NO: 10870 - DNA, 201 bp, Homo sapiens
ggaaaatgccctctcagatcacagaaacagtagctgtgtaggtgttgctagtggagaaaaaaaaatgtttggtatttaaaatagaaacataaaattgttartaagtctacagacaacttgtattgcatgcagaaataaaaaatgaagtcctagtacaacaatactgcttagtcttggattcattttacagaagtttaagat

SEQ ID NO: 10871 - DNA, 201 bp, Homo sapiens
ctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagaca

SEQ ID NO: 10872 - DNA, 201 bp, Homo sapiens
gcagagaattaattggaaggtccatctaagcttcccacacatcctcagaatgaagtcaaagcagtctccaatgctcaatgccaattaaaaaaaaaaaaaaraaagaaaaacagtaagtgggtaggtggtcagtttatcaactctggaaaagcttgtctttgaggattcacactgctaaagccagacaaacgcatcagcaaa

SEQ ID NO: 10873 - DNA, 201 bp, Homo sapiens
tgcaggtagtgtcaaaggtgggaagggaatttaaaaaaaatgaatttaaaatgatgaaaagcatcgtatgtccatgagggaagcaaatttctactttctcmtaaaggttagtgttttctgcccctagcctccgacaaccatctccacttttctctaaagggttcttttccccttagctccctcattcatagctgcacagac

SEQ ID NO: 10874 - DNA, 201 bp, Homo sapiens
tctctcttttgcaaccttctactctctccacccccacggagacaggcaacttatcaggtgagtcccagtgctgtacttggagaaatattcattcaccttgytttcacccttctttgctgtggtcttgcttgggagctagtgggggtggggtgggaatagctgacaacaggaatcaggttttcagcctgaagttgattgaac

SEQ ID NO: 10875 - DNA, 201 bp, Homo sapiens
tggggtgggaatagctgacaacaggaatcaggttttcagcctgaagttgattgaactgttataaagtagcctgtgtggtaatggtcagggaaaagtagccraatataagaaggcagaaaatataattaacaacccgtggccatttgtgttggttttggcagctttatgtttgcaggaacagccctccagggaacatgagcg

SEQ ID NO: 10876 - DNA, 201 bp, Homo sapiens
ccagacctatagagagattcatgctaagacagatggaagaaacagaaatcctccaaatagctgatattttacctacacttttgcctgtgcttggttccaarctttagaaaattggttatattatagatttgcttaaagcctttatcccaggacagcctagaggatgctgggattctttgtaaattagggagactaaggcca

SEQ ID NO: 10877 - DNA, 201 bp, Homo sapiens
tcctagcactttgggaggccgaggtggggggatcacctgaggtcaagagtttgagacctgcctggccaacatggggaaaccccgtctctactaaaaatacwtatatatatatatatatatatatatatatatatatatatatatatgtatctccaatgtacatctgcctaaaaaatgcttcagtatttatagtttaaatgc

SEQ ID NO: 10878 - DNA, 201 bp, Homo sapiens
attcagggagttgaataattcatagtgttggttgacagatcaaatgataagatttatatatctttggccttggtgatgaattaattagattggtttctccrtctttggctcctctagatgcgttgtttttcttctttaaaattcactggtgagtggtgggtctggagattaacttgttcttgagagaccaccataggatga

SEQ ID NO: 10879 - DNA, 201 bp, Homo sapiens
taaacctgtgcagaattcaaacattcctacatggttctcagtgtccattgtaaactaagatttttaatctggtttgtgctgggaagaagcaggtgtttttrgggacaactaccttcagatgtggaagtgaagtacttcttttaatgcaatttcttaggcttactagggctcaaagtttgtagagcagataggagcacaata

SEQ ID NO: 10880 - DNA, 201 bp, Homo sapiens
aagcactttgattaatgcagctaacacacctttccaaagcatctacaagactttccaattcctaataagtatttgaatgttttccaatctgcctgaacccrtttcaacccaaggagatagtaaataaaaggagcagactgatgaaacactcacacttgatatgtctttttttttgaatgaatgaatcaatgaataaatgat

SEQ ID NO: 10881 - DNA, 201 bp, Homo sapiens
gtctctttctactgcatcacaatgttagcactcaggctttccaggtgtcatctgttttgctgtggactgggaaactgggattgtctccagcaccacttggrtaacaaatgagcacagaaggagcagagagcagcatgacaaccaagatactccaaacactcgcactgtttcctgtaattaccatccagagagcagctccca

SEQ ID NO: 10882 - DNA, 201 bp, Homo sapiens
gttcaaacaaatcatttgggcttgcagaaaataatatgagattaatatccaagtgtgtgtgtgtatgtatttgtggggtgtgtgtgtgtgtgtgcgcgcgygtgcatatatgacaactacgtggctcctcacttgaagttttggaattagctactaatatatgtgtatgtttaagggatgcatttgtggacttgaagttga

SEQ ID NO: 10883 - DNA, 201 bp, Homo sapiens
tgattgtaagtttcctgaggcttcccaagacatatggaactgtgagtcaattatacctcatttctttataaattacccagtctcaggtagttctttatagsagtgtggaaacagaccacacagaccaccaagccattcatgagggatctgccctcaggatccaaacacttccctccaagccccacctccaatgttggggat

SEQ ID NO: 10884 - DNA, 201 bp, Homo sapiens
caggtagttctttatagcagtgtggaaacagaccacacagaccaccaagccattcatgagggatctgccctcaggatccaaacacttccctccaagccccwcctccaatgttggggatcacatttcaccatgaaatttggaggggacaaacatccaaaccgtatcaacagggaactatagctcagggaggttaagtaactt

SEQ ID NO: 10885 - DNA, 201 bp, Homo sapiens
gcattggagttaatgggaatggggaatgccttctttgcttcttgacatttctcctccacaacactgcacatcccttgtgaaataatttactattttttagrcatcatgtcaaagactgaagtgaaagccaccctcttgtgatcaactgaggtcagaagttggcaaatttttttgttgggggtggggggctaaagggccaga

SEQ ID NO: 10886 - DNA, 201 bp, Homo sapiens
aataatttactattttttagacatcatgtcaaagactgaagtgaaagccaccctcttgtgatcaactgaggtcagaagttggcaaatttttttgttggggrtggggggctaaagggccagataataaatatttttggcttttcacaccagaaagatctccattgccactagtcaattctgcatttataactgagaagcaac

SEQ ID NO: 10887 - DNA, 201 bp, Homo sapiens
ttacaaaaggcaaagagggctggatttggcttcccaatctctgccttaggcctttaaagatatagcttccctggggaaatctctacactttgagatttatrctccagtactaataacatagtaagagaatagtaatggtggtggtaataatagcagtagtggcatcagcagcaacaacaatggcaccttttaacatttgct

SEQ ID NO: 10888 - DNA, 201 bp, Homo sapiens
cagttcagataagatacaatcctaacaaataaagtggggtcggagtggaatgttcttgaaatcctggtatcaatgggactgggatattactctaaatctayggaaacttcaagaacaatatatttgttttaacctgaaaagacagttgcgttccagtgtgaaatagccaccaggctggatgaaaatgtgtgatgtgattcc

SEQ ID NO: 10889 - DNA, 201 bp, Homo sapiens
ttctcgcttcatttcattcatttcatcttccattgctgataccctttcttccagttgatcgcatcggctcctgaggcttctgcattcttcacgtagttctsgagccttggttttcagctccatcagctcctttaagcacttctctgtattggttattctagttatacattcttctaaatttttttcaaagttttcaacttc

SEQ ID NO: 10890 - DNA, 201 bp, Homo sapiens
acgcagctggagatctgaggacgggcagactgcctcctcaagtgggtccctgacccctgacccccaagcagcctaactgggaggcaccccccagcaggggyacactgacacctcacacggcagggtattccaacagacctgcagctgagggtcctgtctgttagaaggaaaactaacaaccagaaaggacatctacactga

SEQ ID NO: 10891 - DNA, 201 bp, Homo sapiens
ttgccctgcatattgataattttaccatgcagactccactcctcaggtaactcttgttctattacactggactttatcatcatgtaatctgtcctgtcccyctctctctctctctctctctctctctctctattgaattctgggggtgtagtagtccattgtttagagggaatttagaagttttcctatattaggaagtgt

SEQ ID NO: 10892 - DNA, 201 bp, Homo sapiens
ccgggcgtggcggtgtgcgcctgtaatcccagctacttgggaggctgaggcaggagaatcacttgaaccaggaggcagaggttgcagtgagcctagattgygccactgcactacagcctgggcaacagagtgagacttcatctcaaaaaaaaaaaattatatagtataattctaataatgggatgctccacttcacttgca

SEQ ID NO: 10893 - DNA, 201 bp, Homo sapiens
gaaatagtgggtccctttttcaaaaagcaataacgaagtgccatgagaagtacttaaaacataaagctctttttcctttttccatggtttctctctctaarcttgtcatgttgttttatatttgctcttcagtgtcattctaaggaaagaaaatgttaaattattagcatgaattttgccattcatctttatattatgcca

SEQ ID NO: 10894 - DNA, 201 bp, Homo sapiens
ttgatccctagttaggcaaaaacatggagatgagaatatgtgagccttgtttgagaattgcttagctagtgtgaggtaagtcagggaatttcagaagaaasccaattatgaaagcatggattggactgtttgaatattttcctctagttgataaagtgactgatggctttagctactgaattaacgtgatcaaaagagttt

SEQ ID NO: 10895 - DNA, 201 bp, Homo sapiens
aagccaattatgaaagcatggattggactgtttgaatattttcctctagttgataaagtgactgatggctttagctactgaattaacgtgatcaaaagagttttttttttttttggagatggagtcttgctctgtcaccaagctggagtgcagtggcatgatcttggctcactgcaacctctgcatcctgggttcaagcaa

SEQ ID NO: 10896 - DNA, 201 bp, Homo sapiens
tcatcatgttggccaggatgatcttgatctcttgacctcatgatctgcccgcctcggcctcccaaagtgctgggattacaggtgtgagccaccgtgcctcrcccatcaaaagagatttttagtgaattaatatggaagtgtcctatcacagagataggaaggggtggatctgttaatagacagatgaacaagggagctatt

SEQ ID NO: 10897 - DNA, 201 bp, Homo sapiens
cctcactatattattttgtgtatgagtgacagctgtagagatatataatggtttgagtttgccaagtcacagccccctcgtttgacctctgaatttaagggtgtgtgtgtgtgtgtgtgtgtgtgtgtatgtgtgtgagagagagagagaaagagatacagatagacatttcgttggaggaggagtgtgagggaaaaccta

SEQ ID NO: 10898 - DNA, 201 bp, Homo sapiens
ctcactatattattttgtgtatgagtgacagctgtagagatatataatggtttgagtttgccaagtcacagccccctcgtttgacctctgaatttaagggtgtgtgtgtgtgtgtgtgtgtgtgtgtatgtgtgtgagagagagagagaaagagatacagatagacatttcgttggaggaggagtgtgagggaaaacctag

SEQ ID NO: 10899 - DNA, 201 bp, Homo sapiens
gcgcctggcctgacattgtttaattttttaaagtacagcccttagtgataatttttccttttctgtagccagagaggattctagtattttggcagttggamgatatcttatctctctcaatgccctcatcagttgagaaataagcctctttcttttagtattttatattctcaaagctcagaacatttcagagtcatgtta

SEQ ID NO: 10900 - DNA, 201 bp, Homo sapiens
ggatttttaattatttagttgacgcttattcaactatatgatgtaagtaggccttttctccctaatgttttattaccagttaaagcacagacaggtatttyactttaatttagatatagagtaggtaacagagagctgaaattttaaaaattagataaattttttggtagttagttttatagttaatcttctctctttttt

SEQ ID NO: 10901 - DNA, 201 bp, Homo sapiens
aaagtgaaaggagtaaattgctttatggatttcctagtgcatagtacacatagaacttttctaaatatacatcctcttcagcagttagtttgtgccagatytcaattcctacgctacaagttctccagcaaactagaggtgtccatgtccaagtggacatgctaaaaaattcaaattttacagaaattttacagagacctt

SEQ ID NO: 10902 - DNA, 201 bp, Homo sapiens
tatgaataagtcatcaatagttaatgataaggaatcagtctgctgtgccatattggtagatgaaatgctgctactcctcctattcctgggcttttctgccycccacccccttccttccctccttcctctgtccctccaactcttcttcacatctcccaactcccccaattcacttcttttccactgcatgccatgttaccc

SEQ ID NO: 10903 - DNA, 201 bp, Homo sapiens
tcagactgactttttgcaggttatgctgaaagatgaatgctcagtaatagctcgtgccttaagacgtggccgagcaagctttggaggtaaaatagctcatrgagtttttatttatttatttattctttaaaaatggtcacaaagatttcagataaacaatctgagtatggctaaattatttttcttaggtaaacataggag

SEQ ID NO: 10904 - DNA, 201 bp, Homo sapiens
ccttaagacgtggccgagcaagctttggaggtaaaatagctcatagagtttttatttatttatttattctttaaaaatggtcacaaagatttcagataaamaatctgagtatggctaaattatttttcttaggtaaacataggaggcaagagattaaaagggtgggagaaacattaattaggctatgctcttatcaagtag

SEQ ID NO: 10905 - DNA, 201 bp, Homo sapiens
ttatttatttatttattctttaaaaatggtcacaaagatttcagataaacaatctgagtatggctaaattatttttcttaggtaaacataggaggcaagarattaaaagggtgggagaaacattaattaggctatgctcttatcaagtagtgtgaccttagcgaatttacctaatctttttgaacctcagtgtcctcattt

SEQ ID NO: 10906 - DNA, 201 bp, Homo sapiens
atctttttgaacctcagtgtcctcatttataaaatggaggcataactttttatgaagattaagataatgtgtgaacaatctgtgcagtagtagttgctcartaaatggtagtgattttcacatgtatttggactattgtagaatatagaaaagaatatcatgcaaactctagtcctttaaatatgagtgaggaagaggaat

SEQ ID NO: 10907 - DNA, 201 bp, Homo sapiens
taggtatatctcctaatgctatccctcccctctccccccaccccaccacaggccccagtgtaagaaatacaataaacaaagtatcttttattttggctacrtagttatgttgagggtcattcatcgtcctccagtttagcctatttggaacggtactggttaatctcaataaacaaataacattgtcagtttaattgttca

SEQ ID NO: 10908 - DNA, 201 bp, Homo sapiens
gcttggatttgggcaatagataaaaacacatagagagtatttgcagatgcatgtgatagatagaaatggtgagtgaccatttagaaatttagaattggaattttttttttttttttgagtctcgttctgtcacccaggctggagtagtgcaatggtgtgatcttggctcactgcaacctccacctcctgggttcaagcaat

SEQ ID NO: 10909 - DNA, 201 bp, Homo sapiens
acgtaggaacagttccaggcagctaaaagagcttcttcctcacttgccactatcttaaatggtatctggtgtctacagttgctccttctactttcttaagaaaaaaaaaaaaaatccaaatggaaaagaggactctgaagacaaattagtcctttacaattataattttatttgatttcaaagcagtacttggtatagcac

SEQ ID NO: 10910 - DNA, 201 bp, Homo sapiens
taggaacattccaattccacttttttaatttttaaaaatatgcaatacataattgttgactatagtcaccctgttgtgctatcaaatgctagattttattyattctatcaatgtttttgcacccgctaactgtctctacctttcccttctctccccaatacccttcccagcttctggtaactgtcattctactctctatct

SEQ ID NO: 10911 - DNA, 201 bp, Homo sapiens
acacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggtt

SEQ ID NO: 10912 - DNA, 201 bp, Homo sapiens
aggcatgcgctaccatgcctggctaattttgtttttttagtagagacagggtttctccatgtcggtcaggctggtctcgaactcctgacctcaggtgatcygcctgcctcagcctcccaaagtgctgggattacaggcatgagccaccgtgcctggccaagtttatgttaaataactcgtccagaaggtgtagtgggatgt

SEQ ID NO: 10913 - DNA, 201 bp, Homo sapiens
ggattacaggcatgagccaccgtgcctggccaagtttatgttaaataactcgtccagaaggtgtagtgggatgtttgactccaaaatacatgcttttaccrcctcaactgactgagcttgggactacctctaactttcattagaaacacaaatctttttctaataaactttcttcttcttttcaataaaaacatttcccac

SEQ ID NO: 10914 - DNA, 201 bp, Homo sapiens
atggaagcgaggtcagaaacgcctcattacatgccctttatgttagagtttaggcacaactgaccagcattaacattaaaatagagatcataagattaackaaagggactcattgtgacactaaaataccacattctaaataagacctaaggccatgcaaagcaagggttaaggcatgctctgcaaaccgtaaaatctttt

SEQ ID NO: 10915 - DNA, 201 bp, Homo sapiens
ggcagatagcagaccccttatcttgacttaagcatccctttgtattgacctcaagtctttagacaaagcttaactctttcaatcaattgccaactaaagtrtctctaaaactcacccatgacttgtaagcccatgcttcaagatgtcccaccttttcaggccaaaccaatgtatacttttcatgtactgatttataatttt

SEQ ID NO: 10916 - DNA, 201 bp, Homo sapiens
tttttttttccttaaacacaaaactacacccccgcctccagctcccaccccctcccacacatatacccttttttcatagaacaaaatttggaataaatggmctttaaatgaatgcattgttttgactctgcagggaaatgacatagagaaaataaggaatggatcgtacatgctcatgcactgtctggggcactcctgctg

SEQ ID NO: 10917 - DNA, 201 bp, Homo sapiens
tcctcatcctccaattaattagctgaaaaactgactgcatctctgattctctaagaagcatggaagagaaagaaatgggaaaccagctagcagctcattasatgaattcaaacagttccctttgaagggaaactttttcctggcatagatgatgtcattgatgagattgcaagggtaggcattgtataaagatgagatcct

SEQ ID NO: 10918 - DNA, 201 bp, Homo sapiens
taaaatgtctctttaaagcctgggagctctccaaggtgtggtgtgtttcctatttgctaggtacatgattacgatgcatatggatagatgtttctgaagtrtttccttctaagtgcactattgccagtcagatttacacccaagtagcaaagatgttaatgccatgcaatcctattaatctaacatgttgcttttgtggat

SEQ ID NO: 10919 - DNA, 201 bp, Homo sapiens
tactaagtagaagatacttgaatattccattggctgactgatgtgtttattaggcacttactctgtgcccaacacaatgataaacattctcagcaatatcktgaaagtttaacacaggattcctggcttccagaaatatgatgtttacttaagaagagataggaacatatgtgaaaaagttaagcttcatgtagtatctta

SEQ ID NO: 10920 - DNA, 201 bp, Homo sapiens
cagaagttgtggagtagtgtttttgagttatccgctgtttaggatcctgtattaaaagaagtatgtcggctgtgcatagtggctcatgcctgtaatcctarcactttgggaggccgaggcaggcagatcacctgaggtcaggagttcaagaccagcctggccaacatagcgaaactctgtctctactaaaaatacaaaaaa

SEQ ID NO: 10921 - DNA, 201 bp, Homo sapiens
tcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtg

SEQ ID NO: 10922 - DNA, 201 bp, Homo sapiens
agatcacctgaggtcaggagttcaagaccagcctggccaacatagcgaaactctgtctctactaaaaatacaaaaaaattagtcaagcatggtgtcgtgcrcctgtaatcccagctactcaggaggctgaggcaggagaatcacttgaacccaggaggcagaggttgcagtgagccaagatagtgccaccgcactccagcc

SEQ ID NO: 10923 - DNA, 201 bp, Homo sapiens
aaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaa

SEQ ID NO: 10924 - DNA, 201 bp, Homo sapiens
gctttgaagttgatccatgtggtcttttgttttggattgattgtagggactaaagaagtacttcatacgttgtgttatctttctgctcaggtcactgtggrcgatagatagcctttacttctccgctttctcaattttcagccactggtattcaactgcaggccttctttaaaaatgtacctctttctttcaaaattttct

SEQ ID NO: 10925 - DNA, 201 bp, Homo sapiens
gagttcacctgtgaagcatcctgaagggaaacaccggtgcactgggcagggaacaggagacctagatatacttcttcttttttttttttttttttggtagmtatatttatttatttatttatttttattttattattattatactttaagttttagggtacatgtgcacagtgtgcaggttagttacatatgtatacatgt

SEQ ID NO: 10926 - DNA, 201 bp, Homo sapiens
gggactgtaaactagttcaaccattgtggaagtcagtgtggcgattcctcagggatctagaactagacctagatatacttctaacataatctgtgactgtrtgcaggtcatgctaagtatgtcagactgccattttctccttgaggctggaagtgtggggagaaggggataatgtagttgagaatccattactggccccac

SEQ ID NO: 10927 - DNA, 201 bp, Homo sapiens
agggtacacatgtgcctggatggtgctgctactggactcttgtttacattaatgtgtcaacagtgtgctccaaggttctattaggtgttaacaggtgtctyaagaaaaaaatgtttcttaatgagatcagtttgtaagaattctgggtgaacacgttaattagtttattcttttaatgcgttgaatgtttttttttttttt

SEQ ID NO: 10928 - DNA, 201 bp, Homo sapiens
tgtttacattaatgtgtcaacagtgtgctccaaggttctattaggtgttaacaggtgtctcaagaaaaaaatgtttcttaatgagatcagtttgtaagaaytctgggtgaacacgttaattagtttattcttttaatgcgttgaatgttttttttttttttgaaaaataatagaatcccttcagaattcttaatatgatat

SEQ ID NO: 10929 - DNA, 201 bp, Homo sapiens
ttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaa

SEQ ID NO: 10930 - DNA, 201 bp, Homo sapiens
ttctccccaatctggggccccttcttcattcttgcttatcttattaggactccacattaactattgttgttattatcatacacagactatctctgaaaggwtatataagatatagataccagccataacctctgcaaaaagatacaaagagactagggagccggaaagcaaagatagaggagtgggcttacttttccctac

SEQ ID NO: 10931 - DNA, 201 bp, Homo sapiens
agactatctctgaaaggatatataagatatagataccagccataacctctgcaaaaagatacaaagagactagggagccggaaagcaaagatagaggagtrggcttacttttccctacatatgaatttactctattgaatattttaaaatcacctgtgttttaccatcaaaaaaataaaataaaacaagcatcaatattta

SEQ ID NO: 10932 - DNA, 201 bp, Homo sapiens
gtaccaaaacagagatatagatcaatggaacagaacagagccctcagaaataatgccgcttatctacaaccatctgatctttgacaaacctgagaaaaacragcaatggggaaaggattccctatttaataaatggtgctgggaaaactggctagccatatgtagaaagctgacactggaccacttccttacaccttatac

SEQ ID NO: 10933 - DNA, 201 bp, Homo sapiens
cagccaaaagaaacatgaaaaaatgctcatcatcactggccatcagagaaatgcaaatcaaaaccacaatgagataccatctcacaccagttagaatggcratcattaaaaagttaggaaacaacagatgctagagaggatgtggagaaataggaacacttttacactgttggtgggactgtaaactagttcaaccattgt

SEQ ID NO: 10934 - DNA, 201 bp, Homo sapiens
atctagaactagaaataccatttgacccaaccatcccattactgggtatatacctaaaggattataaatcatgttgctataaagacacatgcacatgtatrttttattgcagcactattcacaagagcaaagacttggaaccaagccaaatgtccaacaatgatagactggattaagaaaatgtggcacatatacaccatg

SEQ ID NO: 10935 - DNA, 201 bp, Homo sapiens
ataccatttgacccaaccatcccattactgggtatatacctaaaggattataaatcatgttgctataaagacacatgcacatgtatattttattgcagcaytattcacaagagcaaagacttggaaccaagccaaatgtccaacaatgatagactggattaagaaaatgtggcacatatacaccatggaatactatgcagc

SEQ ID NO: 10936 - DNA, 201 bp, Homo sapiens
attttatatttagatgctactattagcagatgatttgtgcgtatgtcttgccctgttcagctttgaggagtccaggcccttatgggactccttctgagagyggggttcctattttccttaggaacccaagacagttctttcagaggatttcattgatctgttgccccatggtgctttgtggcacataatgacaaagcatga

SEQ ID NO: 10937 - DNA, 201 bp, Homo sapiens
gtggcacataatgacaaagcatgacaggcaggctcacagccctcgactcatgctagatctcggttcattctgtatccagggactccagttcatcatatccmttacccaggcctctctcctagctatgtctgtgtggctcacagatactctagagggagaggcaattaatttctttttggcggtgagatggtttgcctgggt

SEQ ID NO: 10938 - DNA, 201 bp, Homo sapiens
gtccccactccaatcttatcttgaattgtagctcccataatgcccgaatgttgtaggagggacccagtgggaggtaattgaatcatggagatgggaattcmtgttctgttgtcatgatagtaagtctcacgagatctggcggttttataaatgagagttcccttgcacatgctctcttgcctgcaaccacgtaggttatgc

SEQ ID NO: 10939 - DNA, 201 bp, Homo sapiens
gttttataaatgagagttcccttgcacatgctctcttgcctgcaaccacgtaggttatgcctttcttctccttagccttctgccatgattgtgaggcctcyccagctatgtggaactgtgagtcaattaaacctctttttctttataaattacctagtctcaggtatgtctttattagcagcatgagaactgactaatgca

SEQ ID NO: 10940 - DNA, 201 bp, Homo sapiens
gttgtgtcttccttggtgtcttagttttttctgtgctgctataacagaatacctgagactgggtaatttgtaaagaacagagatttatttcttatagttcyagaggctgagaagtccagatcagttgggtggcatctggcaaaggctttcttgctgttttgttctatgatgaaaggtggaaaacaagagagagaacaaaag

SEQ ID NO: 10941 - DNA, 201 bp, Homo sapiens
tggcaaaggctttcttgctgttttgttctatgatgaaaggtggaaaacaagagagagaacaaaaggtgtctaaatttggttttatagcagatccattcctkgataaccaacaaactcccaggatgataatattaatccattcatgacggcagagcccttgtgacctagtcaccacttaatgctcccacctctcaccactgt

SEQ ID NO: 10942 - DNA, 201 bp, Homo sapiens
aaacccttctttcctcatctgataattgggaaaataatagcaactaccttgtggatactttgtgagaatcccatgcttcatgcaataaggacttaataatygtaagttgttaaattgtcatacatgctccttttagttatgaaaacctgtggcttttgtctaagagttgaatatgagaaggttcaaggactagggctttta

SEQ ID NO: 10943 - DNA, 201 bp, Homo sapiens
actagtactagtgaaagtcaggtttgaacaattctgtgaagaatggatttggaaggaaaatatgaggcaagaattttaaaaagttgtttctgagttgaatktgatttacatttgctaactggaaaaagatcagggtataatcagtccataatattgaaagcagtttggaaataccattgcagatacaggtaatttaaaaaa

SEQ ID NO: 10944 - DNA, 201 bp, Homo sapiens
aaaaagatcagggtataatcagtccataatattgaaagcagtttggaaataccattgcagatacaggtaatttaaaaaatctacatgaattaggtccaggmgcggtggctcacgcctgtaatcccagcgctttgggaggccgaggctggtggatcacgaggtcaggagatccagaccatcctggctaacacagtgaaaccc

SEQ ID NO: 10945 - DNA, 201 bp, Homo sapiens
ctggtggatcacgaggtcaggagatccagaccatcctggctaacacagtgaaaccccgtctctactaagaatacaaaaaattaggcgggcgcggtggcggrcacctgtagtcccagctactcgggaggctgaggcaggagaatggcatgaacccaggaggtggaacttgcagtgagtagagatcgcgccactgcactccag

SEQ ID NO: 10946 - DNA, 201 bp, Homo sapiens
gaaaactgtagaacattctacaaatattatctaacaaaatatatgaatgcataattagtgtcttcaagggatgtcataaatatcgtaaaactaaagggtgrgctgtatcaaaacttggaagggattgggatgaaaatcaaactgtctaaaatagaatggccaaatacattgggacttggctccagaaagaattaatgagaa

SEQ ID NO: 10947 - DNA, 201 bp, Homo sapiens
tttctcattgttcaactcccacttatgagtgagaacatgtggtatttggttttctgttcttgtgttagtttgctgagaatgatgatttccagcttcatccrtgtccctgcaaagtacacgaactcatccttttttatggctgcaaaatattccatggtgtatataccacattttctttatccagtctgtcatcagtaggca

SEQ ID NO: 10948 - DNA, 201 bp, Homo sapiens
ccctgtctttactaaaaatacaaaaattagctgggtgtggtggcatgcacctgtagtcccagctacttgggagtctgaggcaggagaattgcttgaacccragaggcagaggttgcagtgagccaagatcctgccactgcactctaggctgggtgacagagtgaggctccatctcaaaaaaaaaaaaaaaaaaaaaaaaat

SEQ ID NO: 10949 - DNA, 201 bp, Homo sapiens
tgaggcaggagaattgcttgaacccgagaggcagaggttgcagtgagccaagatcctgccactgcactctaggctgggtgacagagtgaggctccatctcaaaaaaaaaaaaaaaaaaaaaaaaattcaggaaacaacaggtgctggagaggatgtggagaaataggaacgcttttatactgttggtgggagtgtaaatta

SEQ ID NO: 10950 - DNA, 201 bp, Homo sapiens
gaggcaggagaattgcttgaacccgagaggcagaggttgcagtgagccaagatcctgccactgcactctaggctgggtgacagagtgaggctccatctcaaaaaaaaaaaaaaaaaaaaaaaaattcaggaaacaacaggtgctggagaggatgtggagaaataggaacgcttttatactgttggtgggagtgtaaattag

SEQ ID NO: 10951 - DNA, 201 bp, Homo sapiens
aagaggtaaagaggaacttttaaaagcacatattgattaaaacaaaagttatacactttgggaggccgaggcgggcggatcatgaggtcagaagatcgagmccatcctggctaacacggtgaaaccctggctctactaaaaatacaaaaaaattaaccgggcgtggtggcgggcgcctatagtcccagctactcgggaggc

SEQ ID NO: 10952 - DNA, 201 bp, Homo sapiens
gcgggcggatcatgaggtcagaagatcgagaccatcctggctaacacggtgaaaccctggctctactaaaaatacaaaaaaattaaccgggcgtggtggcsggcgcctatagtcccagctactcgggaggctgaggcaggagaatggcgtgaacccaggaggcagagcttgcagtgagcccagattgctgccactgcactc

SEQ ID NO: 10953 - DNA, 201 bp, Homo sapiens
tggctgggcgtggttgttcatgcctgtaatcccagcactttggaaggccaagtcaggcagatcacctgaggtcaggagttcaagaccagcctggccaaaayggtgaaaccctgtctctactaaaaatacaaaaattagtcaggcatggtggtacatgcctgtagtcccagctactcgggacactgaggcaggagaatcact

SEQ ID NO: 10954 - DNA, 201 bp, Homo sapiens
ttcaagaccagcctggccaaaacggtgaaaccctgtctctactaaaaatacaaaaattagtcaggcatggtggtacatgcctgtagtcccagctactcggkacactgaggcaggagaatcacttgaacctgggaagtggagttgcagtgagccaagattgtgccactgcactccagcctgggctactgagtgagactccat

SEQ ID NO: 10955 - DNA, 201 bp, Homo sapiens
ttgcagtgagccaagattgtgccactgcactccagcctgggctactgagtgagactccatctcaaaaaaaaaaaaaaaaaaaagaagaagaaaaaaaaaargctgggagtttcattattcctcaaagaaggcacctcagaccaggttccatagggcacgcccctaaagagcccaaccttctcagggttctaaaatgtatct

SEQ ID NO: 10956 - DNA, 201 bp, Homo sapiens
tcatgaaatcaataatcatttattgagtactgactattcactgtggggccagatattgagaatattggagagcaattagatgtggtctctgactccagggktctacaaacggcatggtggggaacaagctcattagatgaggagaaaaaataataatataagtgagtataaactcaagaactataattatgcattgattaa

SEQ ID NO: 10957 - DNA, 201 bp, Homo sapiens
gtatggttcctggacaggcagcaccagcatcaccagggaactttttagaagtgcaaatcctctagtcccacaccagacttactgactcagaaactctgacrtggggcctgtaatctgtgttttaacaagccttctggttgattctgatgtgcattgtcctaggagaaccactgacttagagataagttaagaaactcttcc

SEQ ID NO: 10958 - DNA, 201 bp, Homo sapiens
ccagagatgtgcggtggcttgttccaggtgttatatgacaggacaatggacctcaaactcaagattctttttcctctacacttcactactttaactctccygattattttgtggactgatgaataagtacgtgtaaactgattttagtttttctggtaatgaaaaaaaaaaaaaacaatgagtattgttactcttgtaata

SEQ ID NO: 10959 - DNA, 201 bp, Homo sapiens
atctgccctggcagatatgcatacatgtgcaggcccgtgtgttcgtgcacacatatgcacacagataaagtgggaacagagagaagccagtgggtggtggwgagagatgggggcagaattgatgcatcagggggcctaaatccatgcaatgatcaagttcatagcaatttccccaggagactgtatcatattccagtgaag

SEQ ID NO: 10960 - DNA, 201 bp, Homo sapiens
atggaagcaagattcttgggcagttgaatccttctcaaactcattcttggtgagtactgtcactttctaggtgtgccttaggcaagttatttaactgcttygtgccccagagagtggtgggggaatcaagggtaggacacatgtgagtcactcagaacagtgcctagtctttagtgaatggaacttcgggtgttcattatt

SEQ ID NO: 10961 - DNA, 201 bp, Homo sapiens
attcacacactcctatcatggattggagggaagttgaatattggttcatatcttgttttaggttctggtttacttgctgcctgaactaggaatataattcrggatttgcagctagtaagttgaaattaagaagaactcaggcctttagattaatcaagtacatatacagtattgaaattatgtctttttatcagtatcttt

SEQ ID NO: 10962 - DNA, 201 bp, Homo sapiens
atgtttgcattttagacactccaaatacagatataaaaactttatgtctcctcctccagctctaccttcaactttcttttcactttctttcctactaagarcacatatttccaggctcattcttcatccctaaactctgtccctctccttactcctttgttccgtcttttgtcctctccctggaatttctggtcatttgca

SEQ ID NO: 10963 - DNA, 201 bp, Homo sapiens
ttcttcatccctaaactctgtccctctccttactcctttgttccgtcttttgtcctctccctggaatttctggtcatttgcattaactacacttataagtmaaactttctttgttcctttgtgggtgtactcagaacatcattacattcaagtaaattcatgtgttttttttctttttttgcccttttatttaaaagcacc

SEQ ID NO: 10964 - DNA, 201 bp, Homo sapiens
aaaactttctttgttcctttgtgggtgtactcagaacatcattacattcaagtaaattcatgtgttttttttctttttttgcccttttatttaaaagcacycctactggccattagaatagttaccagaaatctcctttggtctatggataagaaattctgcagaacttttcaaccaagtaattagatcatattatgtcta

SEQ ID NO: 10965 - DNA, 201 bp, Homo sapiens
acacatatatattcacatatatatacatgtatatatgtagtctgttgtcctgagctcctgttgtttgtcaattgaaaaatgtgttaccctgtcttagcaagtgtgtgtgtgtgtgtgtgtgtctatatatatatatatatatatatatatcctcaaaattttacctagagtaaaaaaatgaaatgcctacattacataaag

SEQ ID NO: 10966 - DNA, 201 bp, Homo sapiens
cacatatatattcacatatatatacatgtatatatgtagtctgttgtcctgagctcctgttgtttgtcaattgaaaaatgtgttaccctgtcttagcaagtgtgtgtgtgtgtgtgtgtgtctatatatatatatatatatatatatatcctcaaaattttacctagagtaaaaaaatgaaatgcctacattacataaaga

SEQ ID NO: 10967 - DNA, 201 bp, Homo sapiens
acatgtatatatgtagtctgttgtcctgagctcctgttgtttgtcaattgaaaaatgtgttaccctgtcttagcaagtgtgtgtgtgtgtgtgtgtgtctwtatatatatatatatatatatatatcctcaaaattttacctagagtaaaaaaatgaaatgcctacattacataaagacccatatgacaatattaattctg

SEQ ID NO: 10968 - DNA, 201 bp, Homo sapiens
accacagaacttctctcgtcccactccttcttgttttgtctttgggtaaaaggaataaattatatatttatcataaattttaactctacaaaatggccatwtttatactttcttcagatttctctcagttctagttaaggtttttttttggcttccatttgccccttatttgattattatactccaagtggctgaagaaaa

SEQ ID NO: 10969 - DNA, 201 bp, Homo sapiens
atattgtcaataactattcccagaaggttttttttttttcagatctactagagaacttaaagctttttcttttccaggaatggccaaaatatccagaaggrcaatatcaagtaataattaaagttataagctcttggtttgaattcttgctccactagttatgtgaccttgagcaaattacttaacttctctgtgccttac

SEQ ID NO: 10970 - DNA, 201 bp, Homo sapiens
aaaaaaaaaaaagcttatggctctttttgtgccacaatggcagaattgagtcattgctacaggcagtgcatggcctgcaaaacctgtgatattattctctkctctgatattaacatagctggaatgtgccccaaatgtatttcaatcaagagctttcatgtattttttgaaataacctggataagaaaatccagattttag

SEQ ID NO: 10971 - DNA, 201 bp, Homo sapiens
ttacatttatgaattcaaccaactgtggatcaaaaatatttgaaaaaaatgtgtctgtactaaacatgtacagtttttttcttgtcattattccctaaacratacagtgtaacaactatttacttagcatttacattgtattaggaacttaagtatcttaaagatgatttaaagtatatggaaagatatgcttaggtttta

SEQ ID NO: 10972 - DNA, 201 bp, Homo sapiens
aagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaacc

SEQ ID NO: 10973 - DNA, 201 bp, Homo sapiens
aatgacaaatatgggtctcgccgcactaagatattttaatatacttcagtgggaaaggctctgatccagaaatttgcagttgtgctattgataaaatttawgagaaactttcttctgtgggcctcagttttcacatctattaaatgtgctgatttaactaaactatctttatttcctttaggctcagacatttcctatttc

SEQ ID NO: 10974 - DNA, 201 bp, Homo sapiens
catggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaa

SEQ ID NO: 10975 - DNA, 201 bp, Homo sapiens
aacaaatattaattcctcaaagtttaattcttaacaaatattaattctacaaagagctaaaaggctctatgtaggtagataacggcattcagatttacctyctaatctttacagtaattggttttaagggttggagaaagaagtaaaggaggtaaaagaatgtacatagacaataataattatgaataacatttactaagc

SEQ ID NO: 10976 - DNA, 201 bp, Homo sapiens
acaaatattaattcctcaaagtttaattcttaacaaatattaattctacaaagagctaaaaggctctatgtaggtagataacggcattcagatttacctcytaatctttacagtaattggttttaagggttggagaaagaagtaaaggaggtaaaagaatgtacatagacaataataattatgaataacatttactaagca

SEQ ID NO: 10977 - DNA, 201 bp, Homo sapiens
tgtgggtataagttttttcttacatatattatatatacatatataagtgtaacacttttaagaattttattgaccatctaaatatatagcaaaatcagctrggggtacaagagtgtaactacttccttttttcctaagttgtggaaaatgtgagaaatgagaagtaagcaagacggaggattagaatcacaaggtaggttt

SEQ ID NO: 10978 - DNA, 201 bp, Homo sapiens
tgactagccaagactcaaggtgaaagtttggcctgcagctttggcaaacaaaggagaagctaatgaatcataaaggtcacatcttcttgaattttcttctstttcttcactgttctgattacttttaaaaaatctctattccttatatattctgagtacaaaaactcattagcaagatttggttctgttgtctggagaatt

SEQ ID NO: 10979 - DNA, 201 bp, Homo sapiens
cccctcagtgtaatatctcatctcaatcatttttttctttagttttgcagatagcacctgccatttctaaatatgtgtctttaattcatcttaaccacttyggattatgacatcctaaaattgccatatatttttatatttccatacttttgctcaggatcttctttggttaaaataatctttcctacttcacctttgacc

SEQ ID NO: 10980 - DNA, 201 bp, Homo sapiens
cttgttaccttttggttttccccggcacctaacaatgtaatcttcacaaagcagtgctacattctaaatttatagtgcagtaaatgaaagaggttggatcyattgtgcttcataattcagagggaagaatgtctgcagaaagaaacgtgggtattctttggaatgccatatgtgcaataattgaaacattttgaggaattt

SEQ ID NO: 10981 - DNA, 201 bp, Homo sapiens
aaaggttttgcccctcttaactctcctgaccactagcattctctctaccttagtgtgtgggtaggtctttgttatgtctccagactcacactagttttttwaaaaaaatacttaggtaaatagcagtgggaccccaattctctttttcttgtattccagatgaaaaagaaaaaaactcaccagtttaaagtgctcgtttca

SEQ ID NO: 10982 - DNA, 201 bp, Homo sapiens
tactgtgaaatctctggcactggttacccaatatccacacataccccacttagctctagattagaaaataaagaatgagattcagcccagaggcagccatrcgcacaggtgcacaatttggaaaaaatgagaccaattcttaaaaaaaaaatcaagctgaagtcaaagaagcttaataaaaatgtaaatcctctttcaact

SEQ ID NO: 10983 - DNA, 201 bp, Homo sapiens
tgagatgacctaaattgcataaacggatctgagtctttgtacctcccgtgcccatccaaacatccagtcaccatatgaggccacacccattgactgaatcyggttctggagagggactgaggtttggtgcaagttgtccgcagccaggacttccaacatctggaggatgagcaccctaatcttgaaggctgaattcagtag

SEQ ID NO: 10984 - DNA, 201 bp, Homo sapiens
tgaaggctgaattcagtagcacatccactgcaactgaatatctgattcaaggccaaaaattgtggagctcagagccacaacgggcttctgatcttccacasgctgctgaatgcccctggcagtccactgaagtgataatgttaaggaaggaaatgattagaagtaatttgctgagggatcagagttgcatttggagctatc

SEQ ID NO: 10985 - DNA, 201 bp, Homo sapiens
aactttctgtgttgcaaaccttgttgtggctccccctgtgtaaaaaccttttagtgtttctcatctccatgaatcactaatccatggtgcttagtagcatstcaaaggcccttccgaatctatctctagcctacctctgtggaccttatctcttggctctcccacctgcccccacccacacctctaccccttgctttttgc

SEQ ID NO: 10986 - DNA, 201 bp, Homo sapiens
tcagattgatacatcatgttgttaagacccccatctgtctctagggtagtagaaaagatgcagctacggaagagaacagaactgtgctcctgaacatggcrtggctgccgaacctcacagataatcctgaagcaggcaatctctgcagacttctggggtgatttgagcatgtgtagcttttgctggcagctgagagaaatg

SEQ ID NO: 10987 - DNA, 201 bp, Homo sapiens
tacatcatgttgttaagacccccatctgtctctagggtagtagaaaagatgcagctacggaagagaacagaactgtgctcctgaacatggcatggctgcckaacctcacagataatcctgaagcaggcaatctctgcagacttctggggtgatttgagcatgtgtagcttttgctggcagctgagagaaatgggaagtccc

SEQ ID NO: 10988 - DNA, 201 bp, Homo sapiens
tattgcctctggctggaaaaactcgggtaggtgcaaggtgtccaccagcattttctcctgggatcgggctgctgccagctctggcactttgcctgggactrtagccttgtctggactcccctttccctctgcgtgggagtgcttccttatcaatcatttgccctcgaatccatgtcttaggatctgcttatgggttggact

SEQ ID NO: 10989 - DNA, 201 bp, Homo sapiens
tgccttgtttcctaaattgtgtttgataaagtgcttaataagggcggcttccaaagtggttccaggtaaagaagtactaaaaaggcctctttattaatgtrtggattttctgtcactgatgtttgtctgcctatgaatagtttagactagatttttcaagtaagcactttataatatctgtaactctttctaggtgtttta

SEQ ID NO: 10990 - DNA, 201 bp, Homo sapiens
aaagcattaaattttgaggtttaagtagacattaaacatttataatttaatatacatttaataaaattaatatttatgaacacatttgccttgggaattaraagtggaaaacagtgtcatttacttgctaatggccaccacggtgccatgcagttacagatttgatggcctgcatcccagtgacattgctccaagaccaga

SEQ ID NO: 10991 - DNA, 201 bp, Homo sapiens
aagtggatggttttagcatttaccctatggaagcttatagcctggatggcaagatcaaattaacatgagaaggcagtttggtgtaatggttaagagccttyggattcagccaaggcagaaagtgatttgaattctaattgagcccctttttagctgtacaactttgtaaaagccctttaccttctatacctcagttttctt

SEQ ID NO: 10992 - DNA, 201 bp, Homo sapiens
tgaagtcgaagaaatgcttaggttaacccaacaactctgataattgaccaatgtggcaagggccattctgttccaaaaataattaacaatatgatcagtastgaattaatgttgttacggattataggtttcaaattttcccttgttaggaaaatcaccttttaaataatctcatagggttttgaacaaagagcacagtgt

SEQ ID NO: 10993 - DNA, 201 bp, Homo sapiens
ccaccgcacccggctaatttgtttgtatttttagtagagacggggtttcaccgtgttagccaggatggtctcgatctcctgacctcgtgatctgcccgcckcggcctcccaaagtgctgggattacaggcgtgagccaccacacccgaccgacaaacagaaaatcttagaggggcatcaaagcaaatcatatggatggaga

SEQ ID NO: 10994 - DNA, 201 bp, Homo sapiens
tgttcatggggagtttgtgcatatgatttatcagaaagagctgcttctaccagggctcataataataatggttcccctgaactggatgctaaatttatcamctggttattttgggcttctcttgccagtaagcctatagaaaacaaaaacaaaaacttttgctataaccttgattattcagagaaaataaggtttctgcta

SEQ ID NO: 10995 - DNA, 201 bp, Homo sapiens
ataagcaacagcataaaggactttgagaaatcaacagatcttatttttaaaaatgaattttcttaaacatgtattcactcagctggcagtggtggctcatrcctgtaatcccagcaattttagaggctgaggcgggcagatcacgaggtcaagagatcaagaccatcctggccaacatggtgaaaccccgtctctactaaa

SEQ ID NO: 10996 - DNA, 201 bp, Homo sapiens
tctactaaaaatacaaaaattacccgggtgtggtgacacacacctgtagtcccagctactcgggaggctgaggcaggagaatcacttgaacccgggagtcrgaggttgcagtgagccgagatcacgccactgcactccagcctggtgacagagcaagaccccatctcaaaaaaaaaaagaaagaaagaaaaaaagaaaaaa

SEQ ID NO: 10997 - DNA, 201 bp, Homo sapiens
gcaaacatctgggggaagaggaaagagcaagtgcaaagatcccaaagccacagagatgtttatgtgctgggagaacagaagaaatcccagtgcttgtagtkcagtgagcaaaaggaagtatgaggccaggtaaagtaagaaaggttggcaagggtcagatcatggagggcctttggggctgttgtaaagagtttcatttca

SEQ ID NO: 10998 - DNA, 201 bp, Homo sapiens
gataacttcttcataatgaactcttgtgtgcataagcatttcttttcctgttaagaagcagtggacaatttttttgttttaaagacattctagaagatttwaaaaaattattgtggtaagaacacctaactgtgagatctatcttcttaatagatttctaagtgtacaatacagtattagtaactgtagacattatgttgt

SEQ ID NO: 10999 - DNA, 201 bp, Homo sapiens
gaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaacc

SEQ ID NO: 11000 - DNA, 201 bp, Homo sapiens
agtttgagaccagcctggccaacatggcgaaaatataaaagttatctctactaaaattataaaagttagctgagcatgagggcacatgcctgtaatcccasctacttgggaggctgaggcacgagaatcacttgaacttgagagacagaggttgcagtgggccgggctcacgccactgcactccagcctgggcaacagagt

SEQ ID NO: 11001 - DNA, 201 bp, Homo sapiens
taagacagagtctcgctctgtcaccaggctggagtgcagtggcgtgatctcggctcactgcaacctctgcctcccaggttcaagcgattctgttgcctcarccttccaagaagctgggactacaggtgcatgccaccaagcccagttaatttttgtatttttagtagagacggggtttcaccatgttggccacgatggtct

SEQ ID NO: 11002 - DNA, 201 bp, Homo sapiens
tttcaagatagagacagaggatgtgctgcgccgatagaataatgaaagtctcctatagtcaaaaaacaaacaaataaacttgaggcagattcttcacttcraggtgctcaccataaaatggcaatactaaactatttctagaactctatatagagtgcctgttagttattttgatcctgttacaactctttcagatgatga

SEQ ID NO: 11003 - DNA, 201 bp, Homo sapiens
ttaggttaaatctgagatgcacttatctatttatttttacaaaaacaatttgcaatgtgatttagaaatggaggagtaacataaaacaatttgactaaaawtgggtgtgattttcttatctgagactgccaaaaattcaccaaagaaaaatcattcaaatgtctttgtggttaggtttcttttataaattgaaagttgtgt

SEQ ID NO: 11004 - DNA, 201 bp, Homo sapiens
gaatttgagtgtgtccgtggaagctttatttttaggtcaattttagcgtctacagcattgcgtattctaccactaatcatctttttccttagcggaagtaycctgaaatttgatgagtaaaaatgactttcttttatatttttgtgatataacagcttctaaagtaatgtgtttctgaaaatgtcattacccctaagactt

SEQ ID NO: 11005 - DNA, 201 bp, Homo sapiens
gtatatataaggtaacacagcaatggaacatcgcaatagttggcatcagatttgcaaatggcacaattatttgtttcctcttcactggtccttgaaaaatwcataatgttcccatcaaaagttccagccaagcatatttgtaagaacagggtttgaacataacctattatatcatgaagaatggctctcttccatggtatt

SEQ ID NO: 11006 - DNA, 201 bp, Homo sapiens
gtaaaataataaatttaactctcagatttcccctgggagatgcttccaaaacttgttccattttaacatcaatagaattatttgagggaaggctattttgwtatatatatatacacacatatatgtatatatatatataaaaaaatacatgaatgagaaaaaattatattcctcattctcttaaagaaacgatagatcact

SEQ ID NO: 11007 - DNA, 201 bp, Homo sapiens
atttaactctcagatttcccctgggagatgcttccaaaacttgttccattttaacatcaatagaattatttgagggaaggctattttgatatatatatatmcacacatatatgtatatatatatataaaaaaatacatgaatgagaaaaaattatattcctcattctcttaaagaaacgatagatcactcacttaattagc

SEQ ID NO: 11008 - DNA, 201 bp, Homo sapiens
tcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatg

SEQ ID NO: 11009 - DNA, 201 bp, Homo sapiens
gtgtcctagattgagtaactggggcaaatgaagaaagggtcaccaagacagttgagtgctatgagcacttttcttcttttatgtatgtattttaagttcargggtacaagtgcaggtttgtaggcttgttacataggtaaactcgtgtcatgggggtttgttgtacagattatttcatcgcccaggtattaagcttaatat

SEQ ID NO: 11010 - DNA, 201 bp, Homo sapiens
aaaaagacatcctattaatttctttctctctgtatgtaatttacagtaaatcctcttggattcattttttaattatgagcctttcaggaacagtgaaaatktatgtgttaagatatctgttttgtttgacaagaatctataaccttccccaactatttccttcctgacttaaaatgtagattgttacatacacgaggatga

SEQ ID NO: 11011 - DNA, 201 bp, Homo sapiens
aaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaaga

SEQ ID NO: 11012 - DNA, 201 bp, Homo sapiens
atctggtacatagtggatgttccattaatgatagccatgttcttgtgttttcttcccaggtactttagggacatagtgtagaagatttgagttttataccratgatcgattgtttctgaaagcaaaaggaagacatttaaagatttttttagaagaagatgaaatgcccagcacttaatttttagggagattattttggct

SEQ ID NO: 11013 - DNA, 201 bp, Homo sapiens
gcaggtgttgtcagcaggttggattaaaaaggagagaactgagaaatgtctagattgggaaggttgtgatttcattaccaaaaacaaaacaggggacagayaagtaaaacagataagagtttgactttagtgatgcaaaacataaggcatccaagagccaggctattgaaatttccaattggaaatacatgatgaactcag

SEQ ID NO: 11014 - DNA, 201 bp, Homo sapiens
agtgacagtggaaggtttaaggagtgctaatgtctcaagggagatgaataggaacttgggaaatatatacatatttttatatatttaaatatatattattktatatatttatacaaatatatataatgtatattaaatatatacatatacaagataaaggaggaaaggaagagaactaaaaaggaaaggctagagggtagg

SEQ ID NO: 11015 - DNA, 201 bp, Homo sapiens
tcccttggtctgttagcttctaatgtctagcagcagagtatagtaaatacttgaaaggtagaccttcacactgaaaatcacatttattgaagtgggagcarattccatttaaattgtcccttacctgatgcctaattcctaaggttaacaggttttcatgtttgctacttatatcagcagtactggagctggtttttttgc

SEQ ID NO: 11016 - DNA, 201 bp, Homo sapiens
ttagcttctaatgtctagcagcagagtatagtaaatacttgaaaggtagaccttcacactgaaaatcacatttattgaagtgggagcagattccatttaawttgtcccttacctgatgcctaattcctaaggttaacaggttttcatgtttgctacttatatcagcagtactggagctggtttttttgcatggctaaacag

SEQ ID NO: 11017 - DNA, 201 bp, Homo sapiens
cttatatcagcagtactggagctggtttttttgcatggctaaacagcaaagcttaaattcaatactagagcgtgaaagaggaaaatgagttttggtgtgaygtgtgaatgacgtggttttcctaaataccatgaatgcacaatgaatgatccacaaagcacagccgcctcttaaaagaagacaaaaatctccctgaggttt

SEQ ID NO: 11018 - DNA, 201 bp, Homo sapiens
cactctcaggtatttctttatatcaatgccagaaaggactaatacacttactttcgtgaaaacaacttttctcttaaccacctcctactgtctgtcaagtrtagttctaagtgcttgggatccaagagtgaaaaggatagacaaactccctgtcctcatggtacttacattctagtgggggagtccttaatgggcacaagc

SEQ ID NO: 11019 - DNA, 201 bp, Homo sapiens
tctcttaaccacctcctactgtctgtcaagtatagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagtt

SEQ ID NO: 11020 - DNA, 201 bp, Homo sapiens
ccaccttcacatactcagtctatcattaaccaaaatgtcactgtgttgctcatgactgtaatcaaaaaagcacagagagctctctcgctatctggttctayttctaccaccctgacaaccactatagtttgttttcaacaccaaaagaaaataacaaaaaaatagcatcttcaccctcgattctagtttcttttttcttga

SEQ ID NO: 11021 - DNA, 201 bp, Homo sapiens
gtgaggtgtttggtataaacagtatattaacaaagaattctcctatggtataaaccctaactctagcaggaagatcaaatttctctttgaggcatgcagtytgagctccagtgactctctgcaagagaaaagctgatattgtcacattgtgagtcatagtgactcccaaggatgtatttgtgtggatgtggttggtcagaa

SEQ ID NO: 11022 - DNA, 201 bp, Homo sapiens
aggcattttcctacccgctttacaaaaacagacaccgaggcccatgtttagggccaaaatcagtgctgaatgccaggacagactcccaattcagtgtctcrtatcaaactgcatttcctttcaagatgaaaattgttactcaaaaccctatgcagctgggcgggaacacagattccatggtttcctttttcttcctgtttc

SEQ ID NO: 11023 - DNA, 201 bp, Homo sapiens
ccccaaagcaaagcatctcctctctttgcatgggggatctatccctccagaagtctacccagcctgaggataatggcagctgcagggttacaggggtaacygtccatctgtctgaattctcagttgtgtgagagcctgtgttacaaccttagtagcttctgcacctcactagcttttcccactcccttggagtgcttccat

SEQ ID NO: 11024 - DNA, 201 bp, Homo sapiens
ccttacccatcagtactttagggttataatctatatcttgcaggcatgttatgaaaattaaatatgatcacatatgcagtgtgcataacatcatgtttggyacatagtagcctgtcattattttggaaaagtgaccataatgaaagagaatgcatcaaatatataggattgttaaataacaatgtccaatttagaagctga

SEQ ID NO: 11025 - DNA, 201 bp, Homo sapiens
gcacaccttgctcctgactgagaaggaaaaaatctttgtggagtttgcacaggtataccaagtaattgagcatttgcattagtatggaaccacctactacwgacaccgggctcgtttcactcaaaggatagcctagaataagcatgaaggacctcctttcagaatcttgtttatgtaaagcccttcttggatttcctcttt

SEQ ID NO: 11026 - DNA, 201 bp, Homo sapiens
ggtacaaactcaattcaaatattctatgagaataaaaacaggcttatacccaaagataggcaataacaaatgctggtgataacatggagaaaagggaaccmctgaacactgttggttggaatgtaaattagtacaatcactatagagaacagtttggaggttcctcaaaaactaaaaaattgagctaccatatgatctatc

SEQ ID NO: 11027 - DNA, 201 bp, Homo sapiens
aaaacatccttcaaacgaagtggctattttgttgcaaaaaataactattacttctcaagcactgactgagtgccagggtgtatatgtatgtgagtatgtgygtgtgtgtgttttgttctgttttttctcttgtaaatccgtcaaagattgcaaaggtaggaactattatcctgatttttcaagtcagaatccaaaatttag

SEQ ID NO: 11028 - DNA, 201 bp, Homo sapiens
tttgcagaaaagttgtaaagattatatagtttctttaaacccttcactgagcttccactaacgttaaaatattatgtaaccgtgatacatggtttgaaacyaagaaattaacatctgtacaatacaatttgctcagataatcccagtttttccactactgtcctttgtatgtgtcagaatccaatccaggataccacattt

SEQ ID NO: 11029 - DNA, 201 bp, Homo sapiens
gtattccagagaagatttcaatatacagtagttcactgtcctgggaccaagaagaggtacaattaaccatgttgcctatgctgctggtgatgaagccagarcgtaaacagaatgatttatcctcactcctttgttcgtgaacaaaggaaccataatcccccatgaaccattctggcctctttactatcctccagacaggtt

SEQ ID NO: 11030 - DNA, 201 bp, Homo sapiens
ctttctagttttctctgacactctcactccctgccaatcttttctcctcaaagaagccagaatggtattttttaaaaaatataatcagcctttattaccarccacccccaattaaaatcctcatgtagctttatattatattaccaatccaatctaagtgcattaccaaagctttgaagaccctgtttgatcctacctctc

SEQ ID NO: 11031 - DNA, 201 bp, Homo sapiens
aaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtc

SEQ ID NO: 11032 - DNA, 201 bp, Homo sapiens
atccacttactctctccagtgcctgaaacttctcaaggagcttgtgctctcctttgctcctctcttttcaaccaatctgaaaatgcttttaaaagataatktctgttttccagtgcagtcttctcacttggcatgtaatttctccatttttatttcctttgtgaatatcaaggtacaatttccatagctaccagtctaacc

SEQ ID NO: 11033 - DNA, 201 bp, Homo sapiens
ttgggacactgtaatattttagccctgattttgccctttttatagtgtccatagataatttaacttctttgtataaacttccattataaaatgaagttttwtatatatatatatgtatatatatatatatatataaaacattacacatttaggacatttcatgatgaaataaaagtgtttcaaatagaaaatgatggttta

SEQ ID NO: 11034 - DNA, 201 bp, Homo sapiens
tattttagccctgattttgccctttttatagtgtccatagataatttaacttctttgtataaacttccattataaaatgaagttttttatatatatatatrtatatatatatatatatataaaacattacacatttaggacatttcatgatgaaataaaagtgtttcaaatagaaaatgatggtttatttgggtttataaa

SEQ ID NO: 11035 - DNA, 201 bp, Homo sapiens
gatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaagg

SEQ ID NO: 11036 - DNA, 201 bp, Homo sapiens
gaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcag

SEQ ID NO: 11037 - DNA, 201 bp, Homo sapiens
gtggtatgtggaagtcaaatgactgcttctctttaaaaagtgttggaatgatgcgttttctctcaccgattctgtctagggggtaatgtgctagggtgcartaagttaagtgttagtcacatatttgcagggttaaatcttagttccacagctgactcactgcacactctaggcagaattatttaactccttcagtctttg

SEQ ID NO: 11038 - DNA, 201 bp, Homo sapiens
ccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgca

SEQ ID NO: 11039 - DNA, 201 bp, Homo sapiens
cttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcactttta

SEQ ID NO: 11040 - DNA, 201 bp, Homo sapiens
attcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaat

SEQ ID NO: 11041 - DNA, 201 bp, Homo sapiens
ctatatgcaaaataggtctttacaggcaaatttacattctatcacagaaacagtgactatcagataaccaactcccttctcaattcttttttttggcttgktttcttgcttacttgcttggttgctttctctctttcctagctgaatagcattacaggccacttctaaaataaactgggttgtggaatttccactgaaggc

SEQ ID NO: 11042 - DNA, 201 bp, Homo sapiens
ccttcaaaatgaagacccaaagatacaggagaaattgttcatttttatgcttaggttcaaccaagtgtggacatctgtgtagaaatatgattggacaaaawgggtatgatctaatggtaatggactgaggcagaaaacccagcgaggcctggccgtgtagactcttcttggcctctctgagcccacattcctttttttctg

SEQ ID NO: 11043 - DNA, 201 bp, Homo sapiens
ttagccgggcatggtggcagaagcctgtaatcctagctactcgggaggctgaggcaggagaatcatttgaaccggggtggcagaggttgcagtgagctgaratggagccactgcactccagcctgggcgacagagtgagactctgtctcaaaaaaaaaaaaaaaaaaaaaaagactgctttaggatttaaggaagagtagt

SEQ ID NO: 11044 - DNA, 201 bp, Homo sapiens
aaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaacaggatgaaggtgaagttctcagcttgatatttttgtt

SEQ ID NO: 11045 - DNA, 201 bp, Homo sapiens
atcaacttaatatattaaaagaggttttatatctaaagcatccaacacagtgtctggcctagaggaggcactatatctatagaacaaataaacgaatgttsgaacatagcctctctaaattctatttgaatgacttaacacaaagatcagaaatttgcatagctgtttgtgttagccctttaaaacaaaactctcctaggg

SEQ ID NO: 11046 - DNA, 201 bp, Homo sapiens
tacctgttatacattgagcacatgctatataccaggcattctatatactttatcatctttaaccctcagagcaatcatgtggtgaaaggtatccatcagtrtcacttgaggaaactgaagctcacggaggtaaaattgaacagctactaagtgatgatgccaaggatttaacacaccctaggtttgtctgactaggaactt

SEQ ID NO: 11047 - DNA, 201 bp, Homo sapiens
atctttaaccctcagagcaatcatgtggtgaaaggtatccatcagtatcacttgaggaaactgaagctcacggaggtaaaattgaacagctactaagtgaygatgccaaggatttaacacaccctaggtttgtctgactaggaacttctggtctctccaggacacaacagagccttctaaggcaggtttactgtgttgagt

SEQ ID NO: 11048 - DNA, 201 bp, Homo sapiens
tgtattcagttacgtgttggagtgctatcgagagcccagtgggattataggtggaataagataccttcaacacagccatctgctgcatatggtgacccttstgctctccaaatgagcagaagctcaaccagctttgctgaaatgtgtttgatgagaggatggtgtgttttacttttgtgacatctttccccagaggtggtt

SEQ ID NO: 11049 - DNA, 201 bp, Homo sapiens
tgacatctttccccagaggtggttgcctaaagagttgaactttagagaacaaaaagaaagaaatgtaggatccatttatggtctctcctagaatcatgccrtatgttggactctatatggaaagggaggaggaataaaatgaagaaagaggagtacacagagcatggaaaaccataagtacgtgtgatccatgattacgtc

SEQ ID NO: 11050 - DNA, 201 bp, Homo sapiens
ccgtatgttggactctatatggaaagggaggaggaataaaatgaagaaagaggagtacacagagcatggaaaaccataagtacgtgtgatccatgattacrtcattgcaccttgcaaaaacttgttgattttagctctggggaggatgagtgaaaatcatggagtcagagcagaatcatgaaaagagattggttttggagc

SEQ ID NO: 11051 - DNA, 201 bp, Homo sapiens
ctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgc

SEQ ID NO: 11052 - DNA, 201 bp, Homo sapiens
tttttttttaatattccctttttttattaattattttttttttaatttaagttccaggatacatgtgcaggatgtgaaggtttatttcgtaggtaaatgcrttccatggtggtttgcagtacctatcaacccatcacctaagtattaagccccgcatgcattaactatttatcctgatgctctctctccttctactcccca

SEQ ID NO: 11053 - DNA, 201 bp, Homo sapiens
gtgtctttatagcaccatgatttataatcctttgggtatatacccactaatgggattgctgggtcaaatggtatttctagttcaagatccctgaggaatcrccacactgacttccacaatggttgaactagtttacagtcccaccaacagtgtcaaagtgttcctatttctccacatcctctccagcacctgttgtttcct

SEQ ID NO: 11054 - DNA, 201 bp, Homo sapiens
tttttcttgtaaatttgtttgagttcattgtagattctggatattagccctttgtcagatgagtagattacagaaattttctcccattttgtaggttgctygttcactctgatggtagtttcttttgctgtgcagaagctctttagtttaattagatcccatttgttagttttggcttttgttgccattgctttttgtgtt

SEQ ID NO: 11055 - DNA, 201 bp, Homo sapiens
tttggcgggtagtagagaaaagaagatgagtttttagaaaaagactcagagttactcagaattaagaaaatgaatccttactgtcaatatgagtctcccamctgctagcgcaagtggtggatagattttcttttccactagatttacttcctgatatacacatttatcactcaagcatggactgttcatcaagtcattttc

SEQ ID NO: 11056 - DNA, 201 bp, Homo sapiens
tctgcttgcaaagaggctgatttgggaaagttcaacagccccacttagttgctctgtgacatcctgacttcctacaggttacttctcatattgttgggtgtttgtttgtttgtttgtttgtttgtttgacagaggtctcactctgtcaccaggctggagtgcagtggcatgatctcggctcactgcaacctcctcctccca

SEQ ID NO: 11057 - DNA, 201 bp, Homo sapiens
ctgcttgcaaagaggctgatttgggaaagttcaacagccccacttagttgctctgtgacatcctgacttcctacaggttacttctcatattgttgggtgtttgtttgtttgtttgtttgtttgtttgacagaggtctcactctgtcaccaggctggagtgcagtggcatgatctcggctcactgcaacctcctcctcccag

SEQ ID NO: 11058 - DNA, 201 bp, Homo sapiens
gggcattcacagtagtccagaggtcccctgcactgtgagtgtgactaaagctcaggaaagtcagaaaggccagccaaggaaggaagatgctggcaagactyggaaagtgcaggagtgtatgagattgaatcacctggacaggggcacccaaacaaaggcgtctgctggctacgtgactttggttaagttgctgaacttctt

SEQ ID NO: 11059 - DNA, 201 bp, Homo sapiens
tggtttcctgtgacatccaggtgacacaccaggtttccactgcttttcgtcattagcccagatgttcccagttacttggacagagagccttgtagatcccygtatatggagtcttccttcccgtggttcattagaaatggcaaagccaaactggcagtattcttcaatttgttgataagagtgcttcagtgcatgtattta

SEQ ID NO: 11060 - DNA, 201 bp, Homo sapiens
tctgtccctgtattaatacattcaggctgctgtagcacaataccttagcgtgagcaaaggaagttaaagaccacctcctccccctgccccctgcaaaaacytagtagttctcagactcattggttcatagaactcattatatatgaaaacccatcaacatccatgtaattagcaaacttaacacacttgaaaatgctacct

SEQ ID NO: 11061 - DNA, 201 bp, Homo sapiens
gttcatagaactcattatatatgaaaacccatcaacatccatgtaattagcaaacttaacacacttgaaaatgctacctttcaagtcagtattcatattargcagactttggagatgttgtggattctgcttcataccaccacaataacgtgattattgccataaagtgagtcacacaaattttttcgtttcccagtgcat

SEQ ID NO: 11062 - DNA, 201 bp, Homo sapiens
gtggcagttgctggaggttggggtggctgtggaaatttcataaaataagacaataataaagtttggtgcatcaactgactcttcctttcatgaaagttttytctgtagcatgtaatgctgtttgatagcattttctaaatttatttcaaaattggagtccatcctctcaaacccagctgctcccttatcaactaagtttat

SEQ ID NO: 11063 - DNA, 201 bp, Homo sapiens
ttcttagccttcatagacttgaagagagctagggccttgttctgggttaggctttggcttaaggaaagattgaggctggttggatattctgtccagacaaytaaaactttctcatgtcagcaatcaggctgttttgctttcttatcatttgagtcttcactagagtaggactttcacttttctttaagaactttttctttg

SEQ ID NO: 11064 - DNA, 201 bp, Homo sapiens
aattcaaaatataaaaatgatttcatttaaaatgaaaaaagataatgaaaaattacagattttaagaagttggtaaatatcaccgaaatggataaattaayttactatttgcaactaactgcttgacattcttctataacacttttttctataaaattaataatgttcgctatgaatgccttttcatgtgaaaattctgta

SEQ ID NO: 11065 - DNA, 201 bp, Homo sapiens
taacggtaggattttttccgttacagtgcactgtgtcaaaatttggtctcgttaaataaattcctattctatcagggatgagcttcccacaaataatgttaaaaaaaaaaaaaaaggagaaagcatgataaaccttttttcctgtttctcttcttctaaccacagggtgcactatggcagttgcagggcttggtaattgaa

SEQ ID NO: 11066 - DNA, 201 bp, Homo sapiens
gctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaa

SEQ ID NO: 11067 - DNA, 201 bp, Homo sapiens
tgtatatatacatatacacatgtgtgtgtatacatatacgcacacatgtgtatatacatatacacacacatgtgtgtgtatatatatatacatatgtgtgygtatatgtatacacacacacatatgtatatatatgtaatgctaacaaaaaataatttgaatgattgccaggggtccccaagaatgagctttttcttttaa

SEQ ID NO: 11068 - DNA, 201 bp, Homo sapiens
gtaacccattttatcagttgtgctgtcttccactgctgttctctatattccatcagaggaaacaaatggcttctattgtgcataagaatgccatttagtcmcaagcaccatttgaaatggaaatgaggagtaacagtaacagaagaacattggctaataattgtgctctgaatagccatttggccatgtgggcagggtaaa

SEQ ID NO: 11069 - DNA, 201 bp, Homo sapiens
gaatgagcaacgtgtgtgtgtgtgtgtgtgtgtgtgtgtgagagagagagagagagagacagagagacagagagaggcatgatcttggctccctgcaaccyccgtctcccgggttcaagtgattctcatgcctcagcctcctgagtagctgggattacaggtgcccgccaccacacctggctaatttttgtattttttgta

SEQ ID NO: 11070 - DNA, 201 bp, Homo sapiens
tctgcaaataatatataaattagaaatatttggaatgtttagtttatttgctaaagctcttcagaactataaattacaatattaatgaacttatttttaaktcccatcactttcatttttatagaatccagaaataatgcatgtaacttgccattcctccccattagtacacttgagtccaaaggagaggttcacagcatc

SEQ ID NO: 11071 - DNA, 201 bp, Homo sapiens
tcacaaagcaattaagtacctaattgttcatggctctgagtttgctactgaaacagaaaacttcttaggcttgctaagaaaacttcttaggcttctaagcmctcctggggcttggaatccaagaattcagtagaagacggaagcgtggtaaggagaacaagaactgaagacataaacaaatttatttgaaatatggttgca

SEQ ID NO: 11072 - DNA, 201 bp, Homo sapiens
atggttttataaatgggggttcccctgcacgagctatcttgcctgctgccatgactttgctcctcattcaccttccatcatgatagtgaggcctcccaagscttgtggaactgtgagtccattaaacctgtttttctttatcaattacccggtctcagatatgtctttattagcaccatgagaacagacaaatacactgtt

SEQ ID NO: 11073 - DNA, 201 bp, Homo sapiens
actggaacattacaaacttactccttcaacgaatgcatgtagccaatctatgtgtgatgggactgataatataaccaggagctctccaaattatcattcaygtagaatacaatggtttttaaataatcggtaatagaagttattaatttgaggcttacatatgaatctgaaatgcaacaatgtctgtagaaattgtttaga

SEQ ID NO: 11074 - DNA, 201 bp, Homo sapiens
gtgtgatgggactgataatataaccaggagctctccaaattatcattcatgtagaatacaatggtttttaaataatcggtaatagaagttattaatttgargcttacatatgaatctgaaatgcaacaatgtctgtagaaattgtttagaattttgacaagatttgtttgtggatggagtttctttttaaaagattgatat

SEQ ID NO: 11075 - DNA, 201 bp, Homo sapiens
attgatttcttttcctttggataaaaattcaatagtgggattgctggtggatggagtattttatcactgacattgtttagaattgtgaagggaaagcagarttaaattttctgtctctttaaactcagtcatcttttctctatagcacaaaagattatgttttttttttttttttcataactcagcatctttgtgagctat

SEQ ID NO: 11076 - DNA, 201 bp, Homo sapiens
gtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcat

SEQ ID NO: 11077 - DNA, 201 bp, Homo sapiens
tagagatggggtttcaccatgttggccaggatggtcttgatctcttgatctcgtgatctgcccgcctcagcctcccaaagtgctgggattacatgcatgartccccactggatttgatctttacaaattaatattagcacttgttaactaaaggaatgaagaaataagtgaaagaatgaaggaataaatacataacaacat

SEQ ID NO: 11078 - DNA, 201 bp, Homo sapiens
gtgtcttaacattgctaagaaaagaaacacacttgccccctttttgcagaagtaagctcctttagtgattttcatctcattttcttctatacttttttttkatatttgttgtgagcacgatcttctcttttttaataaattcatatttttcaattatttttattattaaggtaagaagtgtgcttttgttggtggaggaag

SEQ ID NO: 11079 - DNA, 201 bp, Homo sapiens
agaatcgcctgaacccgggaggcggaggttgcagtgagcggagattgtgccactgcactccagcctggcgacagagcgagactccatcttaaaaaaaaaamaaaaaaaaaaaaaaccaactttgataaataaaatataactctaactctagatagggaccgaatgggggtataatgtttgtttaagtttttgggagacact

SEQ ID NO: 11080 - DNA, 201 bp, Homo sapiens
gcctgtccatgaactcgtccaaagcaaatatgctttgagttttcatgtctgttttttaatttttgtggatacacagtaggtgtaaatatttgtggggtacrtgagatgttttggtataggcaagcaatgcatactaatcacatcatggaagatagatagggtatccatcccctcaagcatttattctttgtgctaacaaac

SEQ ID NO: 11081 - DNA, 201 bp, Homo sapiens
tttctaaggtctctcagaaccttagctccaacaaaacccccttctttttctctcattataacacaaatttcctgtgaatatcaatgaagcaaacagatacrgtgggagctcgtgaaagacaaaggacaccgagctagtattttcattaacaacatgggctcttgtactgtcaaccaacaagagctttgttataaatttatt

SEQ ID NO: 11082 - DNA, 201 bp, Homo sapiens
attatgattgtcactagctcactctgagccatggctctacattttatccttgtcaataagcaatccagtgttaggattttaaaaattgtttaaaatatccrtacaaagagttattttctatcttggtccacaaatttgtcaatattttccacagcatcacaattgtcagaaaacacagtgaagcttaagttaaaacaaatc

SEQ ID NO: 11083 - DNA, 201 bp, Homo sapiens
catttcatgatagacccgatttcttacactgaaattcattttaatgtttggattgagcaatggtttgctttggtcttaacttttatttattgaggtataahttacatacaatgaaaatctcaaatcttacatctactgttcaatgagttttgacaaatgcataccattgtggactccatccacatccctataacaaagcag

SEQ ID NO: 11084 - DNA, 201 bp, Homo sapiens
caatttctactgatagttaagatcaattaaccaattagttacccattttcatttttcctgtatattctttgtagatcacttactaaaatgattttctaagrccttcactttcttaagtaaagaaaaacaatttgactgagacttggccatttagctaaaatctaaaagacctatttaatttaaagtataagtcaagcagag

SEQ ID NO: 11085 - DNA, 201 bp, Homo sapiens
ttctgtccataaataataagaatgattgtttttcgctaagtggaaaaagtgagatgaggcaagaagttgaagaatgcctagccaggtagcatatgaagccyacaagtttccagctgtgggtctgatgaaaaataatgagacatctgatggaacttaggatcttatttgaaaaataagccatcaagtactttaactttctgg

SEQ ID NO: 11086 - DNA, 201 bp, Homo sapiens
gtctgatgaaaaataatgagacatctgatggaacttaggatcttatttgaaaaataagccatcaagtactttaactttctggtatttcaaaagtaaaaacrtatactaatcacttgtttttatttcacttatttgacactacacatctgtcttagtacaaactcatgtttatgcaatgagatttattagactgatagttca

SEQ ID NO: 11087 - DNA, 201 bp, Homo sapiens
aaacaatgggagtataaaggtattttagaacgtatttgtatatgttaaaacaacagcatattaaaaatttaccttgagaaggccgggtgtggtggctcacrcctgtaatcccagcactttgggaggccgaggcgtgcggatcaccaggtcaggagatcgagaccatcctggctaacacggtgaagccctgtctctactaaa

SEQ ID NO: 11088 - DNA, 201 bp, Homo sapiens
tcaggagatcgagaccatcctggctaacacggtgaagccctgtctctactaaaaatacaaaaaaattagccgggcgtggtggcgggcgcctgtagtcccasgtactcgggaggctgaggcgggagaatggcgtgaacccgggaggcagagcttgcagtgagccaagatggcgccactgcactccagcctgcactacggagc

SEQ ID NO: 11089 - DNA, 201 bp, Homo sapiens
tactaaaaatacaaaaaaattagccgggcgtggtggcgggcgcctgtagtcccaggtactcgggaggctgaggcgggagaatggcgtgaacccgggaggcrgagcttgcagtgagccaagatggcgccactgcactccagcctgcactacggagcgagactccgtctcaaaaaaaaaaaaaaaaaaaaaattaccttgaga

SEQ ID NO: 11090 - DNA, 201 bp, Homo sapiens
aattagccgggcgtggtggcgggcgcctgtagtcccaggtactcgggaggctgaggcgggagaatggcgtgaacccgggaggcagagcttgcagtgagccragatggcgccactgcactccagcctgcactacggagcgagactccgtctcaaaaaaaaaaaaaaaaaaaaaattaccttgagaaaaacaagcaaacacat

SEQ ID NO: 11091 - DNA, 201 bp, Homo sapiens
tatttcatgcatacctcagctgaaaattggcagttatgtattagtgcttgattttctagaccagtattaaaattaccttccaaaaatgtttcagttgcagmaagtattggtggccaacaggtcttccatgagtcgggacacattagccagtgtcaccctttctctagccagtcagttctatgagaatggtattggaagaac

SEQ ID NO: 11092 - DNA, 201 bp, Homo sapiens
ggatgggaagcagtgcagactctcatgtatgaatagctccaattctcaaaaaattcttttagttaactgctgtctgtcttcttctacattgcactcaagcytaactctgcacttttaaaatcaacatataaattataactttctctcctatgataacttttcaaatgttttttgacatctattcagtaccgagctcccttt

SEQ ID NO: 11093 - DNA, 201 bp, Homo sapiens
tcttaacaatcttcttcatcagggattagattcttgtttttttctttgttgccttttttttttttttttttttttgagatggagtctcactctgtcaccasgctggagtgcagtggcgcaatcttggctcactgcaacctccgactccgtggttcaagcgattctcctgcctcagcctcctgaaagctgagatcacaggta

SEQ ID NO: 11094 - DNA, 201 bp, Homo sapiens
tatatgagaaagacaaaactactctttctatcctgtactgtaatcctacctgacaaatatatccttcatgctccttgtcattttgagcaaatagcctgagyttacctcactttcatttgaacttcctccctctttattgccaaggtactacgttcctttatctctgtgcctgaacaagccccccttgctataatcttcatg

SEQ ID NO: 11095 - DNA, 201 bp, Homo sapiens
tgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatct

SEQ ID NO: 11096 - DNA, 201 bp, Homo sapiens
gaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatcta

SEQ ID NO: 11097 - DNA, 201 bp, Homo sapiens
aactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctac

SEQ ID NO: 11098 - DNA, 201 bp, Homo sapiens
actgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctact

SEQ ID NO: 11099 - DNA, 201 bp, Homo sapiens
ctgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctactt

SEQ ID NO: 11100 - DNA, 201 bp, Homo sapiens
cttctgcacatgttctttatcctaggaagcaaaatatttattccttttcctgcattctttaatacctagtttatgcatgtctcattgcacttattctaatmggagcttgttcttgtcattttttttcatatttttttccttttgtgggggagtttaggacccaagtctttgtcctcttttggtttaactagtaccttgcac

SEQ ID NO: 11101 - DNA, 201 bp, Homo sapiens
cagctctgtcacccaggctggaatgcagtggcatgctgttggctcactgcaaactccacctcccaggttcaagcgattctcctgcctcagcctcccgagtrgctggaattacaggtccccaccaccacgcccagataaatttttttttgtatttttagtagagacggggtttcactgtgttggccaggctggtcttaaact

SEQ ID NO: 11102 - DNA, 201 bp, Homo sapiens
gagtggctggaattacaggtccccaccaccacgcccagataaatttttttttgtatttttagtagagacggggtttcactgtgttggccaggctggtcttraactcctgacttcatgatctgcccgcctcggcctcccaaggtgctgggattacaagtgtgagccaccgcgccctgccagaacaatcctattttctaattg

SEQ ID NO: 11103 - DNA, 201 bp, Homo sapiens
ctgggattacaagtgtgagccaccgcgccctgccagaacaatcctattttctaattggggtttttctttgttttttgtttctttgtttgtttgtttgagayggagtttcactctgtcaccgaggctggagtgcagtggtgtgatctcagctcactacaaactctgcctcctgggttcaagcaattctcatgccttagcctc

SEQ ID NO: 11104 - DNA, 201 bp, Homo sapiens
gcccggctgctcttgaactcctgacctcaggtgatctgcctacctcggcctcccaaagtgctgggattataggcatgaaccactgcgcctggccgatactrcagttttgatggccatcactggtacaacaccctgcgtatgccaagactgtcatgccttgtcagctataataaaaagcaggagacaaatggccttttgtta

SEQ ID NO: 11105 - DNA, 201 bp, Homo sapiens
tctctttgtttgaggattggaaagcctccaaaaacccactcaggagggaaattaacaaatgtctgttttgttacctccggataaatcttcatgatgaaatrtgcagccggtccacctcttcaatcttctctcttcttcttcctcagtggaagctcaattaccatgaaggccaaaataaataaataaataaacaacaaacca

SEQ ID NO: 11106 - DNA, 201 bp, Homo sapiens
ctttcatagcttgtaacttttcattgatcatcaactttactgatttttgttaatactggaaattttaataaatgggttgtgcacaggtacttattgagcayctattacgtgccatagaatattctgattattaaggatgtcaaggtatataatccagagtcacggttttcaaggaactcagtcaataattacaagctaata

SEQ ID NO: 11107 - DNA, 201 bp, Homo sapiens
gaactgaatttctcagcaaactaacacaagaacagaaaaccaaacaccatgtggtctcactcataagtgggagttgaacaatgagaaaacatggacacagrgaggggaacatcacacactggggcctgtctgggggtaggaggttgggggagggatagcattaggagaaattcctaatgtagattacgggttgatgggtgc

SEQ ID NO: 11108 - DNA, 201 bp, Homo sapiens
aaacatggacacagagaggggaacatcacacactggggcctgtctgggggtaggaggttgggggagggatagcattaggagaaattcctaatgtagattaygggttgatgggtgcagcaaaccaccatggtacttgtatacctaggtaacaaacctgcacgttctgtacatgtatcccagaacttaaagtataaaaatgag

SEQ ID NO: 11109 - DNA, 201 bp, Homo sapiens
ataaaaatgagaaaaaaagatgcacaaatagtgtcacatatagtataataatgatatggatatggcctaattcatagagtcaacattctgatactaagagraaggaaaaatcaaaacaaaataaagaaaaaacaaagcagacagtagcctttaaccgtttccttttaaagaaacattgttatctgggttcattacttgtta

SEQ ID NO: 11110 - DNA, 201 bp, Homo sapiens
caggagaatggcatgaacctgggaggcggagcttgcagtgagctgagatcatgccactgcactccagcctgggcgacagagcgagactccgtgtcaaaaawgaaagatttaatgttggtcaaattatacacaacgattcaacagtactggaagttgaggaggacgagcaagccagatagcaccaatgatcatgaataaatt

SEQ ID NO: 11111 - DNA, 201 bp, Homo sapiens
aacacagtgaggcatgcatctctacataaaaattttacaattagtctagtgtggtggcacatgcctgtagtcccagctactcaggaggctgaggtggatcrcttgagccaggagttcaaggctgcagtgaactaggatcaagccactgcactgcagcctaactgacagagcaaaatcctgtctctaaaataataataattt

SEQ ID NO: 11112 - DNA, 201 bp, Homo sapiens
ggatggatggatagatgaatatcagtatcaaaaggtccatgctttattttctaataacaattcatgtccaattatctgactgccagcacagttatctgctrtggttgttagaaactttagaaagaagtaaatcctccaaaattgtcactcttaaaatctgagagaaaacagaatgaatagataagagatgcttcaaggcag

SEQ ID NO: 11113 - DNA, 201 bp, Homo sapiens
ttccttcgaggagaagcacaaagggaatagaagacccagcatttgttactggccttagataagcttactgttcacttatttatcaatgtaaaaacgcccarttagtttttagctcaaggaagagaggacatggccaaagatggccttcatgaacttttttttttcctgtgtgaagtatggaaactcattttcagtattgga

SEQ ID NO: 11114 - DNA, 201 bp, Homo sapiens
tcattttcagtattggattttgactggattgtcttctacccagaagctggctctgcagaagttatgatcagatctttggaagtaacatttgatctaccgcygaatatagatccccttccttccctcttctactccctccttgcttttccttcttattacactgatttcatgcaaaattaattatcagtcctgtcacatctt

SEQ ID NO: 11115 - DNA, 201 bp, Homo sapiens
gctgcagctgcctagttaggtattgaaatattgtatccacttgcaggtcaaaaaggaaaaaataacaacaacagcaagtggtccatgagagtgaagtggasgtattaaaactaggctgggtcttctcttggaagatgacagactgagtcccacagtgcctcactccattcaaagcaattaggagtgtaggattgcagtgac

SEQ ID NO: 11116 - DNA, 201 bp, Homo sapiens
catccttcttcacatggcagcaggagagggaagtgcagagtgaaggggggaaaagccccgtatagaaccatcagctctcatgagaactcattcactatcamaagaactgcttggggaaccgtccccatgatccagtcacatcccactggttccctcctacaatacgtggggattatgggaactatagttcaagatgagatt

SEQ ID NO: 11117 - DNA, 201 bp, Homo sapiens
aacagaaggattgattagaaggaagccagaactggagcctggaaagttggctacatggctttcacagtaatccaggaaggggatgatggaagagaggctgsagcatgggagcaacagctggagtgaagaagagaggatatgtgtgggaaatctttaaggggtacatttggcacaactaggtgatagacagaagtgatgggt

SEQ ID NO: 11118 - DNA, 201 bp, Homo sapiens
ataatattcctgtttaccagaaatatttctgaccataagactcattatttatttattatggatggtcattttatatatttttaatgcttatttaagactcsggagtacatgtgcaggcttgttacatggatagattgtgtgccactgaaatttggtgtaagaatgatcccctcatcattcttagcatagtagtcaatagtc

SEQ ID NO: 11119 - DNA, 201 bp, Homo sapiens
tcttaaataatatttgtatatggtgagaggtgtaggggtccagtttcaatcttctgcatatggctagctagttatcccagcaatatttgttgaatagtagsgagtcctttccccattgcttgtgaccatgagattttatgtgatgttgaaacccaaaactacccaaaggaattaactactgctggttaattgtacctatat

SEQ ID NO: 11120 - DNA, 201 bp, Homo sapiens
cccaaaactacccaaaggaattaactactgctggttaattgtacctatattaaacactttctttatagtattttccttatttgggggccatctcaaagtcmtaacaatcagaatttgtgtcttctcatatgatttttactcagaattacacagaatacagtattcataaaaatgaaccaaccataaaatatttattcttct

SEQ ID NO: 11121 - DNA, 201 bp, Homo sapiens
ctcagaattacacagaatacagtattcataaaaatgaaccaaccataaaatatttattcttctactgtgtcaggtagtcttgtaggttcctaagagatacyaaatacaggttcataattcttgtcctcgaagatctcccaatctactgataaagcaagtaccatatgcatgaaaagataaatgtctttataaagtttctta

SEQ ID NO: 11122 - DNA, 201 bp, Homo sapiens
atgacgacattttaaaggaagaacctccctggcagcatggctgaatagacctgggaagaaagagaatttatgcctgaatgaatggaaaactgatgattttrtatctcaaagtggataatttatttagaggcaactggctttggaggaaagagaaaatgaggggttttctaatgtttgagatgatagagaaacaggcaagca

SEQ ID NO: 11123 - DNA, 201 bp, Homo sapiens
ccttgtctgcataacaataatagttattatgaggtatttttgtgaataaactgaaatgatgactattaagcatttagcccaaggctaggtaaaagaaaagrctagccaaaagcatctgttattataaatataataattactaatcagcacccaactatgccgggcacttttgtagttacacatttgaataagatgcaaccc

SEQ ID NO: 11124 - DNA, 201 bp, Homo sapiens
tctgttattataaatataataattactaatcagcacccaactatgccgggcacttttgtagttacacatttgaataagatgcaaccctcaatttcaaagargtaagtgtcaatacaaagataaagatgtgaagaatagatagataccattttgtggtattgtttctacaagaaagatgtaaatacaatggaaaaggtgcca

SEQ ID NO: 11125 - DNA, 201 bp, Homo sapiens
acaccacgcccggctaactttttgtatttttagtagagatggggtttcaccgtgttagccaggatggtctcgatttcctgacctcgtgatccacctgcctyggcctcccaaagtgctgggattacaggcgtgagccaccgcacccggcctattacttagtttattattatttcattattattgagtatctattatttgatc

SEQ ID NO: 11126 - DNA, 201 bp, Homo sapiens
aaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaa

SEQ ID NO: 11127 - DNA, 201 bp, Homo sapiens
aaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaa

SEQ ID NO: 11128 - DNA, 201 bp, Homo sapiens
cctttaacctatatctccccatctcctcttccactgcatctggtaaccaactttctactctgtgttactatgtatttgactgtttattagtgtcgacttakgagtgagatcaaactctttcactctctctttctttcccgtttttttttttgtttgtttttgtttttttttaaacaagatctcacactgttgcccaggctg

SEQ ID NO: 11129 - DNA, 201 bp, Homo sapiens
tactctgtgttactatgtatttgactgtttattagtgtcgacttaggagtgagatcaaactctttcactctctctttctttcccgtttttttttttgtttktttttgtttttttttaaacaagatctcacactgttgcccaggctggagtacagtcacatgattccagctcactgcagcctcaacttcccaggctccaggg

SEQ ID NO: 11130 - DNA, 201 bp, Homo sapiens
actctgtgttactatgtatttgactgtttattagtgtcgacttaggagtgagatcaaactctttcactctctctttctttcccgtttttttttttgtttgkttttgtttttttttaaacaagatctcacactgttgcccaggctggagtacagtcacatgattccagctcactgcagcctcaacttcccaggctccaggga

SEQ ID NO: 11131 - DNA, 201 bp, Homo sapiens
gtgttactatgtatttgactgtttattagtgtcgacttaggagtgagatcaaactctttcactctctctttctttcccgtttttttttttgtttgtttttktttttttttaaacaagatctcacactgttgcccaggctggagtacagtcacatgattccagctcactgcagcctcaacttcccaggctccagggattctg

SEQ ID NO: 11132 - DNA, 201 bp, Homo sapiens
aattttctccccatgctcaagaagagaaatggaaatatggcaaacatctccatgaacccacattttctcacatctttagatcaaaaactcttattcttcarataaacaggttgtaaaattttcagtgttgaagagaatgaaatatgacatttgattttattgattcattgcttatttttggcagaagttatcctttattca

SEQ ID NO: 11133 - DNA, 201 bp, Homo sapiens
cccaatcatgtttaaggattattattttacatagaaataaataaagaaaggggaaccaatacaaagtgttagaaagacagctacgattaatatattggacyggcccattatcagaccctctagattttacaggtagctttctgatcagaaatctcgggtgagaaatagtaagaatgatggccttagttaaatcctctatca

SEQ ID NO: 11134 - DNA, 201 bp, Homo sapiens
gttggaaaatgataaccttattcattattattgcttgatacatttccgaatttgtgttatctgtcattaaatagctaccacagccttctttcattcttctyggtatcagtttaataatttgttcaatgaatatgagaaagaacaggatcacatccagattttaccacttactggctgtgtgacactgggtatggttattaa

SEQ ID NO: 11135 - DNA, 201 bp, Homo sapiens
atatgagaaagaacaggatcacatccagattttaccacttactggctgtgtgacactgggtatggttattaaccccatggaacctcatctttaaagttcaratgatggtaactaactcatgaggttgctagggattaaatgaagtaccatgtttaaggcttctggcgtgggtgctgagatatagcagataagagatggtag

SEQ ID NO: 11136 - DNA, 201 bp, Homo sapiens
cagatattggaaaggtggaggagaattatgttctatggcactttcagaagctcgagaataccttggcagagccaagccttctgcttagggaatggctagcmgtaacaaagcatggtacctgagatcaggtacatagtcaagagttaggttgaaagtcgaatattaacctgaaaaaggaagatttggcagcacagtgtatct

SEQ ID NO: 11137 - DNA, 201 bp, Homo sapiens
agtgtatcttacagtcccaggaaaagagccagttgacatgttctgtgagacttcagaaaactgtacgacgtgaaagtagaagcatttctaatcatagttayattttgagtaatctcttcacagtagaatgagtcccccaacactggatgtactaaagccaaaggaagggccaccacttttcagagttattgaaggaattca

SEQ ID NO: 11138 - DNA, 201 bp, Homo sapiens
cccaacactggatgtactaaagccaaaggaagggccaccacttttcagagttattgaaggaattcacccatcagatatgttttgattttattcagtgattkttcaaactagatccgtttctctaccttattttcaatgggcagtggttctctagttcatcaaaaagtttttcctctggaatttttgagaagcaatagaaat

SEQ ID NO: 11139 - DNA, 201 bp, Homo sapiens
catgttacagctgagccttttcaaatgcacggtgataaagaacagatatgttttgtgtgtgtgtatgtgcgtgtgtgtgtgcgtgtgtgtgtgtgtgtgcrtgtgtgtgtgttatgcacagtggcttgaaggtagcagccctttcccctgatagaaatttgatgatggcagcaacaaaacctaaacagagaataattaaag

SEQ ID NO: 11140 - DNA, 201 bp, Homo sapiens
agcagtaagtgctagagaggaaaggaccagaataagggtaggaggtacttttgagaggtgacaacgtgctagcagccctcgctcgctcttggcgcctcctyggcctcagcgtctgctctggctgcgctggaagagcccttcagtccgccgcggcgctgtgggggcccctctctggggctggccaaggcctgccctctgctg

SEQ ID NO: 11141 - DNA, 201 bp, Homo sapiens
agggtaggaggtacttttgagaggtgacaacgtgctagcagccctcgctcgctcttggcgcctcctcggcctcagcgtctgctctggctgcgctggaagascccttcagtccgccgcggcgctgtgggggcccctctctggggctggccaaggcctgccctctgctggcggggaggtgtggagagacaggcagaggtggga

SEQ ID NO: 11142 - DNA, 201 bp, Homo sapiens
gggcgcagccggctgatgcctgctgggcttgaaaagggacgagctccctctgggctgccggagtgcccgtgctaggttccaaagtcgccagtgagtgccaytgagaggtgaagccggctgggcttttgggtggagtggggacctggacaacttttctgtctagctaaaggtttgtaaacacccaatcagcactctgtgtct

SEQ ID NO: 11143 - DNA, 201 bp, Homo sapiens
gtttgtaaacgcaccaatcagcactctgtgtctagctaaaggtttgtaaacgtaccaatcagtgctctgcatctagctaatcaggtaggggacttggagamcttttctgtctagctaaaggattgtaaatgcaccaatcagcactctgtgtctagctaaaggtttgtaaatgcaccaatcagctctctgtcaaaacggacc

SEQ ID NO: 11144 - DNA, 201 bp, Homo sapiens
gactaaacacagctagtaagttgcacgacctggatcaattctccattggcttgtttccaaagccacaggtttactttaacatatacagcttttatagcackaacattgtgttctatgtgtccgtcattaagttgggtattttacacacattatcttaatatataaaacaattatatgcagcagatgttattaccatgatac

SEQ ID NO: 11145 - DNA, 201 bp, Homo sapiens
tggatcaattctccattggcttgtttccaaagccacaggtttactttaacatatacagcttttatagcactaacattgtgttctatgtgtccgtcattaarttgggtattttacacacattatcttaatatataaaacaattatatgcagcagatgttattaccatgatactgcaaataagaaaactgagaaatagaacat

SEQ ID NO: 11146 - DNA, 201 bp, Homo sapiens
gtgttaggatttagactgatttctgtgtgatctgtagtccattctgttcaacactacatgtacctgccttcccgtggtatcattgccccagttctgaaacytaggtctaggtcgcaggagaactagcttgataaggatgggctttagagccaaaatttaagccatgctttgtcttatctgcataattttatgttcccagtc

SEQ ID NO: 11147 - DNA, 201 bp, Homo sapiens
gttgtatctccctcattgatgcatcctctgtaacatctagctgtttaatgtgtcactcagaataagtgctcaataaatatttatcaaagtagctgatgttwcaggaagtctaggaagcaaaccacctcttctgttctgctcttggattcaagaacttaagaggattttgttggaaatccacaaagaatattttaaacgaga

SEQ ID NO: 11148 - DNA, 201 bp, Homo sapiens
ttgtatctccctcattgatgcatcctctgtaacatctagctgtttaatgtgtcactcagaataagtgctcaataaatatttatcaaagtagctgatgtttsaggaagtctaggaagcaaaccacctcttctgttctgctcttggattcaagaacttaagaggattttgttggaaatccacaaagaatattttaaacgagac

SEQ ID NO: 11149 - DNA, 201 bp, Homo sapiens
tgtatctccctcattgatgcatcctctgtaacatctagctgtttaatgtgtcactcagaataagtgctcaataaatatttatcaaagtagctgatgtttcmggaagtctaggaagcaaaccacctcttctgttctgctcttggattcaagaacttaagaggattttgttggaaatccacaaagaatattttaaacgagaca

SEQ ID NO: 11150 - DNA, 201 bp, Homo sapiens
gtatctccctcattgatgcatcctctgtaacatctagctgtttaatgtgtcactcagaataagtgctcaataaatatttatcaaagtagctgatgtttcakgaagtctaggaagcaaaccacctcttctgttctgctcttggattcaagaacttaagaggattttgttggaaatccacaaagaatattttaaacgagacac

SEQ ID NO: 11151 - DNA, 201 bp, Homo sapiens
aaaaaaaaaaatcttaggctgtccctacaacttttgctatcctcacgaaagagtgttactccagtgagacaaaagtccatcacaagaaatgatttttctayggaaacagctgtgattggagcaagatacaaggtaaaacatgttgtggtcaagttcaaggagaaaacagggtggctagccctagcaatcctactggtggac

SEQ ID NO: 11152 - DNA, 201 bp, Homo sapiens
cagggtggctagccctagcaatcctactggtggacttacttctgcacacttcatgctactatctatcctgtgttgtctaaggctatataatgtcgagagaygggctagtccaggaatcatgacagcaaatgagggagagagagagagagagaggagacagagagatggctcttgcaacctttccaatagcttttgataggt

SEQ ID NO: 11153 - DNA, 201 bp, Homo sapiens
aaaactcacagaaacataaagttgacttgatcatgcccattttataaataaaggaatggagactcaaagcggttaagggacatgtctgcagtattttaccygtgagctatatgccctctgggtttctcctcatccatctgcccccaacaactatgctctttcctctttcctttactgtttctgggcatatcaaagccaaac

SEQ ID NO: 11154 - DNA, 201 bp, Homo sapiens
ttgatcatgcccattttataaataaaggaatggagactcaaagcggttaagggacatgtctgcagtattttacccgtgagctatatgccctctgggtttcycctcatccatctgcccccaacaactatgctctttcctctttcctttactgtttctgggcatatcaaagccaaacttaacagcaccaatttcacattaaac

SEQ ID NO: 11155 - DNA, 201 bp, Homo sapiens
ttactgtttctgggcatatcaaagccaaacttaacagcaccaatttcacattaaacaaaagaagaggaacctactgaccaacctttccccatcgccaccaygtctagcctcgccagactctggtaatcattacactactctgtaattctaagatcgacctttttagattccatatatgagtgagatcttgaggtatttgtc

SEQ ID NO: 11156 - DNA, 201 bp, Homo sapiens
ctgggaaggcctcaggaaactcaaaatcatggtggaaggggaagcaaacacatccttcttcacatggaagcaggagatagaagtgcagaccaaaggggggraatggcccttatggaaccatgagatctcatgagaactcactatcatgagaacagcatgggggaaactgccaccaagacccagtgactccttactgggtcc

SEQ ID NO: 11157 - DNA, 201 bp, Homo sapiens
gagaacattcagggatttaatttttctgacacacagactgtgagttcttttgttttttgtttttgtttttctttttttgttttcagcacatcacactctgrctgtcattatcagttccccataaactgtgataatttttgtgtcacatagagtgtttaggttggcctctgatgaaatgaagcccaagtacttgctcttcca

SEQ ID NO: 11158 - DNA, 201 bp, Homo sapiens
ctgggttcaagcgattctcctgcctcagcctcttgagtatctgggattacaggtgtgcgccaccatgcctggctaatatttttatttttagtagagatggrttttcaacatgttagccaggctggtcttgaactcctgacctcaagtgatccacctgcctcggcctcccaaagtgctgagattacaggcatgagccaccgt

SEQ ID NO: 11159 - DNA, 201 bp, Homo sapiens
cagatattttatcacctgtgtatgtaagccttgtacccaatagttatttttttctgctcctctccttcctcctaccctctaccctcaagtagacctcagtrtctgttgttcctttctttgtgttgatgagttctctagaaatctttgtgattagttgtagttgagtactaatgtggctttgttttttttttcatggagttg

SEQ ID NO: 11160 - DNA, 201 bp, Homo sapiens
tttcttatcatcttgatgctgttgctcattttgcttaagttttaaagatttggcctttctctttttatgttgattaccaagagtgtctttgcaaagtcctktatgcagtactcaaagtatgtccatgccatttagctcctataaagaaaacaagtttttagccttcctaggaaattaagtttcctacaaaatatatgctct

SEQ ID NO: 11161 - DNA, 201 bp, Homo sapiens
ttaagttttcttctatattatcagttgctgtttagaataaattataatctccacgtttttttttgagacagagtctcgctctgtctcccaggctggagtgyagtggtacaatctcggctcactgtaacctccgcctcctgggttcaagcgattctcctgcctcagcctcctgagtaactgggattacaggcgcacagcacc

SEQ ID NO: 11162 - DNA, 201 bp, Homo sapiens
tggtacaatctcggctcactgtaacctccgcctcctgggttcaagcgattctcctgcctcagcctcctgagtaactgggattacaggcgcacagcacctcrcctggctaattcttctgtatttttagtagagattgagtttcaccatgttggtcaggctaatctggaaatcctgacctcgtgatttgcccacctcagcctc

SEQ ID NO: 11163 - DNA, 201 bp, Homo sapiens
tccttcctcagcggtagtagtccagacagaaacagttttggtggttgcttgagttctcccagttgttctcctgtcattttgcaggtcaatctgcttcattrtaggaacattctactggagaaaaaagtctatcattattcaaaatatccctccttatgcatacttcccactgcttagatgtctatactcagaaaagttact

SEQ ID NO: 11164 - DNA, 201 bp, Homo sapiens
attcaaaatatccctccttatgcatacttcccactgcttagatgtctatactcagaaaagttactatgtggtttttctttatgggacaatactgcgtgatygtggcgttcacatttctccctccaagtccttgcttttctagtttctgtaatcattcctcaggtgacataaaagtattttccgaagttttgccattttcat

SEQ ID NO: 11165 - DNA, 201 bp, Homo sapiens
taatttcactagccatcatatgatttagcttctgaagcagcttgctgctctgttattcgtgtgaactcatatcctttctcatttggaaagtcaagaccacrtgggtacacctcttatcacaagcttcgtagagaccacaaagatgccactttagtcccaactcactaaatctcctctacaatgtctctaaaaattatccaa

SEQ ID NO: 11166 - DNA, 201 bp, Homo sapiens
ttgagtctacctaggtccttggcctcctgcccttttatcttttctgagatctcatgccatctgttacctcatctctattttatctgttataattcctctcytctgcttcttccccagctgctcagaacatactgaaatatatgtaagattttgggttttttttctggtcattttgctcaatgacttcctaataccaactga

SEQ ID NO: 11167 - DNA, 201 bp, Homo sapiens
atatatgtaagattttgggttttttttctggtcattttgctcaatgacttcctaataccaactgaagagagtttatatttcttaatacaacattgaaagcytaacatgatttggcctcaacctacctttttttatccagtaaaattcatttctctctaatgtatactatattccatccaaactaacccactgattagactt

SEQ ID NO: 11168 - DNA, 201 bp, Homo sapiens
gatttggcctcaacctacctttttttatccagtaaaattcatttctctctaatgtatactatattccatccaaactaacccactgattagacttcattttycttttaattactgctttttgctgtgctggtcccactgcttagaatgttatttcctcaaccttatttctgtttcctacatttgttgaaatcctagatgtcc

SEQ ID NO: 11169 - DNA, 201 bp, Homo sapiens
tgacggcaaagtagatctctgggcccctcagcaaggaggcagaagttcatgttgcaaagaaagttccacgggcctactgaaatattaccaatcaaaattayaatttcatttattgacaagtcatatttaacattcttctaatgttttttctcacatgccaatgtccaaaaagctaaaccatcagctgcatgatgctaaggc

SEQ ID NO: 11170 - DNA, 201 bp, Homo sapiens
tcatttattgacaagtcatatttaacattcttctaatgttttttctcacatgccaatgtccaaaaagctaaaccatcagctgcatgatgctaaggctttcrgcagtcagcagaagcagtggtagttgcgagctggttattcagaggcagctactgtgctccacataaccataaagtgaacattttgacattcccgaaaatg

SEQ ID NO: 11171 - DNA, 201 bp, Homo sapiens
cctttattgaggttcagagaggttgctacttatatggtagcaaaagtatttcccttccctacttaccctactatacaaaacaaacaaacaaacaaacaaamaaaaaaccagaaaacttgatgataaatgtcaatcaacactcagcctctgcatctgatgagcaacagaaattagcggggactgtggtgaattggaaaacct

SEQ ID NO: 11172 - DNA, 201 bp, Homo sapiens
tgagaaggagtctcgctgtgtcacccaggctggagtgcagtggtgcgatcttggttcactgcaacctccgcctcccaggttcaagcgattctcttgcctcrgcctcctgagtagctgggactacaggcgtgtgccaccatgcccggctaatttttgtatttttagtagagacggggtttcaccttattggtcaggctggtc

SEQ ID NO: 11173 - DNA, 201 bp, Homo sapiens
gtgtatgcacaaaacaccctgtcccgggccccagatgtgtgcaggtttctaattgccggtgctgcactaagatttgaagggtgagagagttgcaaaatcasgaacaccgagggcggtgttaggaaggcagcttcctgcacactgttgtaggtgttagtgagattatcaattgctccgggagagacacaggactggagggct

SEQ ID NO: 11174 - DNA, 201 bp, Homo sapiens
tatgaagcagaattcttatccatatgggaaagaagatttggggcagcatggggtattacatgaaacactgttgccatcagatctgggccctgacgttaacwtgcaggacgttaggaaagttaacattcctgggccttgtcaaatgcagtcagtggcctaagccatctccatggtttcttctgtgaataagacagtcagtag

SEQ ID NO: 11175 - DNA, 201 bp, Homo sapiens
tcctatttatatgaattataagtgagtaggtgctgcccaagtgcttaaaagccgtttgttcttttaagaatctttaccattccttctaagactttggagcrtttggtgatgtccttaacaagccattgtatatagcagaggagtaaagtggaatcacacataaatggtcacatatttcaaatatgaagatgtaaacagttt

SEQ ID NO: 11176 - DNA, 201 bp, Homo sapiens
tgccacaaatgagctacatgtctttgacaagttgcttcaactcttagtttcctcaattgtaagtttcatatgaaatttagaaagaataaagggaatgggawctagcaccaaattaaaaagtaaacgtgatgtgaacttgaggcattaaattacaaataagtggtttccaaaagagagtatgctttgtctcatcaaaggaag

SEQ ID NO: 11177 - DNA, 201 bp, Homo sapiens
ttttcatagcacttactaattatctttgtttattactttattgcttgtctccccattataacgtatgcttctgggagtcaggagctctttcttataccagygattttatcacaagacctaaaagagtgcttggcacatgaaagatgtctatatatgatgaatcagtgaatgagtgatgaatgaataaatattggtcctctt

SEQ ID NO: 11178 - DNA, 201 bp, Homo sapiens
ataatgcacagacttgaattcctatattgagagaataacttacctcttttaaataataccataatttgccttgaaggtagggaagaaagagagtgaagtgsggaaaatttcaaaattctgtcttccagggagcatattcctactcatctgtgacatctaatgtaatagattttgaagaattatttgtaagatagatacttg

SEQ ID NO: 11179 - DNA, 201 bp, Homo sapiens
gcggtacgtgacaggggctgcatgcaccggtggtcagagagaaacagaacagggcagggagtttcaaaatgttcttctatacaatgtctggaatctatgartaacatcggtttctaagttatgagttgatttttagctactgggtttaggccaggcaggcccaggcctggtttcgggcctggcgccgggctgcctgtcttt

SEQ ID NO: 11180 - DNA, 201 bp, Homo sapiens
tctaaaatggagagaatactgattagacatatcttatacgatttgggggctactaaataagataatgcatgaaaagtactatgaatcatatttacaacatrataaagatcagctgcttctattattaatattaacactattaaggagtaattttacaaatgatgctctctccctgtgagaggttatgggtaacaactgagt

SEQ ID NO: 11181 - DNA, 201 bp, Homo sapiens
aagtagtatctcattggcttatttagtaatccctttaatgttctttaaggcccccctagtgtgtccaatttcagctagtttatagaaatgatgtaaagaayaggtctggctcacaagaaatcaaaagcaaggatagaaatattcctcaaccttgtgtttatcatttattgtaatgtgattgtgttcttggaaaagcattaa

SEQ ID NO: 11182 - DNA, 201 bp, Homo sapiens
actgaaataaattaaaaataattaaaatccaaagttcaccttatgaaggtgtgtgcctttaataatgctcaaatatagatttttaacatacactctgattktctgtctgccaaaagagggaaaaatctgataatagctgagtgtcatcttcctccaagcaatcagcaatgcattatttcctaatattgctgtttgatttca

SEQ ID NO: 11183 - DNA, 201 bp, Homo sapiens
tagacctctgtgcctttatctatgtcgttccttctacctcaacaggtttctgtcctaccatggattgtctaatgccttctgcacatgttctttatcctagraagcaaaatatttattccttttcctgcattctttaatacctagtttatgcatgtctcattgcacttattctaatcggagcttgttcttgtcatttttttt

SEQ ID NO: 11184 - DNA, 201 bp, Homo sapiens
cccccttctccgcaaagcactcaggcatcggacacgctatggtaaacaaactacattgtctggtagatatcattcttattgtctctttttttgggtttgcmgtgtgttgccccccttttcctctccaacccccccttttatcctctttagactcatttcttcttttaagattttgttacattaaatgcaagcctttctttt

SEQ ID NO: 11185 - DNA, 201 bp, Homo sapiens
accaccctgccccctcctaagcagccggcttatgagacatttgcaaagatgttaaccccacataaaaagtgtgccgttcgataattatgtaaattagctgrcaattagataatgtcactcactttccctctctcgcttgattcccacacaacagagaagtgttctgagcttctgcaccagcccgggccctgcatgcaggct

SEQ ID NO: 11186 - DNA, 201 bp, Homo sapiens
ttgggcaagccatttgacctttctccaccacagtctccatttgcaaaatggtggttacaatcttccgcagccatgtgtggtggctaaatatgcaaagcacyttatgttccagaaggattatgagctcatccatggtctaggtatagacgtgctgtgacgtgcacatgatctacaggctgagctttctgtttcaaaggtgac

SEQ ID NO: 11187 - DNA, 201 bp, Homo sapiens
caggttgccattttcacttggtttttctatttgcgaatctgttgttaaacccagttggatggcatccaggctttattaaccagaaaacactatactttctraagtgcttatcaaaaagtgcttaccaaattttcttctgccacatgattgatttaatgtcttctaatgtcaatgtgaaagcgtaagaaatgataggtgtct

SEQ ID NO: 11188 - DNA, 201 bp, Homo sapiens
caccaccctgccccctcctaagcagccggcttatgagacatttgcaaagatgttaaccccacataaaaagtgtgccgttcgataattatgtaaattagctrgcaattagataatgtcactcactttccctctctcgcttgattcccacacaacagagaagtgttctgagcttctgcaccagcccgggccctgcatgcaggc

SEQ ID NO: 11189 - DNA, 201 bp, Homo sapiens
cttatcaaaaagtgcttaccaaattttcttctgccacatgattgatttaatgtcttctaatgtcaatgtgaaagcgtaagaaatgataggtgtctgcctaygttttctgtttgataaaagtgtaactccttacgaatactaaacaaatggtataggctggcacacatttgaaacacatttccacacttaggtatgtcaagg

SEQ ID NO: 11190 - DNA, 201 bp, Homo sapiens
aaaggctcacttttgtttctactaaaaacacttttctaaaatagtatcaggcacacttaagtcctttaaatggagagaggataaaccaaactgtaattcaratattgtttgtgctgttttaatcagagcagctagaggaaaactaccctggatgtttttcccgcccctgcccttcatgttctaaggcccaactctgctctg

SEQ ID NO: 11191 - DNA, 201 bp, Homo sapiens
aagcatgccttaccacttcacaaatagataaggtggcttctaagaaaatctcaaatagaggtggtcaggaagccacaggaccaaccaagaacccagaaacracagtgcttactagatgctgcttgcattctaccatgtggatacaatgagtaaaacttgggtactaaagtcaaagtgcctgccaccacacctggctaatat

SEQ ID NO: 11192 - DNA, 201 bp, Homo sapiens
tttataaagaaataaagtcttttcccattgttctgctctgtggaagtcaccttcagagtaagggtgggggtgactgtccttgccaatttttaagtaactgscttgcaagggtgattccctacagagttattttctgcatagtttccctctgggtacagaatgtgggaaagtagatgcaacgcattttagagtagtcatttg

SEQ ID NO: 11193 - DNA, 201 bp, Homo sapiens
cagaaaaccagcaactagcaaatggtttctccatgatgattttgggttcacatttcacttccatatataatacaacttatgtgcccatatttcatcctctrgaagcctgccacattatcctctgaatgaatattaacactccttgtactctgaagtagcctctggtattctggtatttattcaacaggttttgaacaagat

SEQ ID NO: 11194 - DNA, 201 bp, Homo sapiens
agttttctcctctgcaaaatggaacaatagaatccttttcattgagttattctgaggattaaatgagtgaatataggtaaagcacgtaggacatccctggyatatagcagtcaatcccttgtaaaatgttagctgcagtgggtgcaactgactgcggccagttgtcaccacctgtgacatttaccaagacaattttgggta

SEQ ID NO: 11195 - DNA, 201 bp, Homo sapiens
atcagaaccttttgagacaggggcaggacttggcatcagtatttcttaaatataaacattgtatatgtaaatattatatcaataccagtatttttaaaagyatcccaggggagtcagccttttgaattactgtccatttaatattcaaagcaaagtctatacatttgtattattcctattttatttatgaggactctgaga

SEQ ID NO: 11196 - DNA, 201 bp, Homo sapiens
aagaggcgtgtttcaactaacaggaggagagatgcaaagagctttcaccaaagcaatcagaagacctgtaaacagcctcagggaactgtaaaagtctgtgrgggtctctagtgtaccagatgaaaagcagaaactttaggtagccgtctgaatgtgtcaaatgggaatatcagaataactcactaaatttcctttttcaac

SEQ ID NO: 11197 - DNA, 201 bp, Homo sapiens
cttgttacaaacgcatattgttgattctcattccacaactattgaatcagaaattctgggactgagtcctagcaatctgtgttttaaacaagccctccaartgatttaatgcatgccaaatactaagaatcactgttatccttggaagaggggaaagctcagataacccacaattgaggtctagagatgttcatagtctct

SEQ ID NO: 11198 - DNA, 201 bp, Homo sapiens
aatgcagatgttgtttttaaaaatgaacaatgttaggctgccttcctcgaggggctgtctctcttgttctcactcttctgcctccccttccacctttaagkatcctgtgattacattgggtgcacctggatgataggcaagctccctattttaagatcaactgattagcaaatttattcccctgtgctatagaaggtacca

SEQ ID NO: 11199 - DNA, 201 bp, Homo sapiens
agggtgagcaaaggcatggaggtagagcatgttctggtgtctgggtgaagaacttacaaacagcttgctaatttcaaggcccaaattataagactgggagmtttggactggtagctgcggttaggtagggaccatttcatagaggcctttatttcatgctatacccttggactttgttctctaggtaacgggggagccatt

SEQ ID NO: 11200 - DNA, 201 bp, Homo sapiens
gtcctctgcttcctggtcctttcactactgcctctccctctgcccccatagtacttcgcctatcatggtgtcatgatgagtctttccacctctgttctctstgctttctttccatgctgcattctgccccgttttgctctttgtgccattctttggaaacatccagtgcccagcaaagcatgtcttcttcagcctcccact

SEQ ID NO: 11201 - DNA, 201 bp, Homo sapiens
agggtttcaccatgttggccaggccaatctcgaactcctgacctcagatgatcaacccatctcggcctcccaaagtgctgggattacaggagtaagccacygtgcccggcctggccagttttttgaactactgatgaatttgatcaaagcctattaaaaacttactgagtaaacaaacaattgtcccatgaaagcagtata

SEQ ID NO: 11202 - DNA, 201 bp, Homo sapiens
aacaataaaacagtctactatagtagactacctgatattttgttatcactaatgtccataggttgatccaagaagactagttttttatcctttctgttaamctctaatgtgccccaatattgataaatgccatgagacctttttccaaacacataggcttcagaagacatcagagtcttctccactgcccattttctgttt

SEQ ID NO: 11203 - DNA, 201 bp, Homo sapiens
acatggtttacaggtctccttcttcttaattctcatctatacctttgtatagatgcctaagctgaattctcacattttctttattattcaagtataacagkttacctgtttgagtctacaacacccacttgctatattctgtactaatgacagagaacatgctatttgtgctttcccccaatttcagcacagtgtctgtca

SEQ ID NO: 11204 - DNA, 201 bp, Homo sapiens
tcatctatcttccaatagaaattttagagttgaaaagtccaaaaacctaaatgaaaaattcactagacgagctcaatggtagattagagttggcagaagawaaaataattgtattagtctgttctcatactactgataaagacatacccgagactgggtgattggtatgaaaaaagaggtttaatggactcacaattccat

SEQ ID NO: 11205 - DNA, 201 bp, Homo sapiens
aaagtccaaaaacctaaatgaaaaattcactagacgagctcaatggtagattagagttggcagaagaaaaaataattgtattagtctgttctcatactacygataaagacatacccgagactgggtgattggtatgaaaaaagaggtttaatggactcacaattccatgtgactgggatgcctcacaatcatattggaagg

SEQ ID NO: 11206 - DNA, 201 bp, Homo sapiens
aaaacctaaatgaaaaattcactagacgagctcaatggtagattagagttggcagaagaaaaaataattgtattagtctgttctcatactactgataaagrcatacccgagactgggtgattggtatgaaaaaagaggtttaatggactcacaattccatgtgactgggatgcctcacaatcatattggaaggtaaaaggc

SEQ ID NO: 11207 - DNA, 201 bp, Homo sapiens
agaaagtgggtttttcttttctatcacattgtcaggctgcaacttttttggacctttgtgttctattttccttttaaaactgaatgcttttaatgacaccsaagttacctcttgaatcctttgctgcttagaaatttcttccaccagttaccctaaatcatctccctcaagttcaaagttcaacaaatctctagggcatgg

SEQ ID NO: 11208 - DNA, 201 bp, Homo sapiens
ctatattattattcagctgacttctccagtaaataatagtgttcttcaggaacagaaaaccaaacgccacatgttctcactcataaatgggagctgaacartgagaacacatggacacagggaggggaacatcacatacactggggcctgtaggtggaggggagcagggggagggagagcatcaggataaatagctaatgc

SEQ ID NO: 11209 - DNA, 201 bp, Homo sapiens
tagactgctgttcttttctgttggtcctccagactccaaataccttccagtatcagctagtcttatgcactgtgattggatagttaaatactactttgacwcaaggctgccatcttactgttggaactctccactgttcttatagtaatcatcaggctctgaacactggcttcccagccctgtataatctcccccacttta

SEQ ID NO: 11210 - DNA, 201 bp, Homo sapiens
atctgggaaataggaaaagtggcatctgcccttgctccgcacttgggatgggagagtcaaatgagaaagactgaaagcaggtgtaaaatctaaagtactakgaaaaacaaggtgttatgatgtcttgataaacatttggtaagataggagtcttgttacacataataacatttttctgagtaatctagtttggtttatttt

SEQ ID NO: 11211 - DNA, 201 bp, Homo sapiens
ttttcattgcaggcatgtctgggcaagtcacctgtttagcctttcttatctgtgtggctgtgggcatgtcctagttaggcaagtcccattttccaagttcycttatctgtgcctgcaggctgttctttcctttgagagaattcagccaaggacccaccctaactgcctgcctgaccactttcttcctttctcctctctcat

SEQ ID NO: 11212 - DNA, 201 bp, Homo sapiens
aagaaaatgataacttaggtcctggataaataaattttaagtagggaaaggtgggctggagttaggagcattctaaactcaatgaacaacatgcacatgcrcttggagacagtgcaggtcaatttaggagctcacaggccatttagagtgacagaagcagagtgtgcaggtcaggcagtaataagacatgaggctggagaa

SEQ ID NO: 11213 - DNA, 201 bp, Homo sapiens
tattcctgaacaaatttccattgccttctaaaagggttatttcttggtctgcagagctgctaatctgtaggttgcattcagtctaggctatcagaataggkcaccccatgggacttgatgatagtattgtcacttagatggcaaacaaggcatgaaataccttttcatagaactaaacaccctcaaatggggacatgaaac

SEQ ID NO: 11214 - DNA, 201 bp, Homo sapiens
gggaaaagatagtctagatagtcttagtcttcaatgagccaacaatccagagcgacatatagagttatgtaaatatatttaccaagtgttagaggagatcrgtgaaggtgtgaatagtttttataaggcaaaaggagtggtggtgtcataaaaatctttacctctaagggttattttgaactgtgtcttcaaggataggga

SEQ ID NO: 11215 - DNA, 201 bp, Homo sapiens
aaatacactacttggcacactctttccccagatcttcatctggctgtcccttttcatcttctagatctcgactcaacatctccttcttaggccatttctgwccactataactgatccctgtcacgttctatcataatgtccttttgccattttcttagcacttattagtgtataaaattatcttctgtatttagctgtgag

SEQ ID NO: 11216 - DNA, 201 bp, Homo sapiens
ccttcctgataccccacctctaatggaatatggggagaagaaattgacttatttacaatatttagcaagctgagagaaagtttagaaagcctgtttggctkgggaccccagaaggcaaagaggtccaggttcaattctgagatagtggatattattgttgcggacaactccttaaggttcttgggtagagctttaaggcca

SEQ ID NO: 11217 - DNA, 201 bp, Homo sapiens
ttctggaaatacttgaactgaggctcagagaggtttaggattgcataaagtcacacagcaggttggtatggcttggcatccagatgcgattttgcttaaayaactgtaagtttgggtaggggagcctggaaaagcatcacatgaaaggcttttaaagagtcagggcagtgttaggaaacacaggctagccagggagtctgc

SEQ ID NO: 11218 - DNA, 201 bp, Homo sapiens
ctgctatttgattggttaatgtgcactgggcctggaacctcaattggggtttgtttcctggctctatctgtgccccagtgaacaaaccagtctcccaggakgtttgatgagccctgaaggctgttgtgttggaagacacctgctgatgcgagcagctgccttggccttttctgaggtggaagcattccaacctgccgtgag

SEQ ID NO: 11219 - DNA, 201 bp, Homo sapiens
atacatgtgtgttatactcttggtcctcataactcatattaatgttaggaaaatacaggagaacctagcttctccgagatgtcccctaatcatttttagaytaagtgcatgcaatttcacatacatgtggctgtgcagtacttttgcatgcagactttgtcatgtttctgaggatgggactgagaagaaatgaatgggatg

SEQ ID NO: 11220 - DNA, 201 bp, Homo sapiens
cttctgggctggaccagctccacagatgaatgggaatactcactgaactaggaatcagagaatcatagctccagttttgtttctgtaggttcttgggtttstggattaatcgcttaatatgggcatctaaatttatctacctgtgaaatgaaattgctaaggtttactctatgaacctcagaaggattttaagcatcagtc

SEQ ID NO: 11221 - DNA, 201 bp, Homo sapiens
tgagtgaaaaaagccaattccccaaagggtacatattatatgatttcattctttattctttctttaaatgacaaaaatataaaagagtgaacaggttagtrgtttccactgtctaggcctggggagagggaagaatgtgtgcggctgtgaaaggacaacttgaagggttcttgtgatggaaatttcctgtatcttgatggt

SEQ ID NO: 11222 - DNA, 201 bp, Homo sapiens
ggttgcattcagctgtgaacttagctgggcctgggatgtacaggaaggctccttcacaagaccttcacaactcctctccttgctcaattgtctaacccagmttcttacatggtgactagatttcaagttctccaaagtggaagcatccctgctgctatggactgaatgtttgtgtccccttgaaattgctatgtcgaagcc

SEQ ID NO: 11223 - DNA, 201 bp, Homo sapiens
actgtcatcgcttgacctcaagaagcttaaatctaatgggaagggaagaagagtatcctcgaacacccgtactgtatgcaatgtgatgttccctaagggtrtggcaataggagtataggaatgagtgggattatttctagctgaggatcagggaaggttctgttgatgatttgacattttagctcagttttggaaaattga

SEQ ID NO: 11224 - DNA, 201 bp, Homo sapiens
ttatgttttaggagtagttgatggctagatcaagaaacaggagcatgcagtggagtggaatcatccccttaccatggttgatttctagctttctgcttccmcctgtgacatggtgagatgcttttatttttacttcctcatccagatatattcttgatctcatccttctttctcctccctattttcttcttctaaatatgt

SEQ ID NO: 11225 - DNA, 201 bp, Homo sapiens
catgccctaattggttcacagatggatacatcctgaggcaggtgggggtaatcctcaagttttcctacaccaaagcataccccagaacaaagaactactcrttctggaggtgaagataaggcctgtgatgggttgtcccatttgatcactgtggatttcctctctgtgatatcttctgctcccctggaatctagtattgag

SEQ ID NO: 11226 - DNA, 201 bp, Homo sapiens
ggggatgatggtatgctctctgaattgaaccttaccttttaacatgaaatttctaattgaaacaaagctgtgatgcctccagctttgttcttttggcttargattgacttggcgatgcaggctcttttttggttccatatgaactttaaagtagttttttccaattctgtgaagaaagtcattggtagcttgatggggatg

SEQ ID NO: 11227 - DNA, 201 bp, Homo sapiens
caaaagtcttcaaaatcttcattaggtatttgttatgccaacttctttctcagccctcccggtttgtaactttttaaatctttacccagtgttgcacgaaractgttgagatggttccctctgccttcctctctctaggattctccctgggaagtttaaaatatataatgttatgtaaagtaactcactggggccttcctc

SEQ ID NO: 11228 - DNA, 201 bp, Homo sapiens
tttaaaaattatatcattgattaaatcaattttaaaatgggaagtgactttgagaaacagacttactacaaacagacacataaagaaaaatctggtacatrttaaagagaaatattgctataaaatcagaatacattatatgaagtctacatttgaattatgccatgtgtcaagtttgttaagcatataggtaagatgtaa

SEQ ID NO: 11229 - DNA, 201 bp, Homo sapiens
ggtttcaccatgttagccaggatggtctcgatctcctgacctcgtgatccgcccaccttggcctcccaaaatgctgggattacaggcgtgagccaccaccrtacccggcccatacttgggaatttttactacagctgactgaaattttttatttgaatcctattttatatatgaggatactatttcttctttacagcatta

SEQ ID NO: 11230 - DNA, 201 bp, Homo sapiens
tgcctgccaccacacctggctaatatttgtatttttagcagagatggggtttcaccatattggccaggctggcctggaactcctgaccttgtgatctgccyacctcggcctcccaaagtgctgggattacagatcccaactggattgggatcttagcacttacttgctgtataacttctccaggttactgatcatctctaa

SEQ ID NO: 11231 - DNA, 201 bp, Homo sapiens
tggaacaaaatgctgccagtctgtttgctaaaacatagctagagtcatctttactccagttcccaaaaagttcttcattccatctgagaccatctcagccygaatttcattgtcagcattttggtgaaagccattcaacaggtctctaggaagttccaaactttcccatgtttttctgtcttttcctgagccctccaaact

SEQ ID NO: 11232 - DNA, 201 bp, Homo sapiens
agttcctttggcgacagcactgttggctaaatatgaaaggctgtgagatgaaatggcagcaagagaacagcagaggaaaatgtaaggcaaggatgggaaayacatgagaagtttatacctgaccatctcttttctatcattggcttcctatctcctattcttcttctttgtcaatctctgtagcctccacctttgctcaaa

SEQ ID NO: 11233 - DNA, 201 bp, Homo sapiens
gagcccatgcctttaaccactacattatcccgcctgcatgagaggggcactcatcctagcaccagtcttctactttggaccctagaggctaaccatcaccrtatcaagcccacacttggcagagtctgcttctcacatttggtccacctccttatattatttaggctcatgtctttcctttctactaacatataagtgcct

SEQ ID NO: 11234 - DNA, 201 bp, Homo sapiens
gttaaaaagaataattaacttgaccaaataggaagggagcatcatttcaggtgttttcacatgttttcttgtttagtccttttaatatttaatttttatarcattaatacgagataagtatcattatattcattttaatgtacaggaaatttagggcctgttaggttaagcagttttgcccacgatcatagagcttgtcag

SEQ ID NO: 11235 - DNA, 201 bp, Homo sapiens
ctgagtgtctgtacaaagggataaggatggagttttgataggggtctgggcatcagaaaggacataacaggttgcatcatgaagactgagtagtatttctrtggacagaggagaacattcctaggcgtgaagggatggaaatgaatgttgagaagtgagctatctgaaattgctggactagagtgtgggctaaaagatgta

SEQ ID NO: 11236 - DNA, 201 bp, Homo sapiens
gaattagcatgaaattgctgggtgccaactggggcatggggacaggagcagtcagaaggtgaattctatacacttcgaagacccaacctggatcaacaccyggtgtttgaagcacaagggcttgttagtgctaatcctgcatcaagtagagatggtgggaaatcgccctgaaaagctctatagtgtataaaatgtcatgat

SEQ ID NO: 11237 - DNA, 201 bp, Homo sapiens
atggccccattttacagaagatgtctaaagatagaccttcaagtgggcccgacttactaggccattccatccgggcccgacaagagggtcacagctcttasacccacccctcagcaactccctaggacaaggacacaatgaggcaaatctctgagcctttgccctaaggttacacaaagctcatttagagccttaacaagc

SEQ ID NO: 11238 - DNA, 201 bp, Homo sapiens
cccatcactacaaattcctttttttaaattagctggacatggtgacccatgcctgtagtcccagctacttgggtggctgagtcaggagggttgcttgagcrcaggggttctagactgcagtgagttatgatcaccactgcagtccaacctgggtgacagagtcagaccttgtctctaaaaaaataaatttaaaaataacat

SEQ ID NO: 11239 - DNA, 201 bp, Homo sapiens
tcctctctctaggattctccctgggaagtttaaaatatataatgttatgtaaagtaactcactggggccttcctcttgggcctcacctctatacactgaaracaatgctttctagcaaggaggacccatgcttccagagaggagggtttgcaactggagtaacttgagtatgtctttgggattcttgagctcaacccaaag

SEQ ID NO: 11240 - DNA, 201 bp, Homo sapiens
gcattagcaaattcccagttcccacctcaaacctgctgagtctgaaactctaggggaggaacccagcaatttgcgtttcaacaagccctcccagatgattmtgatgttatagcaattcttaacttgcttaagaatttggaaagtcttacaaataagggcaggactgggtggagaaaatggagaggtctgattatctttcat

SEQ ID NO: 11241 - DNA, 201 bp, Homo sapiens
accaaccaagaacccagaaacgacagtgcttactagatgctgcttgcattctaccatgtggatacaatgagtaaaacttgggtactaaagtcaaagtgccygccaccacacctggctaatatttgtatttttagcagagatggggtttcaccatattggccaggctggcctggaactcctgaccttgtgatctgcccacct

SEQ ID NO: 11242 - DNA, 201 bp, Homo sapiens
ttagtccattctcacactgctacaaataaatacctgagactgagtaatttataaagaaaggaggtttaattggctcatggtactgcaggctgtacaggaarcacagcagcatcttctctgcttctggggaggccttaagaaacttgtaatcatggcagaacgaaagggggaagcaggcacatcttacatggctggagcagg

SEQ ID NO: 11243 - DNA, 201 bp, Homo sapiens
tcaccatgttggccaggccaatctcgaactcctgacctcagatgatcaacccatctcggcctcccaaagtgctgggattacaggagtaagccaccgtgccmggcctggccagttttttgaactactgatgaatttgatcaaagcctattaaaaacttactgagtaaacaaacaattgtcccatgaaagcagtataatctaa

SEQ ID NO: 11244 - DNA, 201 bp, Homo sapiens
ggttttggtattcaggcttcattatttttggttccattctttgtaacacctggggtcctggttctctgctgatgggcctcttaattttgtttattttgtgwctgaacctcagattttagtttgtatttattttttgaaataataatctggttactgaattagacaccaagctcatggaaagcttggaccatgcctgctgca

SEQ ID NO: 11245 - DNA, 201 bp, Homo sapiens
caatgcaatggatatttgaaaactaaatccagaacctgaatttatcctcaataaatttgacttttcatattccattcagagttctggtattcctatattgktttcaatttaatgctagactttatattaattaagataattttatggtaacaataacattatgcatgcattgagtgtttgctacatatgaagcacttataa

SEQ ID NO: 11246 - DNA, 201 bp, Homo sapiens
tacctttaatttgattaacatgttaatactagcaggagagttactttgttgtattctagggattataacatggcatcatttgaaatgatatggttcccacygataaggggaggatgaatagaagcatacactgaatttctctccagggcattgagttcctttggcgacagcactgttggctaaatatgaaaggctgtgaga

SEQ ID NO: 11247 - DNA, 201 bp, Homo sapiens
gtctgaatggtattgtattgtggtattgtattgtgcatgagtattctcttaatgtatataaatagtatttcttttttagtttgagatggagccttgctctrtcgcctgggctggagtgcagcggtgcgatcttggctcactgcaaactccacctcctaggttcaagcgattcttctgcctcagcctcccaagtagctggga

SEQ ID NO: 11248 - DNA, 201 bp, Homo sapiens
gtttaacacatttccacaagcttggcagcttaaagcatcacacatttattatctcatagtttttaagagtcaggaatctgggcacagcttagctggatccwctggtttatggtttcttacaggttgcaatcaaggttttagccagggctgagttctcatctgaaagcttgactggagaagaacctgcctccaagttcacct

SEQ ID NO: 11249 - DNA, 201 bp, Homo sapiens
ctccatgttggtcaggctggtctcgaactcccgacctcaggtgatccgcccacctcggcctcccaaagtgctgggattacaggcgtgagccaccatgcccrgccaatcaattgttattgatttattactgagattgctttaaataaattcatccttatttctgttgtagtctttaccttgtctccagatctttggaagtct

SEQ ID NO: 11250 - DNA, 201 bp, Homo sapiens
tagaacagcaggctgtgttttcaagttcaagtccataagcagacaggaatagaatcccacaagagtttgttctgtctctgccatttactagttaatctctmtatgcctcaatttccccatttgtaaaatggatttaataatggctgtctaccttataaggttgctatgaggtgccagtgtgataataaacgtaaaagtact

SEQ ID NO: 11251 - DNA, 201 bp, Homo sapiens
cacattgttgttgacggtgataggttcagggcacaggtatcctgtatcctcagtctttgcatccaaaacttgacaaatccttttctcacccatatattctscctctcatgcaaaccttcttactttagacttatattttgtgtttaacagtcaaacatttcctctaggatgcctagtctatgtagccatttcaaagataat

SEQ ID NO: 11252 - DNA, 201 bp, Homo sapiens
gagggaaatgtatctaagacatccccattagatggaaaactgtgaccagcacccaggacttccaacatccagtctgggaatgattcctcctttatatggcygtttcctatctgagaattctcatgacattctcatgacacttcagtgtagcactgtagattcctcccatggagcaaactaaggtgctttccacccacccta

SEQ ID NO: 11253 - DNA, 201 bp, Homo sapiens
attcaagctggtgggaggtttcaggggaagaacaggggagaagacaaagcagaaacagccttaggcagtataaattctgaatacctttaatttgattaacwtgttaatactagcaggagagttactttgttgtattctagggattataacatggcatcatttgaaatgatatggttcccaccgataaggggaggatgaata

SEQ ID NO: 11254 - DNA, 201 bp, Homo sapiens
aaagaatttgaattttctgcagcactgctgcacgttaggtaaattcctctctttgggcctcacttgcaacaccaataaagagaggaagttatactagatgwtctataagccccttccagccctaacatgctattagcccatgattcttgtgtagggataccagaagaagatgaaagagagaacctaacttattttctgtca

SEQ ID NO: 11255 - DNA, 201 bp, Homo sapiens
aacagactcttttcccaaagaaatttgctaaaatgacaaatcagttatcactgtctattaggacatccactgcatccatctatcctaatatcttcctcacktatgcctcagcggcatgttttacttctatttactggtaccacagtcttagcaaaagtagcacattgattataggagttgtgaagccttgagccctgacaa

SEQ ID NO: 11256 - DNA, 201 bp, Homo sapiens
ttatccttgacacatatgggagcaggctttaccagaggcaagaattcaatcaaaagtcaggctttttgaatttaggtctttctcttttcttctgctataaratggtgagatcatagcccatgccctaattggttcacagatggatacatcctgaggcaggtgggggtaatcctcaagttttcctacaccaaagcatacccc

SEQ ID NO: 11257 - DNA, 201 bp, Homo sapiens
gacaactgcccagttcaattttatgatgaagcaagtttggaaagcatagagtcagggtgctgagcactttttgagcatctttgagcactttttgaccatgktattcctggctgtgaaagaattctttttgtatgaaatctcatctacccataacaagtcttggaagctgctcttgtcatcctcatcacagacctgcagaaa

SEQ ID NO: 11258 - DNA, 201 bp, Homo sapiens
gtgattcagaaatgagccatccattctcccagaattcctccattcaccccacagacacaaaaatcaaatctatgaaaatgtttttgtatatttcataggasaaacagatgtggaggcttaactcatgtatccaatgccaaaagtcttcaaaatcttcattaggtatttgttatgccaacttctttctcagccctcccggtt

SEQ ID NO: 11259 - DNA, 201 bp, Homo sapiens
ctcaaagtgtagtcccaggaccagcagcattagcaaattcccagttcccacctcaaacctgctgagtctgaaactctaggggaggaacccagcaatttgcrtttcaacaagccctcccagatgattctgatgttatagcaattcttaacttgcttaagaatttggaaagtcttacaaataagggcaggactgggtggagaa

SEQ ID NO: 11260 - DNA, 201 bp, Homo sapiens
gcctgccaccacacctggctaatatttgtatttttagcagagatggggtttcaccatattggccaggctggcctggaactcctgaccttgtgatctgcccrcctcggcctcccaaagtgctgggattacagatcccaactggattgggatcttagcacttacttgctgtataacttctccaggttactgatcatctctaag

SEQ ID NO: 11261 - DNA, 201 bp, Homo sapiens
ggccaccgctccaccttcacttttgggagtccggactcagattcccatcattcgccctgcgggaggggccctgggcattttaaccccgggagacacacgcscctggagagtggtcgcccaagccaccgccaggcagggaggagcgcgcgtgcggcaccaccgcgtgcagcagctccagcgctcgcgctgcctcaaggggtt

SEQ ID NO: 11262 - DNA, 201 bp, Homo sapiens
gcaactgaagttactaaggtaatagacataacatatgatctaaaaattgagagtacgttaatcaaggggagtgagcagaaattattctcgtcaatcatccrtgtgtccctctatatccttcacctttattgctgttagatttggaggaaattctgagcaatgttccgtgatcaggggtgaaaagtgtcatttctgggctga

SEQ ID NO: 11263 - DNA, 201 bp, Homo sapiens
acaaagatgcaatcaagcacagggttgtgatctcatctgaggcttgggatcttgttccaagctcacacggttagcaggatttaattccctgaagttgtaaractgaggccctcagcttgtagaagctgctcagttccctgacatgtggcctttccataggtgtttcataatatagcagcttcttcaaagttagtggtaaag

SEQ ID NO: 11264 - DNA, 201 bp, Homo sapiens
ccagtgggcctccagcattcactagcaatatcacatgaattgcatactctagtacttttgtttacttctttccttttactacctgccagtctggctttgtytttctagactctagaagatgtaaatggtatcacttccttgcaggtgtagccaagaagatcctggttatcattctcttcctacagtccattttccttatag

SEQ ID NO: 11265 - DNA, 201 bp, Homo sapiens
ttgctgcttagaaatttcttccaccagttaccctaaatcatctccctcaagttcaaagttcaacaaatctctagggcatggaacaaaatgctgccagtctrtttgctaaaacatagctagagtcatctttactccagttcccaaaaagttcttcattccatctgagaccatctcagcccgaatttcattgtcagcattttg

SEQ ID NO: 11266 - DNA, 201 bp, Homo sapiens
ccggcaagctagatgttctaccttcactagagtaattttaattcattctcttctgaagaaagaggtaaagatgaaggttgtctagggaggaggaatctcartatttttcttcattaggacagttataatgttgagaccaaaaagatgtaagtaaaggtaattaacaaagggcaatctacttcctttggagcttataaattc

SEQ ID NO: 11267 - DNA, 201 bp, Homo sapiens
attagcagatttaaactggacttggggctgccatgtttgtggattcagaagtagccttatcaatcaattagccttatcttcttgtaagtttgatgattcaytaatcaaacttagaagaactagataattctatttctaatgtttttatttgttgtattctgtagacaaatatttcagaataattttctccaaaagcctgag

SEQ ID NO: 11268 - DNA, 201 bp, Homo sapiens
tggcctgagagtcctgcctagattcattaagaatttctttctgtctctctctttcatacattatatatttttcaggtgaccattttagcaattgtacaagstatttttaatattaaattatgtagcctcagctgcttataaggagagtttaaggagaatattagacatatttataagtatcgtttgtcatgcaagggctaa

SEQ ID NO: 11269 - DNA, 201 bp, Homo sapiens
tgtattgtgcatgagtattctcttaatgtatataaatagtatttcttttttagtttgagatggagccttgctctgtcgcctgggctggagtgcagcggtgmgatcttggctcactgcaaactccacctcctaggttcaagcgattcttctgcctcagcctcccaagtagctgggattacaggcgtgtacaccatgcctggc

SEQ ID NO: 11270 - DNA, 201 bp, Homo sapiens
gagggcatgtttgatgtcagtactttcatatgttcattggccttcagtgaactggcactcgtcacgttttagttgtgcctaggtaaatggatttatgtgtyaggtgatctaattttcatgaaacaacatccacaaaacagacaggtgtcttatacaaactcccaaagaaactgtgggtggaggagaaaccagcactgtatg

SEQ ID NO: 11271 - DNA, 201 bp, Homo sapiens
ctgccagccaagaaatatcttctgtcttctccttacccttacgcaggtactttctttttccctcttagagaataatttggggggagagaaattgcactctratttacttgttgcctggtaagattctctggtgacatttactctctggaactgcacagttctaacaacaacagaaaagggagcttgatgggtttaccttcc

SEQ ID NO: 11272 - DNA, 201 bp, Homo sapiens
agtaggggttagcaggcaggcaggaagaagaagggcatggttggcagagattgccacatgcacagaatatagtggtgaacctacatggtgcatttggaatkgcaagtagtctggctttgctggaagtgggtttgcaagctgaggagtaacaagaaataaggccgaatagcataccaggaagtggtagatggcagagacccc

SEQ ID NO: 11273 - DNA, 201 bp, Homo sapiens
caccatttaaaaattatatcattgattaaatcaattttaaaatgggaagtgactttgagaaacagacttactacaaacagacacataaagaaaaatctggkacatgttaaagagaaatattgctataaaatcagaatacattatatgaagtctacatttgaattatgccatgtgtcaagtttgttaagcatataggtaaga

SEQ ID NO: 11274 - DNA, 201 bp, Homo sapiens
caccttggcctcccaaaatgctgggattacaggcgtgagccaccaccgtacccggcccatacttgggaatttttactacagctgactgaaattttttattygaatcctattttatatatgaggatactatttcttctttacagcattaaattttctagattaaaaaatactcatttccccccaagattttataaaataatt

SEQ ID NO: 11275 - DNA, 201 bp, Homo sapiens
actagatgctgcttgcattctaccatgtggatacaatgagtaaaacttgggtactaaagtcaaagtgcctgccaccacacctggctaatatttgtattttyagcagagatggggtttcaccatattggccaggctggcctggaactcctgaccttgtgatctgcccacctcggcctcccaaagtgctgggattacagatcc

SEQ ID NO: 11276 - DNA, 201 bp, Homo sapiens
caatgactccctctgtgatgtttcactcccacgcaacactcccttggatgaaatggcttgctctctgcctgaattgggctaagatatatgcctgctgaggrcttctgccctcccatctctcttctaccacccctgccttgtgaattatcttctttattcctagggaatctacagtaaatactttgtcatctatagtcattt

SEQ ID NO: 11277 - DNA, 201 bp, Homo sapiens
catgaattcagctcttcagaatcctctttcaatcctgaagtcccaactcattgatttggggcttggagagtgaatgcatctgtattaagtagactccttgmatatttaattggtgtttttgagcataaaatcaagagaagcagcaatcaacaaaatatccctacctctggcttccatcctgcacccaagctgtgacccttt

SEQ ID NO: 11278 - DNA, 201 bp, Homo sapiens
tgccaggacgcctgcttattatatgctatggtctgtccaaatcttctgtggctgccactacagcctgatttcccttggaaacttggcagcccgtgagttaygatggaattcccaggtgataatgtatctaatttccctcattgtacttcttttatcctgtaatgtgctgttgattcccacggctgagctgtgatggagaat

SEQ ID NO: 11279 - DNA, 201 bp, Homo sapiens
caacaatgttgagaatctatttatgaaaaggccaagatgataatgttagctaagtgctaaatataataaaaagtagtcatgaccaccattctagacaagcytcattgtcccgcacactttatctggacctgtggtttctggatggttaagcggcttgtactcacaaagacaaattgtgcattcttggaatacattcttgga

SEQ ID NO: 11280 - DNA, 201 bp, Homo sapiens
tctcacccatgttctacaaaatttcacttcatgattaaaacaaattatatctctgtctttgcctaagacgtgtattaaataacagcaatacaaataataamcatattaagtccattctgtgttctagtcacaatattaagtattttatatatattatttaatcttcacattactgctaagaagcagtgataaaaccaagat

SEQ ID NO: 11281 - DNA, 201 bp, Homo sapiens
aatagaaagttgagggaggcagtagttatatgcacatattttttgagccagagttccctgagtttgagttaaggtgtcctgagttttgagttaaagttccmtgagtttgctaccaattagctatgaaacctgggccgagttaaaagttagacctttacagtcttaagtctccctttttcatgtgtaagacaagggagaata

SEQ ID NO: 11282 - DNA, 201 bp, Homo sapiens
taaactacttaaggagctaacagaaaaggttgtatcagagaaacagtggagaaacacaggtttctaattatatctggcactggagagaatgtcaaaggtaytgggcctggggcaggttcacaagagtgaaagtaagagatttaaaataggttctcaactcctgataaaaacacgaatatttatttatttagtctagctttt

SEQ ID NO: 11283 - DNA, 201 bp, Homo sapiens
tcagagaggtttaggattgcataaagtcacacagcaggttggtatggcttggcatccagatgcgattttgcttaaataactgtaagtttgggtaggggagsctggaaaagcatcacatgaaaggcttttaaagagtcagggcagtgttaggaaacacaggctagccagggagtctgctggagggtaagggcctatgtctta

SEQ ID NO: 11284 - DNA, 201 bp, Homo sapiens
aggtttgtgatgtatattattttagttttataatcctaacccaatgccataggtagaattagcattttctgtattacatatgaggacacagaggggcagarccattagaacactagaataaagcaacacagctagccagcaagtagagatagacatctaggaccacagcctggtcggggctaccatccccctctacttctc

SEQ ID NO: 11285 - DNA, 201 bp, Homo sapiens
gaacctgaggtaaaggagagggcagccaggggtggaggattgcggagcagggctgaaggagaacacagaggctggacaggtctgctctcagggccggtgcrattacctcgtccatcttcctatctgctcatgtgctatattagtctgttctcacactgctataaagacatgtctgagaacaggtaatttataaagaaaaga

SEQ ID NO: 11286 - DNA, 201 bp, Homo sapiens
ccttgtagtcaaggctggacttgtcttattcatagctttatacccagtgctagcagcacactcagaacataataggtgctcaataaatacatttgagtggrtgagtaaatgcatgatgaaaaatttacaagttagtatatccatctccacataaaagaattcaaaacttatttttggtaatgtcactcaacaaatatttag

SEQ ID NO: 11287 - DNA, 201 bp, Homo sapiens
tggccttcagtgaactggcactcgtcacgttttagttgtgcctaggtaaatggatttatgtgtcaggtgatctaattttcatgaaacaacatccacaaaayagacaggtgtcttatacaaactcccaaagaaactgtgggtggaggagaaaccagcactgtatgagagcaacaatgaagtggccgagctgtcacttctcct

SEQ ID NO: 11288 - DNA, 201 bp, Homo sapiens
aaacctctaatcatgccttagtttttctggcccccatctaggagctatggtggagtccccagccactagtcatttcattggcatataaaagacactatggmgattccaaggattttaggagctgtatgccagaaatggcattttgggagggggtataggaaaatgttggggtggagagtgaggagttggcaaagaccaaca

SEQ ID NO: 11289 - DNA, 201 bp, Homo sapiens
ggtctgtaatttttctcagaaggctaacttatagtccaggtatgtgtgcactctgcccattcagtctttgcctttggtttttctttgatctggaggatcayaggaggcaagtgtggaaatacttcttcctggagacaatggcagaggagagtccgtgtatagaaattgatttgttaacccttgcgatggcctccctctccc

SEQ ID NO: 11290 - DNA, 201 bp, Homo sapiens
atatctagattcagtaggaaattgggggtgatgagagaattttaagaaaaacgcttgctttatcaccagctgtgtcattttgttcaaagggacaggaaacwtaatactctctctgaagcttaatagaactgcagacctattgccacagttttctcttttgcataatcttgtttagtcacttaagagctagtgagtgacaga

SEQ ID NO: 11291 - DNA, 201 bp, Homo sapiens
tgcctaggttcaagtcctgctctgccacttatcagctgtgtgcctgtgggccggttccctaactgctctctgtgtctgtttctgcatctgtaaaataaggsaatgattacaggtatctcaaatgggtgttgtctgtatctaatgggatggagaggtgttaaatccttaccatggtgcctggtggtaggtgcttaataagtg

SEQ ID NO: 11292 - DNA, 201 bp, Homo sapiens
atggccacttctatatggaaggagtgatggcccagagaaggggatccaagctttcttggattttagatttcctatttctaactttaggcatccactctagrcacttctgaagaagaatgaagaaaatgtattgggtattctctctatacaggaatggaatacttttcggattaaggagccctgccccattcaccataacaa

SEQ ID NO: 11293 - DNA, 201 bp, Homo sapiens
atccctcgtaggtttccagatcctttatttaaatgtctgacctggagatggatcctctgacctttcttttctgcaagaataaaatgaggcagttgggtttyacgctctctcaggcccttttcaactctaaaactctgattctcaaatgtcatcagcttggcaatgctttctcttatcccaaggagagagagaaaggtgaat

SEQ ID NO: 11294 - DNA, 201 bp, Homo sapiens
ctggcagatggcaagtaccaggctgatatcctgcaggttttttgtttgtttgtttgaaatggaggagtctcactctgccacctaggctggagtgcagtgaygcgatctcagttcactgcagcctccgcctcccgggttcaaggaattctcctgcctgtctcctgagtagctgggattacagcatacctggctattttttgt

SEQ ID NO: 11295 - DNA, 201 bp, Homo sapiens
gcaggttttttgtttgtttgtttgaaatggaggagtctcactctgccacctaggctggagtgcagtgacgcgatctcagttcactgcagcctccgcctccygggttcaaggaattctcctgcctgtctcctgagtagctgggattacagcatacctggctattttttgtgtttctagtagaggcggggtttcgccatgttg

SEQ ID NO: 11296 - DNA, 201 bp, Homo sapiens
acagttttgtgtgtttgccttggagaaaaagagaatttcagttgcccatgattcatacatttttatgtggcagcttccttgaaagggaacaaacgttgaarggattcatttggcaacattattcccattttatagatgtgggtttttaggcttgaggaggttgtgacttttctaaagtcatgtaattaattagtggcgaag

SEQ ID NO: 11297 - DNA, 201 bp, Homo sapiens
agaatatgatattgcattcaagcttcatcatacttttggtagcgcctttgcttgctacatgataactgtcattttagctgcaatttttcaaaaatctcctraaacactcttctcacacaatcggcctctcttaactaacttgtagacaattttgcccttctgctcaagatcttttctgcctcctttagatttcctccctat

SEQ ID NO: 11298 - DNA, 201 bp, Homo sapiens
tatgctcatttcaccttcagtgcccttgatccaaggtctcagatttatcctagtttcattttcagtgaagtattgatttgataaaagaaacgagtcctgckgctgattgcttagacacttgttagtttcacctgcatatgtaaggtggagttggctgtagttcaagcaatagaaagaagaggtactattttaacaacagtt

SEQ ID NO: 11299 - DNA, 201 bp, Homo sapiens
taatggcacagaaattctgcccagggatagatgcagagtgtcacaataagagtttccactctgcctggagtcactgactatctggaacagaagttagagawgttcatggctaagggttttcttaaacaatggagatcttgatggcaagcagcttatagggagcaggcagctctatgataccagcagcaatgagcaaactgg

SEQ ID NO: 11300 - DNA, 201 bp, Homo sapiens
ctttgggatggagaggttagggaagattctgtggaagatgtgagatctgagctgtgttctatggggtagctaggtcgaggtaaaaaatgccatagccaagmgatcagaggcataaatatgcaaggagtcttgggtggaatcacaaagtttagcagatgagtacatgaaggtagaccctttgtgccaggaagtaattttgac

SEQ ID NO: 11301 - DNA, 201 bp, Homo sapiens
aaagcgttaaggtttggcttatttgttttgggcagatcacagagatccaggactcagagctagggaatagacagctgaccccaagctggaaaaactttccyagatactccctcctgcctaggaagtggcctatgaaaaagcagtttaaataatggcagcctaaaatatagttctatatgcaacatttttttttctatgaaa

SEQ ID NO: 11302 - DNA, 201 bp, Homo sapiens
taatttggttgaaagagtcatttttattcaagataggagagtagactcattgatttctgttagtcttttctatgaatctgttatcggaaatagttgactayaattaaaataattcctggcactataacactactagacatcttcatgtcatgtagccaacatctttttttcctttgcaccatataatctgttttctctatg

SEQ ID NO: 11303 - DNA, 201 bp, Homo sapiens
cttttaagcctatgatgatattttatatcaaaactgagataaataaaaaatgttcactgacaataatgactatagataaatgctgtcagttgtaaggaagygtcaatcacagacagacgtcagtggatctgtgagggccacactgaatttttgcatgtgtaaactgtataaaataagattttaaagaatgtcataatcata

SEQ ID NO: 11304 - DNA, 201 bp, Homo sapiens
ttttcatttatttttttttgagacggagtctctctctgtcgcccagcctggatgcagtggcgagatctcagctcactgcaagctccccgtcctgggttcaygccattctcctgcctcagcctcccaagcagctgggattacaggcgcccgctaccacattttttttgtatttttagtagagatgggtttttaccattttag

SEQ ID NO: 11305 - DNA, 201 bp, Homo sapiens
ggttctgaatcaaaagatcagtgtagaggcttggagtggcatttgtgtggggtgtgccagaatatatttattttaattcaagaagatttggatttcagtcmtaagtctgtcacttgctaatggaaccatcttggctgtgtgctattaaaacttccagagcctcagtaacatttgtaagaatgtggaaaataatatcttcct

SEQ ID NO: 11306 - DNA, 201 bp, Homo sapiens
tacccactgtaggcttccctctttggaggcattgattagtagatacgaaatccttatcttctctctagagtttgaaatgtataattaacaatggagtctgycagatcaacaattctcatcacagaatgtcctgtgttttagtctttgtggaccatatggttgatctaccttatcattgttattagtgtggacccttttttg

SEQ ID NO: 11307 - DNA, 201 bp, Homo sapiens
atggctcaggaatgatactcaatttatcagttaacactgttctcttggcccaacccatcacaacgagacccaaaagtcctctcttactacaaccctataakggaggagaactaggaaagtgtggtaaacagtgccgctcattattttctttactaggaaccagactttgaaatgggtatggaagaccttgctgtgcctggc

SEQ ID NO: 11308 - DNA, 201 bp, Homo sapiens
tagcagttaagacactgagacctgcttccattgcccatatccctggcatacatttgaaaatcccagttctgtttctctcagctgcaattttctaaaatagyggatgatgcattccgtcttccccaggggcagtctggaatgaacgaagagatagccttcagtgacatctttattcctgagaattcttcttgcccctgagca

SEQ ID NO: 11309 - DNA, 201 bp, Homo sapiens
ggcatacatttgaaaatcccagttctgtttctctcagctgcaattttctaaaatagcggatgatgcattccgtcttccccaggggcagtctggaatgaacraagagatagccttcagtgacatctttattcctgagaattcttcttgcccctgagcatttctgctcctggagtctgaccctggtgtcggtagcatctctta

SEQ ID NO: 11310 - DNA, 201 bp, Homo sapiens
attttcttttgcctctgactttaatacatagcatttattctttgactgttcattagacccacagtctgattttttagtgtcaacaaagcaataaagaaaawttgttcctcctttatttcagggctcaagacaaaattcaaaaatgcctttggcattcattttgcacagacgaatgttgttaggatattcctattagcatgt

SEQ ID NO: 11311 - DNA, 201 bp, Homo sapiens
cctgcaagaaagtgctttctgccagcctggtgcaaattggcagaacctttaagccactctttctcagcttagcagcagtatatcatcattacctgtggctrgaccaagaaatcacatttgtcaatgcctgaattgctcttttactttcagtggttttagaaatccactttgttttggaaatgggcttagctgagtatgtta

SEQ ID NO: 11312 - DNA, 201 bp, Homo sapiens
tttcttagatgaggaggattcataaagttctgatctctgggagatacttcagaagtgagtggggaaaaaaaggtagggaagactggatttcatattcaccrggcctattattcacttttttatctatatgtgaaatcatacatagaacattttccaaatgataccactgttctgtcctcttttgctaaatttaataacatt

SEQ ID NO: 11313 - DNA, 201 bp, Homo sapiens
actggcagtgtcacttgtacaatatgctattagtctaaacagtcacagagctttcccagtttcagaggaggagacataaatatcacttctcaataggaggmggagtagcaataatttgcaaccaacctaagtctaccacattactaaggctaccatattataaagtagggagggtggtgtacttctagtggctatgttata

SEQ ID NO: 11314 - DNA, 201 bp, Homo sapiens
gtatagaatttagacagggaatttatctgagggattgactgaaaatgccttacttatgaaaaaagagttcttggttggtgtttattattcatgtaggtccrtttaccttgaagccataatgctaatatagcctgtcatttggaagttagataaatagtaaagcactttaaagaatcactaaaagtttcctcacaaccacag

SEQ ID NO: 11315 - DNA, 201 bp, Homo sapiens
tgtgatacttcacatgtactctttaaaaaacttactaagcctgctcagcttttacacagggtacgccggcacacaagtgtgacctggtccttactccatcmtcaaagataagttgtccccacagtctgccaaaaagatgtccctgatgcaatgagaatgagctggagtcctgactgtgctacatttttagtggtatcctaa

SEQ ID NO: 11316 - DNA, 201 bp, Homo sapiens
tgagaatgagctggagtcctgactgtgctacatttttagtggtatcctaactctctattccacagacatcagaaaatgtcacaacatactctttgtaactrgtccctttattatgtccatgaatgtaatatatacaatgattttcaaagagggtgatttttcacccctcttctctccctgccccacatacaaaggagactt

SEQ ID NO: 11317 - DNA, 201 bp, Homo sapiens
tgtttcaggtacagctccatgtatgctgcagatgatttgggttaaaaaaaaaaattggccagcctaaactttgaggcaaagaaattgcatttcccaatgtytcatttctctttccttttactttacttcatctactgtgaatgacccttatttttttgttgttgctttatggcaataaataaacgaacccccattgtgcaa

SEQ ID NO: 11318 - DNA, 201 bp, Homo sapiens
tcagtttgaacccatatactcttaaacactatttatacagtattaatgtgatttgacaaaagtggcataaagagcaatgactctttaagactcaaaagaaratgttcagatttatattttgatattaatattaatatcagcaagataagctgttaaataagcattacatgtaagaatcctgaccttggataaaattaaatc

SEQ ID NO: 11319 - DNA, 201 bp, Homo sapiens
tcttccggcaacagcagcagcaaaaactggaggtgggggtgaagggaagatggaagtgacagactccatattcataaaagctctgatgataaatttttttwaaaaaatgtgtttgttttaaataccagtcttccatgaatcctaagaattgcacagtaaaaaataaaatctgcctaccatttaacagcccgcaatacaaaa

SEQ ID NO: 11320 - DNA, 201 bp, Homo sapiens
accaacaataacttggaatgtgtctaataagtgcagcctaatcttaattttattgggagttatctcagctaaataatggaaaatttgacaaacctaattawtgaattatccactgttaaatcttctgtgccactgagtcctctttttagtaaaatgattaaaaacattaactatagtggtatataattactattaacaact

SEQ ID NO: 11321 - DNA, 201 bp, Homo sapiens
tcttactcctttactttgtggtcatttgttttgcagctatttagacagttacttcttaaagaacccctaaaactatttagacagttacttcttaaagaacycctaaaactatttagacagttacttcttaaagaactcctaaaactaccatttgttcctctagaaaggattaaagatttgctgaagcaaagttctcctgac

SEQ ID NO: 11322 - DNA, 201 bp, Homo sapiens
tgtccaagagcattcttacacaactttcttttgtaaatttttctttcatgccaaaaaacatgcgggcaatttgttgatgtaagttgactataaattaatayggtatgcttttttagtttaaattattttgcctatatggaaatgatttctttttttcccagaacagcttctatttttaatttgcttttactttttctttcc

SEQ ID NO: 11323 - DNA, 201 bp, Homo sapiens
cagtaaaatactggcaaaccgactccagcagcacatcaaaaagcttatccaccatgatcaagtgggcttcatccctgggatgcaaggctggttcaatataygcaaatcaatcaatgtaatccagcatataaacagaaccaaagacaaaaaccacatgattatctcaatagatgcagaaaaggcctttgacaaaattcaaca

SEQ ID NO: 11324 - DNA, 201 bp, Homo sapiens
tgtctttgtcacaactaagagtctgaccttggatgagtcatggtaagactctgtgtcatatataaagagtattctgagagtaaaacacgcatacaaatgamaagtatggttattatggtctcttgaatattcttagatcaatttcacccattggatggggctagtatatggttgatggatggtatttgtttcatttatctg

SEQ ID NO: 11325 - DNA, 201 bp, Homo sapiens
aaccaggtgagcttggtccccacaaagccctactggtacttaagcttcccatttcaagaggacatttgggttcactacacctctccaagccgtctgattarttgcagctgtgtgcaaattagttttcttcaggggctctctcctgctctcagattagcaacaacgtattcagatggaaagcaaataaagatagttgtaaaa

SEQ ID NO: 11326 - DNA, 201 bp, Homo sapiens
tgggtgtataaataaaccgtgttttagacctctaagcctttgcaaatactatttcacctgaaatgcccttctccttctccagcccacccgtcctcacttcyttcccctgtctcaccactgcctgtccctgagggctcatttcccacatgctctctgccttcttgctatttccttccttcacacattaatgcttcctcttgt

SEQ ID NO: 11327 - DNA, 201 bp, Homo sapiens
caatcactgtgaggggaaaaaatgtgaagatgacattgaacgcaacttgataaacattcccaacgtaactatgaatagaagagtttcctaaagcaacactrtttcctggaggagcgtggatggtggacagttaaaaataacaattcactacaagtgtttatacccttggttacagtgaatactaaattaatgtgaattaac

SEQ ID NO: 11328 - DNA, 201 bp, Homo sapiens
gatgcaacatgtttgctcttgatgggtgcattgatgtcagaacaactagggggaaataagaccaccttggtactgttatcatcgtcctgatgatggtcccktcttgcagaaaagcccaaacagaagcagggcgttgtctaatcactgatgggtttcctgatattattgagaagaccaagcaaaattaatggtgatattata

SEQ ID NO: 11329 - DNA, 201 bp, Homo sapiens
catttaacttctacaggttatttcctgattaatttacatccatttgaagctctcacttttcataaatttgggtagtttagtgtgtgctataattcaatttktattttcatatgagcatcaaattttaaatgaaataatttattttttcttcaaatcacattggatttttaaactgctggttttgagttagttataagcaat

SEQ ID NO: 11330 - DNA, 201 bp, Homo sapiens
ttaagcaacctagagtactggttcccaagctcgaatttaaaactagtaccagtctatgccaaagctttcagtgacccatagtgaaatgagaaaagcaaggwcaatatggtgagtctgcacaaagtcaaacttacagaactgccctatatttggatactgtatcatgtttttttggatggctaaaatcaatgtcttttacaa

SEQ ID NO: 11331 - DNA, 201 bp, Homo sapiens
ctatagttccagctacttgggatgctgaggtgggaggattgcttgagcctgggaggtcaagggtgcagtgagccatgatcacaccactgcactccagcctkggcaacagagcaagaccctgtctcaaaaaatgaaacagaacaacaacaaaaatcgatgcagagcatgtattacatttgtaatcagagagaagggatatct

SEQ ID NO: 11332 - DNA, 201 bp, Homo sapiens
agattatattaatgaattaaaacatttgattacctttaatccaagagaatgcagcagtctctttagtcatttagtttatcagggttttttgatggttcttyttttttccacgtgcatcttacgactatagtccacccctgaagctgtgagatctttcagcagatgttgttttccatatctttaccctttccgttgtggaag

SEQ ID NO: 11333 - DNA, 201 bp, Homo sapiens
agacacaggcaaagtaatctctccatttggtcacaatggactaaactaccttgttctattgtctaccttctctctcactgactccatcaaggcagacttgytcggtaaactattcaggtgactttgtgaacttttatttggtgcaaggctctgttaatagctgtaagtcagctgtttttggtcctccctctcattctcttc

SEQ ID NO: 11334 - DNA, 201 bp, Homo sapiens
atgttaatgcagaactaggtcagattatggcatttcacacatgcaagatgggaacacgcttcctctggttagacaaaggcttgacgattgcccatgcatcyggtcctgctttaaaggaagctcatgtaatcatgagaactcacaatgtatccatagatttcttagatatcaagtttctatgagcctaggcattgtgtatgg

SEQ ID NO: 11335 - DNA, 201 bp, Homo sapiens
attgcccatgcatccggtcctgctttaaaggaagctcatgtaatcatgagaactcacaatgtatccatagatttcttagatatcaagtttctatgagcctwggcattgtgtatggttttattgttattttgccaaacgagggttttctagcttcacttagtatgcctggagaaagctattttggttcggcccagctccatc

SEQ ID NO: 11336 - DNA, 201 bp, Homo sapiens
tgcctggagaaagctattttggttcggcccagctccatcactctaagaaatgatgaggatgagcgctctcagtttgtaccgactactcatgagagactaaraactgatcatctggctgctggcaacattccactgcaacagctaatacagtgttttggaaagatgccgacaacaaccagattgcattaagcactttaccgt

SEQ ID NO: 11337 - DNA, 201 bp, Homo sapiens
taactagagatagtaaaagaatgaattaaaattccagtgagccaaactacaacattgataatagtaatgagaattaattctgtgttgattttatggtgccyttgcctcgtaagtatatataactctggagtttatgaggcatgtttatagatcttaacttcttaattttgtaatgctgtcctcttaaaatttttgcttgag

SEQ ID NO: 11338 - DNA, 201 bp, Homo sapiens
agtaaaagaatgaattaaaattccagtgagccaaactacaacattgataatagtaatgagaattaattctgtgttgattttatggtgcccttgcctcgtargtatatataactctggagtttatgaggcatgtttatagatcttaacttcttaattttgtaatgctgtcctcttaaaatttttgcttgagacggacaaaac

SEQ ID NO: 11339 - DNA, 201 bp, Homo sapiens
gatcttaacttcttaattttgtaatgctgtcctcttaaaatttttgcttgagacggacaaaacctcctgaatttcttcaatttacatgggcatttttactrggaaagagcatgcagccttcatcagattctcaatagggtttattaacaaaaaatgttgagaaatcacccttaaaaggcaggcagctcttaaatgcttgtt

SEQ ID NO: 11340 - DNA, 201 bp, Homo sapiens
aaagttcttaattgacatactcaggttttttaaaatttaaagatccagattggtagctcagccatatagctaaattgaataattatgcaaatgctgcacartatttaattggaccttttggaatgaaaataacccaggtgtgcacaattctttgcaatctggagcaaccattctaatatatatctgcaagtgacaacatct

SEQ ID NO: 11341 - DNA, 201 bp, Homo sapiens
tagagagaagagcagaacaaatgcagttattcctctcaaagttcagctgaatgctactaatagttcaagaatgtggattgtaatggttctgtgcattgaargaacacaatggcaaatgacaaagatgacactaagtgtgagccacagctattgttttgatagcccactctgcttttctagttaactttcttagaaccgtca

SEQ ID NO: 11342 - DNA, 201 bp, Homo sapiens
gcattgaaggaacacaatggcaaatgacaaagatgacactaagtgtgagccacagctattgttttgatagcccactctgcttttctagttaactttcttasaaccgtcagttccatatttaagactagaggatcagttctgatggtgctcattcaaactcttgccaactgacatttaatgcactttaaagttgttaaaacc

SEQ ID NO: 11343 - DNA, 201 bp, Homo sapiens
gaaggaacacaatggcaaatgacaaagatgacactaagtgtgagccacagctattgttttgatagcccactctgcttttctagttaactttcttagaaccrtcagttccatatttaagactagaggatcagttctgatggtgctcattcaaactcttgccaactgacatttaatgcactttaaagttgttaaaaccaagag

SEQ ID NO: 11344 - DNA, 201 bp, Homo sapiens
gaacgccactgctttacaaagttattcttttcaccactaatagttctttgatgtcattttttgtacaagtgtcaaagtttttctctagaggcttccacacmgttaagttcttgcttttggattctttctaaaccaaataaataaatcttcgagactgcaggttaatcaaatgccttcaaacatgaaggctgtttaggagct

SEQ ID NO: 11345 - DNA, 201 bp, Homo sapiens
tttaatgtaaaacatgcaggactagatacagtcacggccattcaattttttaagttgtatatctttgggtgagttacttagcttatttcagcccagatttrctgctatgtaaggtgtaattataattattgagtaaaataaactaaagcatttaacacgatgtctggcagagactaagtttttaatactcttaaaaacatc

SEQ ID NO: 11346 - DNA, 201 bp, Homo sapiens
ataaaaatcaccatgagatatcacctcatacatggtagggtaggtattatcaaaaagacaagggacaacatgtgtcgatgagagtgtggagaaaagggaascgttgtacactgtgggtgggaatttggattggtccagccattacagaaaacagtatggaagttcctaaattaaaaatggaattgccatataacccagcaa

SEQ ID NO: 11347 - DNA, 201 bp, Homo sapiens
aacccagcaatgccttttctgagtatatacccaagggaaaggaaattaccatcttgtagaggtatctgcactccatgttcattgcagcattactgtaccgyattatgaaatgggttccttcaccccttttctgagcaccctccatgtctacagaagaagttatgaggaacaaaggtatatgcagggctcgttttgtaatgc

SEQ ID NO: 11348 - DNA, 201 bp, Homo sapiens
aatcctcacatccagacttccatgtccatgtacagggttctctactttcgttctaagtcaaactgtgattcagaaatgagccatccattctcccagaattyctccattcaccccacagacacaaaaatcaaatctatgaaaatgtttttgtatatttcataggagaaacagatgtggaggcttaactcatgtatccaatgc

SEQ ID NO: 11349 - DNA, 201 bp, Homo sapiens
cttcatcgttcaagggcttctgcatcgcctttcaagttaaaatggtcccgctggttatgatgggcaagtttacctaagggctactgggtatgtggcggaargatggaggggagtgagaggaggcaaggctggtatttattttttaatcttcgggcttaatctgcctaagtcatatggggcaaacgatatttcagacgggtg

SEQ ID NO: 11350 - DNA, 201 bp, Homo sapiens
gctgagctcggggcagggactatggatggggcccactcccagccctttcctgcaggttgttcctcaaattatactcctcagagagacctttcctgaccagytttctaaaatagtccccttacctcaacctcctggctgctttccagcccatgacactgtctttaattttaattggtgaatcattatttaatattatattat

SEQ ID NO: 11351 - DNA, 201 bp, Homo sapiens
cagaagctttacacatggtagttaactcattgccttctcatggtgatcttgtgaggtggacttcatgggttgcattttacagacagagcatggtggctgaragaggttttatggcttccctcggtatacccctttacaagtgtgatttgaacctagactgactccagagcctgtatttgtgactgtgatgaaacatgcttc

SEQ ID NO: 11352 - DNA, 201 bp, Homo sapiens
aaagtttatgccatattaccatcccacctgcagagtataagaattaacattttccagcccctttataatgtatttttgctaagcctggcctattagatagscctaaaaaagtgacatttttttttttgttttaaccttggccagttctaagaaagagcacgagcatgtatgaatgggttcttcagtggtgtgaggaaaaaa

SEQ ID NO: 11353 - DNA, 201 bp, Homo sapiens
cacttgcccatgcaagcatctttatttttctttcccaacccagagtaccactggcatggtgcaatgtgtcatgtgttgggtcttttcagattggctgagaygatgcacggcacacttggatgttgttgaagtacttacactttgcttgggtagagtttgcatgaaagagcattatttaactctttgagtagtaggattggg

SEQ ID NO: 11354 - DNA, 201 bp, Homo sapiens
atatcttcaaggcgagggaagagggaagagtcccgttttcttttaaggtaactggcatgctgctgggggcagggggtgagtggggagcctatagaggttcragaaagtgttgatagaacagggtcccagggaggtggcagggcttggagaaagagcactggggataagtcagttttaaagggaccgtttttcattgagaag

SEQ ID NO: 11355 - DNA, 201 bp, Homo sapiens
agcctatagaggttcaagaaagtgttgatagaacagggtcccagggaggtggcagggcttggagaaagagcactggggataagtcagttttaaagggaccrtttttcattgagaagggaagtagggaaggtaggtaggagagaaagtgagtagccagaggggagagaagcacaggccttcatgactaaaaacctcaatttt

SEQ ID NO: 11356 - DNA, 201 bp, Homo sapiens
aagaaaggtggatgaggtggggcacatcagacctacactttttctctttgcagagcctctcactactttttgaagttcttgatcttcactttcccactagkctctaagctccttgtagtcaaggctggacttgtcttattcatagctttatacccagtgctagcagcacactcagaacataataggtgctcaataaataca

SEQ ID NO: 11357 - DNA, 201 bp, Homo sapiens
ttgcacacccactagcctagggctctcaccagagcacctcccacctctttggttctctgcggtgacgtccttcagcataggcagttaacaccgaagcagaygaggctgaagtacatcgtggtgcttataggcttggaagttccattctacttaacttactatgttaagtgctcgtagtaaatttggagctaagacttggac

SEQ ID NO: 11358 - DNA, 201 bp, Homo sapiens
cagtcagcaagcacatgtctatgatcgactctgtgccaggcactaaacctaccatcgttctaagctctgcaggtcctaatacttgccctggcctgggaggktctgaagtgtgccctcttgctgtgtcttttctttgccactatcttccttctttatgcctcacatgtttatgtcttcctacaggacacagtgtgagggttg

SEQ ID NO: 11359 - DNA, 201 bp, Homo sapiens
gctaccttggggatggagtataggtagtaggtggaaaagagactgttgccatgagttgcttttggtatgaaccttagaagattgtcaaggcatggtaagarggcatgattatttctgtcctttgtgtagtctttgatgtgcacatcctggaaggtgtattcattgttcttcccaatttataggagaagaataaaaaattga

SEQ ID NO: 11360 - DNA, 201 bp, Homo sapiens
taccttggggatggagtataggtagtaggtggaaaagagactgttgccatgagttgcttttggtatgaaccttagaagattgtcaaggcatggtaagaggrcatgattatttctgtcctttgtgtagtctttgatgtgcacatcctggaaggtgtattcattgttcttcccaatttataggagaagaataaaaaattgaat

SEQ ID NO: 11361 - DNA, 201 bp, Homo sapiens
gccctacttgtccttcaagtttccttgcaggttcctctcctctgagaaacctctgaccgcaccagccctgagtcatcttgttcctctggattgtattgtaytccatgtatagacctacttagtactggacatagaacccctaaagatgtccagtctcttctgggtcatccccagtaacagggagcccgcttcatttggagg

SEQ ID NO: 11362 - DNA, 201 bp, Homo sapiens
atgagatatgatggttttataaagaggagttcccctgcacaaggtttctcttgcctgccccaatgtaagatgtccctttgctcttctttcatcttctgccrtgattgtgaggcttctccagccatgagtccattaaacttctttcctttataaattacccagtctcaggtatgtctctattagcagcttgagaatggacta

SEQ ID NO: 11363 - DNA, 201 bp, Homo sapiens
aatccacaggaacattcttccacttctgcttttactgttcattctatctacaagtgcttcccaaactccagctccatgacgaggccctgtggcagacaccrtgttgaagcagtcattgcctccagggagccccccatcagcaatctggttccagagcctgggctcttaattgccgtgctttactgtctctgaagtaaactt

SEQ ID NO: 11364 - DNA, 201 bp, Homo sapiens
attgcaaagaggcacagagattgactgcagtgttgttcagccaagcctccaagggagctgagagtatacagcatagcctggagaacctcccaggttcaacygtgacttcccagggagaagcagggaggcacagaggcttaggttgccctcccttgctcaccaaatctgactgtttgggattagatctaagagaggtggctc

SEQ ID NO: 11365 - DNA, 201 bp, Homo sapiens
cctactggtctcttcgtggaggtggtgtaaggtatagggcagaacagtggttctcaatttagctgcatgttaagattgtcttgggggaatttaaactccasaccacaccccaggctaattaaatcagaatctcttggcatgggatccaagcatttgtatgtttttaaagctctccacataattcctgtgcacaatcaaggt

SEQ ID NO: 11366 - DNA, 201 bp, Homo sapiens
ttatgtctataaatagaatgctttggtggtcaactagacttgttcatgttgacatttagtcttgccttttcggtggtgatttaaaaattatgtatatcttrtttggaatatagtggagctatggtgtggcattttcatctggctttttgtttagctcagcccgtcctgttatgggcagccttgaagctcagtagctaatga

SEQ ID NO: 11367 - DNA, 201 bp, Homo sapiens
agctccattttacggatgaggaaaccgaggaaccgagaaattgggaacttgaaccccccgtttggcatagtggataagagtatggctgctggagggaaaaygatccggacttaaatttgggcttgtctacttacatgttgtatggctctggagaaggtttttgaagcttcagtatcttctttagtaacaatgatagctaat

SEQ ID NO: 11368 - DNA, 201 bp, Homo sapiens
gtatggctctggagaaggtttttgaagcttcagtatcttctttagtaacaatgatagctaataatcacagagcactggctccaggctcacactgtcttagktgcttttcatgcactagctcttgaaaccctcgcaaccactcttgacatgcgattatgattctcatttttttggataaggaagctcggggcaagaggttaa

SEQ ID NO: 11369 - DNA, 201 bp, Homo sapiens
ttctaagtctccacacctaattttgtatttgcaatttctttttcttaaggactcccaaatatcataagcaacaggtcccacctctgtggatccgcctctgytaacacaacttgttgctgtccgtgacagcaatgttgctctgggtgtatgtgtgatttcatttttttcttctaaccagtgaccattcatcacagacacatt

SEQ ID NO: 11370 - DNA, 201 bp, Homo sapiens
ccacatcatggggaaagggctggacaggctgggagtttaccacacactcagtttcttccttcctcctcattctctcaggcttcttttctttccagacgggrccctgtatcttgcatggttagccttgagagttaagagaatgggaaagagtgggcttgaagggcactgagctctgacctgtggaatccttgaaagacaaat

SEQ ID NO: 11371 - DNA, 201 bp, Homo sapiens
taggaatgtagaacaggaaagccattgtgaggagcaggtttggggtgaagatgagagaggagtaaaaatagattttgatttggccgttatcctgccttccktgcagatcctataggacccttgtcgggagatgtacaggggcaggtgggggcaatggttggcattggcggggggaggatgggggctgccacaagtttcagg

SEQ ID NO: 11372 - DNA, 201 bp, Homo sapiens
ggggcaacgccttcatttttctaagcagaagagactgaggtgttaggggcccagctggtatgcgatgggaaccaagaaatggagcctatgtggacatgcaygctttacacaaattctctcgctgaaactcgggaatgttatcagaaagctatctctttccacctcatccaacaacaatgcacactatttgaggttcactgt

SEQ ID NO: 11373 - DNA, 201 bp, Homo sapiens
tagcttcaaactctttcttaacacagtattccaggttgtcaacaatcaaagaacagggaattagtatgtgctgagcatggtgtcaggcaggtcattaagcwttttatatacaattgattcttttgataagcttgacaactctggaattgatacaatgactcccaatttatagatgaagtttaagggacttatctaaggtca

SEQ ID NO: 11374 - DNA, 201 bp, Homo sapiens
gggcagatcctctgtctcaaggaaatcactggggtcaagtaatgcaataattgtgattgccagcctcaatgactacttcttttgtgccagacaccttgctragtgcttttgcgtatgttagttctttataatgcttacatcagtcctaccaggcaagtagactgtccccattttacagatggggaggttagggctcgaaga

SEQ ID NO: 11375 - DNA, 201 bp, Homo sapiens
gcaataactacatgcttttgagcccttcctgtgtgctaggaactgtgctaagtgtattccatgtgtggttacatgtgactgtcacagtgattctgaaaggmtattttgcagatgagaggcaggaaattttacaggtatttttcagatgagaggcagaaggaagtgcaaagttaacttgctcagaagtcccaccattagtga

SEQ ID NO: 11376 - DNA, 201 bp, Homo sapiens
tttcttttaaccaagtctagggccttttctcctctcttcttactatacccttcccccacaaaagacccaaaatgaattttttgaacaaaacaaatcatgaraatgacttgttttatcttgatttcattcttccgtgagtatttatcctggtcctagagcaacaaatactaaaactatctatttaaaatattatagtttaat

SEQ ID NO: 11377 - DNA, 201 bp, Homo sapiens
ttccagttagcacttactcaattattgccctctcctaattggtctttctgcctctgttctcttctagtctatccagtggttgagaattgcttaaactctgyggcccacaaatggagtgcaggattagctatctccctttcaaagccttcccttatatggtcgtgtttacctttatcttgctcctctgttaagcttaactac

SEQ ID NO: 11378 - DNA, 201 bp, Homo sapiens
ccattgttccttgttgctggtaagaattgctaaatggcaaatatgcattgaacaacacactcttctattattagtgatatctctgaacctgaacttgatamtgtgagttttgtggtccagtattttacctataatggcttgtgtgctatgaagttgatgaaaggactgtgaaactcaaatcaaatagaggctaatgcctct

SEQ ID NO: 11379 - DNA, 201 bp, Homo sapiens
gccagattgtcatcttccaaaaaaattttgagaaacgctaataatgtttttttttttaactttttctttaggtttgggatatatgtgcagatttgttatayaggtaaattgtgtgccataggggtttggtataaattattttgtcacccaggtaataagcattgtacccgataggtagtttttccatcctctttctcctcc

SEQ ID NO: 11380 - DNA, 201 bp, Homo sapiens
agaaacgctaataatgtttttttttttaactttttctttaggtttgggatatatgtgcagatttgttatacaggtaaattgtgtgccataggggtttggtrtaaattattttgtcacccaggtaataagcattgtacccgataggtagtttttccatcctctttctcctcccaccctccatcctccaccctcaagtagtcc

SEQ ID NO: 11381 - DNA, 201 bp, Homo sapiens
aacgctaataatgtttttttttttaactttttctttaggtttgggatatatgtgcagatttgttatacaggtaaattgtgtgccataggggtttggtatarattattttgtcacccaggtaataagcattgtacccgataggtagtttttccatcctctttctcctcccaccctccatcctccaccctcaagtagtccctg

SEQ ID NO: 11382 - DNA, 201 bp, Homo sapiens
gcctgtaacattgcctgccccatcatagaaacaacttagtaaatacttgttgatgagttaagtaacttcttagcagagttctgcaacagggccagccccargtcttcctgtgatcccattatgctttcaatagagagggtctttgggtacctccattgcaagagggaatcattagtctcttcctttagaacaagttcatcc

SEQ ID NO: 11383 - DNA, 201 bp, Homo sapiens
ttagaattcctttagtcgattccactgtgattttgtggatgacagaacatgctgagagggcatgagtgatgtgtttgtcactgcacagaaaatttgtagcrcaatcgggacttagaacagactttctgacttcagatgttgttttctttctcctcccaccaagttgcctctaagtcctggtcatcttcactgttgatggta

SEQ ID NO: 11384 - DNA, 201 bp, Homo sapiens
tagtgcccgtccgtgaggcagccttgggggatgttgatgggtgcaggaaatcggttcttaaattgttgcaaaattgccttccttcagactgttttgatcaygagggctctcaagtgtcaaagtcatttgtagaactagatagataaaatgcatgagcactaagctttttttccaggatagaataaataagtgtgttttcta

SEQ ID NO: 11385 - DNA, 201 bp, Homo sapiens
agcactacttctttcttagaaatggtttatcttgtctgaaataatcctccagtttccctacttttacctctgcctttctttaaataaaggttttttttttwaacaaaactttctcgtatcagtttaaatacatttctgaatgattacatggcattatccccattttcacaggcaagaaaacagaggcccaaggttacaaag

SEQ ID NO: 11386 - DNA, 201 bp, Homo sapiens
gtaacactcttccttgactgtattagtcagggttctccagggaaacaaaaccaagaggagatatatatgaacatgatgattgttatgaggaactggctcamgtgattagggaagctgagaagtcttatgatctgccgtctgcaaactggagaggaagccagtggtatagtttcagtgtgagccctaaagcctgagaaccga

SEQ ID NO: 11387 - DNA, 201 bp, Homo sapiens
cttcacaagtccaccccttttcaactcgacactcatctatatctccttaaatgatacttaatctataaataaagataaaaagatcataatttcacctaacrtgatacacctatcctgagtataattgaaaatgcactaaagagttggttttcctcctacagtatattggatttagggggaggctggatatttgactccaaa

SEQ ID NO: 11388 - DNA, 201 bp, Homo sapiens
tgaaaggggaaggccattggtatcctagcatctgtggaatcagggactcagcatcttaggatcttagttcattgacatgaaaagaggcagggaaatgtctrtgggaatggagtgaatgccaggcccaactttcttaagtggaaactgctctgatggcatcctttccttctgccttgatctcaggcctccacttaggtcacc

SEQ ID NO: 11389 - DNA, 201 bp, Homo sapiens
gttcttattacctgccttagccgtcagtataacaaggggcagccagtgtggcaggtagaacagaatgagttccctagggtgcaacaactggaaggatgtgkttatcaggttcttcaaaccaaataccatgagagcaaaggcccttcttgaaagggctgctgcctcttagcaccaaggttgcatttgaccttctcaaactgc

SEQ ID NO: 11390 - DNA, 201 bp, Homo sapiens
ttctaggccagtgtgtctcacaatctaatgtgcacccgaatcatctggacatcttgttatacgcaggttctgcgtggggagggttgaggtggagcctaagwttctgcatttttaacaaactcccaagggatgtccatgatgttgctggtatgtggaccattctttggagggacaagtctttgaggccatcactttgaatga

SEQ ID NO: 11391 - DNA, 201 bp, Homo sapiens
tgggtataatctcacttaactttactctgcaaatgcaatgttggtcttgccatccctgtgttgtgttcagtcttatttgatctcactctccctgttacccrtctgtataatcccctgggaagaatgagatctaaacaaaaacaaaggagaaaatgcttaagaaatataatctgactgtctaacaaagcagatagttaagtc

SEQ ID NO: 11392 - DNA, 201 bp, Homo sapiens
aacaaagcagatagttaagtctctggtggactcctttgttttatttggactagagggaggaagaaaaaagcttgggactgctgctggaggaacagaagtgmattaggaggctcatatttcacaactggttgccagtgtctatattggctgatggctctggtttccagctggcggtggccttggttgaaacatttacctggt

SEQ ID NO: 11393 - DNA, 201 bp, Homo sapiens
ttgcccttttaccctctcctgtcctatttctgtttttttctggattcataaatatttgtatgtgaatactcttgtatgtgtataccctctctttcctttcrtcttctctgctctttagagggcacaatgagtagttgtcattgttttttaaaggttcctgcaaggctctctgttggatttagtttattcttgctaaaacat

SEQ ID NO: 11394 - DNA, 201 bp, Homo sapiens
tagggatggagatgctacaagaggaagtgtgtaagtctctctgggcaaagaaggaaaggctttgagataatttcttacctgcatataagatgatatccccrctttcaaagaacttaaaatctagttgaggattgacatgtatacatggcaaggtactatcttacaactgcaaacctaggctgctgaggaagtgcagcaggc

SEQ ID NO: 11395 - DNA, 201 bp, Homo sapiens
agggacactgagcttacctattgtagaaaagctgcctttttaatgattctgtaaacacttattgaaacacctactagggctggacggagcagtggaaattkttgccaacattatatcctcagagcaaccccaggagtttggaccagagaatcgctctccatgaaggaaacaggaatggggaggtggattgaaggtgggtac

SEQ ID NO: 11396 - DNA, 201 bp, Homo sapiens
ccccaagttagactgaaaaagaaatgagagcagaatccaggaccacaaaaattaggctttggtacttttaggtgaaaattttggacttaacactttaacasttgaaagggcctcttcattgtggtttcattcaccttatttagaaatgaggaaatccagtttctgagaggttgtgtgacttgcccaaggtggtggaggtgg

SEQ ID NO: 11397 - DNA, 201 bp, Homo sapiens
aatctcgggccagcaccctagacctgttgaattagaaactctgggggcggaatccacctctctgtgttttcatgagctctgtgggtgactgtagcaccacractttaggggtttggaggtcagacacctgagaagtagctggtgagggtaggatatttgcaggtgctggactccagaggctgtcctttgtggcagacccca

SEQ ID NO: 11398 - DNA, 201 bp, Homo sapiens
tggtcagcacacaagtctcagggagtgacaccgaacaaggtgaggcagagaaaccaggagaccctaccttgaaccaggtaagaagaaagaggctgcagccmctacgtatgtgtgaaccctccccaccttttgaaaattatccattaagccaacattatctctttgcctggatcatgaccatagactcctaattggtttcct

SEQ ID NO: 11399 - DNA, 201 bp, Homo sapiens
tcttaaaaagacatggaggtcatggtcccttttctttttaggctttgtttccctactggtgaatttctggttgtgggactataggtttctgaagttggackttttttctaaaatcacgtctttgccctgtcccttgcccatgacagcttggaagcatgtcttctcttattttaagcatagccaatacagaaggcctcaata

SEQ ID NO: 11400 - DNA, 201 bp, Homo sapiens
atgtactaagtgtggttgtaagtaccatgtgtggattatctcatttaatcatcacagtaattccatggtactttattagctcaattttcctgataggaaastgaggcacagagtggttacacagcaacaaagttgtggaaccaggattctaacccatgagatttacctacaaagcattccatgtctctctgttgctgattg

SEQ ID NO: 11401 - DNA, 201 bp, Homo sapiens
gatattacagagagcctggtagtgttgggttaattttaacatggccaataagaaagcattcaaagctggagaatgaataactgtaactgaatcttagcccyttctgaactaaccactttaggatcactgggctgttacaaaaaataccagtagcatccaggtcccaccccagatcaatgaaataaaaatctctgggcatgg

SEQ ID NO: 11402 - DNA, 201 bp, Homo sapiens
ggaacaagccctgtatctgttgaccagtacaacttgcttagataaagtggcccaaatatattgaaagagaatagtctgcaaggggccaagagggagatgcrgatgaaatggatgatttaatgggtcatctctcctgtagttaatttctctagatctcttgtgctatattgattttgtaaatagctattgtcacatctgccc

SEQ ID NO: 11403 - DNA, 201 bp, Homo sapiens
catggtgagaaagatatatcaataattattaacttatcctatctcttttggtgctcttataaaaaattgcataaatctataagaatttggttttgttttarggatatggttcatggctatcagctagatccaagctcactgttttccctaggaacagtacacatgactttggacttggtaagcagcttttaagaccctcta

SEQ ID NO: 11404 - DNA, 201 bp, Homo sapiens
ttgagaacctcccttctcaaattcttgtgaagatttcctctatggagccctcatgtggcccactcaagccagggctctcaggagcctcttctcccacaacrctttattctttctgaaatacaaggactatgttgacttcaccaaagggatagtcaggtcgcacctggatatcataacttgtagccctggggccttgtcacc

SEQ ID NO: 11405 - DNA, 201 bp, Homo sapiens
caggtcgcacctggatatcataacttgtagccctggggccttgtcaccagtcatactgcctgccagtcaccatctttagcatgtgtatgtacttgagtggrtaagataggcttttatttcttttatgatttgcctcaggacaaatcaaagagagcttcactaataacttgtaatgttactcggaaaagagaccagggcttc

SEQ ID NO: 11406 - DNA, 201 bp, Homo sapiens
tctggccttgggataggtaaggtaggaggctacagtgggagagagtttaagcagagtgacatcagccattttactgtatgcatagctgggaggcagatcawggacttcaaacttcaagagtaatggaacttgctgtccaaagcacctgctgaacaacagtttcaaaaacaaggcgtgcctattgcagggttcctaggtgct

SEQ ID NO: 11407 - DNA, 201 bp, Homo sapiens
catcttttgaggaatgaagcagcccaatacttaacagtggtctgatagtgaccttattctcatcctccagtaatactgattatatgcttacaattcacaascaaccagcatttatttgcatgtcacctactctgctgaccctgtgtgtgaggtctttctcatgtatgtgccattatctcctaagacaaacagagaccacag

SEQ ID NO: 11408 - DNA, 201 bp, Homo sapiens
ctcatgtatgtgccattatctcctaagacaaacagagaccacaggatagaggattttgttcccttggaatcaaacctgcctttgggaaggactttttgggrgagagattttaagaaaagttttggagaaagaaagaaaagaataagctggcaactgtgccttgggagctccttggcatttttctgaatctgattctgattt

SEQ ID NO: 11409 - DNA, 201 bp, Homo sapiens
agctgtgggagaaagatgggtacttattgtaatactttaaagacaaatatttccttcatttctatcactaactaggttttcaacaaaagtctgggggatgmctttaaaaggcctggtaattgcttattgcttacaaacaattcatatgctaattgaaagctgctcctatctattcattgaagcccttacttcaaaaatttt

SEQ ID NO: 11410 - DNA, 201 bp, Homo sapiens
gcaaagatccatctcaaagaacaacaacaacaaaaactggagatgtaaaaattccatgggtgtggccacatgctatggatttagacaatattaaactgttrtgaattcttaagtctgtaagaatggatttatgaggttttaaggggtcctaagaaagacttacaatatggtcatgagaggtcacatcctgaccactagaac

SEQ ID NO: 11411 - DNA, 201 bp, Homo sapiens
atgaacttattctgtgtgttccttcagtatgtatgctcctggcctcctctttgtttttctgacacttgtttaaatggaatagtgtattaaccaccctaggygatgtgttttaacagttacttattggaaagactgctttgatccaaggtctaagacagagctgtttctgtttgggaagtcaaggttacattgagtatagtc

SEQ ID NO: 11412 - DNA, 201 bp, Homo sapiens
aaaattaagtaaaataagtatgctataaaaaataaaaggcaatgtatcataacacggtagacattagaagaagacagttgtcactagtagggcaagaaacstaggtagaataatgaagctgaggtagaataatgaagttctgggttaaagtaccaaaggctgtcaaatattcatggcatcaccatggctctgggcttactg

SEQ ID NO: 11413 - DNA, 201 bp, Homo sapiens
aagacagttgtcactagtagggcaagaaacctaggtagaataatgaagctgaggtagaataatgaagttctgggttaaagtaccaaaggctgtcaaatatycatggcatcaccatggctctgggcttactgaaaaggaagtatctaaaattggtatgcaggctcaaggctcagataaccttgtcctgttcaaacctttaac

SEQ ID NO: 11414 - DNA, 201 bp, Homo sapiens
tgaggtagaataatgaagttctgggttaaagtaccaaaggctgtcaaatattcatggcatcaccatggctctgggcttactgaaaaggaagtatctaaaaytggtatgcaggctcaaggctcagataaccttgtcctgttcaaacctttaacagttgaagtatctcaaatatattaaacattggaggtcgagaatgccaag

SEQ ID NO: 11415 - DNA, 201 bp, Homo sapiens
tttgccatattctttttaaaaaatattggtttttattttgtgctttaattcagtgttaagtgagttgttgacttttttggtttgtttaaaaaagaagttaracagttggaatcccatgtaggcataaaagtggggttctaaaaactaggtccgtcctgggtcctaacacttcccacatatagatacgtgtttagtgacagt

SEQ ID NO: 11416 - DNA, 201 bp, Homo sapiens
aagacattcaggaaagacttttacaagacagtgcatgctaagggctaggaagtttggtgagagatggctcccatggagaagtagaaattaagatgggcttygaagcatgagcagatgacaaaaaagcccaatccaaactggcttaaacagcaagggggtggttattggctcatgtgattgagaagatcaatgtgaccaagg

SEQ ID NO: 11417 - DNA, 201 bp, Homo sapiens
gagtaagggagatacatgtacagaccactgatgtggactcatcatctccataactgcccctttgcccttcctttgcattcaaaattattatctctctctcrttcaatttagctatttctatgaaggggtgaaaatccctaacctcttgatatgaatttagcattcaaaggcacctgagatgaggaaggcagaaagtgttca

SEQ ID NO: 11418 - DNA, 201 bp, Homo sapiens
ttggccaatagccaaccatttggtcaacattagtttcagttattttctccctgtctgtaaactctagagtttacaaactcaacaatttggaggtttttctycccacgcagcacatgacttcacaacactaagcatgtcgatagtgaattaacttgtcattaatgtatgggttttattattatgtttgcttttgaattagta

SEQ ID NO: 11419 - DNA, 201 bp, Homo sapiens
ctctagagtttacaaactcaacaatttggaggtttttctccccacgcagcacatgacttcacaacactaagcatgtcgatagtgaattaacttgtcattawtgtatgggttttattattatgtttgcttttgaattagtattttgagcagttgcatcaaatcacagaacagtggaggggttctgattaagctgagcctttc

SEQ ID NO: 11420 - DNA, 201 bp, Homo sapiens
gagcacttatgatgaaattaatgcttatgaaacgaggaagagatgagatctctgcatgcatgcaccaaggaaggccatgggaggacaaatccagaaacacrgctctcaccaagaacccaactatgccggcacactgatctcagacttccaacctgtagaaacatgagatataaatgttcatggtctaatctccatctgctg

SEQ ID NO: 11421 - DNA, 201 bp, Homo sapiens
ctgggttcaagcgattctcctctcttagcctcctgagtagctggaattacaggtgcatgccaccacgcccagctaatttttgtatttttagtagagacagkgttttgccacattggccaggctggtctcaaactcctgacctcagatgatccacccatctcagcctcccaaagtgctgggattacaggcatgagcccccaa

SEQ ID NO: 11422 - DNA, 201 bp, Homo sapiens
cagggggataaggcagatgaatatgtgaacaatgttttggtagattagcttggttagaggattttcaaactttttgaaattataaaacctacaaatatatrttttttaaatcacaaaacaaaaccttaatgaatcagtaaaattctcataatctttatacaggaaaggtagtagagaaaagtttatatcagtttgcaacta

SEQ ID NO: 11423 - DNA, 201 bp, Homo sapiens
ttaagtgtttcagaaatgtttctagattttagctgaggtcctgtggcatcttagagtattgtccaggaatcttggtggcagtatttcccaaattttagcaygtacaggaatgatctgtgggggaagtgtcaaatctgcatattcccaagccccacccaagtgattcagattggaccaggtggtgctacagtggatgcagcc

SEQ ID NO: 11424 - DNA, 201 bp, Homo sapiens
catccagatggcaccactgagaaagctggctcacaggccagcaggggcccctcccaccccttgactaaaccctctgcattccttcagactcttcttacccygaatggagagtgctagaaacgttcttagtagctttctaaaggctttataaggccaacgagtaataatttggtgatttcagaagcagccctcagaataata

SEQ ID NO: 11425 - DNA, 201 bp, Homo sapiens
acttgcagggacaaagccagcacctaaggttttataaatactagtccagtgctcttgttcagacaccacattccttctcatcttgtttcctcagatttatrgccaaaaacaatgggaccatcagggacccaccttaggaccctcatagcgagtggtcctccagctcagcccatgtgcatccagctgaaaggctttcatacc

SEQ ID NO: 11426 - DNA, 201 bp, Homo sapiens
cgtgcatgctctcttctatcttccactatgggatgatgcagcaagaaggccctcccaagatgtgggctccttgaccttggacttcttagcttccagaaackgtaagaaataaatctctgctctttataaattacccagtctccagtattctattatagcagtacaaaatggactaaaacagtggctcggacaacaaaattt

SEQ ID NO: 11427 - DNA, 201 bp, Homo sapiens
ttttttcttaaaactttatccctattttacaggtgtggaaaccaaggcagaatttttacaggtgtggaaaccaaggcgaaatttgctcaactcatcacgcrtcttggtagggtcagagctaggactggagctggggtctcttactttctagtcctgttctgcttcccaggaagcgaacacccacaagtagctcctgagtaa

SEQ ID NO: 11428 - DNA, 201 bp, Homo sapiens
gttgtctaggcagctgggtgaaaggccacatttgttttgcttttattgttaaacaacataaggacagggccttgtcatgtgagaacatcaatactgaatamataatatatttataataccaataagagcaattgacatttgtatagcctttacaacttacagattactctgacttacctcattgcgttttgtatttatggt

SEQ ID NO: 11429 - DNA, 201 bp, Homo sapiens
atgatgccctttttgcaaaggggaagccaagggcttgaagagaggaactgaaatattaagatttcacatcaaatcagagttagggcttaaatagaagtaarggcactcattttcccactttagtgggaagggaaataaaccaacatttattgacctcctaatataagccatgtccttccctcaaatattttattctcacaa

SEQ ID NO: 11430 - DNA, 201 bp, Homo sapiens
agatacacatgcaagatgggggcgtgcttatgaaactgtccactggacacccactatgtgcttaacattatgctctaggcttttttttttttccattatarcatcatcatttcccggatgctttcctcatggcctctctatgtaaggtatacttcatacttgctattatagttaaagttgatgacataacatttaagtgtc

SEQ ID NO: 11431 - DNA, 201 bp, Homo sapiens
gttaggaggtctagtacagtttcaatcacttgctgtgttgcctcaggcaaaccacctaacctgtctgttgcagtgttcccattggtaaaatcgagttgctrcattctgtcattcatatttcagagtgctgctgatttctgtgtgagtaaatgagataacagatgctaaagtgggatatgaatgcatagtatgattatgctg

SEQ ID NO: 11432 - DNA, 201 bp, Homo sapiens
cgcggagagagtgagcactcggtgcctttttggataaaccaggtaaagaagaaaacaaattactttttagtacactcctttattcctcattccctccgcarcctcctatgacttctgatttcttgtctgaacttcaggaacagcacctctctctgtgtcttcctcatctcactcctatatggtgtttcattctctttatgg

SEQ ID NO: 11433 - DNA, 201 bp, Homo sapiens
tctttgtatcccactaaggaatccttctccattctctaacagaccattggctatctgtctacccaactcatttcctatgtcttcaaactcttaagcacacrtcaatcagcatttgacagagggtcccaaaggtgaatgcctgaggcatatggaaagctcatcaggaattattattttaaatttaaaatggataaaacaagc

SEQ ID NO: 11434 - DNA, 201 bp, Homo sapiens
gctatctgtctacccaactcatttcctatgtcttcaaactcttaagcacacgtcaatcagcatttgacagagggtcccaaaggtgaatgcctgaggcatayggaaagctcatcaggaattattattttaaatttaaaatggataaaacaagcactggcaagaaatccatcaatctgctagcaatgactgtgcaaatgactg

SEQ ID NO: 11435 - DNA, 201 bp, Homo sapiens
acgctttacttaataacttcctccctacctggagcccggtggaatccacaaagccataagcacacaccagcctggtaggttggggcaggtgggaaggagcyctgggaggctggggcatcagaacttcaccctctctggtcagagctgtgggctcctgagcttctccctctgcctgctgtggacttatgtaacacattcaca

SEQ ID NO: 11436 - DNA, 201 bp, Homo sapiens
ttgggtctttgtagatgatcgagttaacgtgaggtcattagggtgggccctaatccaatgagtatgttctcataaaaaggggacatttggacacagaaacrgacacatatacacagggagaatgccatgtgaacatgaaggcagagatccaagtgatacatctacaagccaaagattgccagcaaatgaccagaaactaaa

SEQ ID NO: 11437 - DNA, 201 bp, Homo sapiens
gactctcccttagagtcctcggaaataaccagctctgaaaacacttgatcacagtcttttagtctccagaactgcgagacaatgaatttctgttgtttatrtcacctgctttgtcgtactttgttgccctaaaaaactaatacaccactgaaccaagataattaagagcttatgtcctctcctttccttctttcagtaaat

SEQ ID NO: 11438 - DNA, 201 bp, Homo sapiens
atcagggatacggataagtaagcaggccattactggctgtatgataggtatttcatgtcttttttcccctctagaccactagctctcaaccttcaccataytctagcttctcctgataacttaaaaaaaaaaacctatgtccaagccccattcccaggcattttgatttaggtaccctgtggtgggaacaaggctttggta

SEQ ID NO: 11439 - DNA, 201 bp, Homo sapiens
ttttttcccctctagaccactagctctcaaccttcaccatactctagcttctcctgataacttaaaaaaaaaaacctatgtccaagccccattcccaggcrttttgatttaggtaccctgtggtgggaacaaggctttggtattttatgaatcttcctaagaaatcccaaaaggctgttattgatgaaaaccactgttttc

SEQ ID NO: 11440 - DNA, 201 bp, Homo sapiens
cagagagagaagaccttaactttactctagaatatgagcaaatcttcagagaaaggagggagacctaactatcctggaatgtctctggggaaggagacagkctctatctttgttatactggtcagaaaacaaatctgccttctgacctagagagagacactctatttcatttccaagaatttttactatgcaaccaaccca

SEQ ID NO: 11441 - DNA, 201 bp, Homo sapiens
acctagagagagacactctatttcatttccaagaatttttactatgcaaccaacccagaaaaaattgtcagtagagccctttgctcagaggactcaaaccrtgcagaaatgtgagatattcacagagaattgtcttccaaaagggactcttaggtgtgaagtgaggggcttagacaacattagagacttgaaaaatgtgga

SEQ ID NO: 11442 - DNA, 201 bp, Homo sapiens
agttggggaaaaggagaacatctcttctgaggcaattttgtggtttaagattttcgtacaaagcaagttcttaatcctaccaaataacattctcaatttartctttaatccatgagaactgtagctattaacttagagaggcttcccttgcaaacagggattaatagaagaataggtgcctgttgttatatctccttctca

SEQ ID NO: 11443 - DNA, 201 bp, Homo sapiens
ggtaagaaataatacctggtgatgaaataatctgtacaacaatcccccatgacacaagtttacctgtgtaacaaacctgcacatgtacccctgcacttaaragttaaaaaaaagaaaatatttggatccacctatgacctataagctctctctttgagttgttctgcctttccagactgaagtaatgtatgtctcacatgt

SEQ ID NO: 11444 - DNA, 201 bp, Homo sapiens
accttctccacctagttacacaataaaatcgcctaaagagcttttaaaattgataattgagtctcatccaaggccaattaagcttaaatttctgggtagarggcctggtattttttttaatattcacaggaaatctaatgtatggcaaaataggaatcattatctaaatcagtgttcttcttgtgcccatacgttagaatc

SEQ ID NO: 11445 - DNA, 201 bp, Homo sapiens
tggaggcctgcttggagcctggctactgtatgaagacatattaaacgtatgtccatctgtaatattagtggtcctctgaaaaaccagcttagaggactaawtatcattcatctgataagaagagagagtaagagatagggaatggtgtaattaactttctggttatttgtagttttagaaaaaagagccaccattcttcat

SEQ ID NO: 11446 - DNA, 201 bp, Homo sapiens
aggggtacagggagactggacaggtgtgaaaaagcattttattagcattatctttgtggatattccccttcctttcagatgataagctcttagaggtaggwcctatatgctatttaattttgcaactcccgcagaggttagcatggtaagctgcttgcatcaggcttacaatagatgtgttaacacataggggcaagttca

SEQ ID NO: 11447 - DNA, 201 bp, Homo sapiens
taggataattgtaaatattttttatagcaaaccaatgtgctacaatatgtaagttagggtgtgactatccctgtgcttcataagtgagaaaattattattkctctaagtcagttttccatcttggctacacattagaatcacctggcgaactttaaaaattacgaatgcccaggaccttcccccacctgctctcccaagag

SEQ ID NO: 11448 - DNA, 201 bp, Homo sapiens
actatccctgtgcttcataagtgagaaaattattattgctctaagtcagttttccatcttggctacacattagaatcacctggcgaactttaaaaattacsaatgcccaggaccttcccccacctgctctcccaagaggcatagtgagtctgagaagtggcctgggcattggggtttctaaagctccccaggttattctaa

SEQ ID NO: 11449 - DNA, 201 bp, Homo sapiens
agagtttgttaaaccacagactgttgaattccatcggcagagtttctgattcattagatctgggatgggaaccaagaatttgtatttctaacacatccttrggtgatgctgatactgctggttctggggaccacagtttaagaaacgttgatttaaactattgaggtcaagacaattcaggttgtacaaagtcagcatttc

SEQ ID NO: 11450 - DNA, 201 bp, Homo sapiens
aatgcagctgcggaataatacactagtgccacagagtttaataatagataatgacaaataatacagttggggaattgtgtaattcaataacagagtaaatracaaggaaacacacacaccaatgaatggttctagtggggacgcttaggtgttttcaatttaacttacctctccagccctttggcctactacccttttgag

SEQ ID NO: 11451 - DNA, 201 bp, Homo sapiens
agatgggaagagactgggagttggggtttgggtttagggtcataatgggaggtaaaaggtttagccacagctatggtttagtaagcataccagtgatctgktgtgtacttccctgtcctcagctgcattagagaaaggcagccgctgatcactgttagacctgtattctttctctaagagaatgggatatttccctctcat

SEQ ID NO: 11452 - DNA, 201 bp, Homo sapiens
taaatgataaaaacaaaacacttgatccctatgatctaaagccctgctctgcaattctagagattgctttagaagtttgcatttaggtatagtcgtaacawcctagaaattaatttagaaagctgcttttacattaaaaatcaaaaaggtgagcaaaaagaatcatggctctgtaaattttcttttattttgatatttcag

SEQ ID NO: 11453 - DNA, 201 bp, Homo sapiens
acttagaaacccatatttggcgtgttttgttgcttgggtaaagggagtaagacctcatggcttgaaagaatcctaccagaggtgttttgtttttttttttrtctgatttcctttttcaaacttgataagggagtaggcaaaaaatgtctgagtcaccagaactggggtttcacaaatgaatggtctcgctgtaacctaaag

SEQ ID NO: 11454 - DNA, 201 bp, Homo sapiens
atcattactaagaattacggagtgttaggcttagaaaaggtctaggaattgactcattttcctacttccaggagatctggttctagaacccaggacttccrgctcccaggcaaattgaagcgcttcttcttccacatgggacccacttctatgagagcatcagtctgttagggttaagtccaagctctaccacttaagagc

SEQ ID NO: 11455 - DNA, 201 bp, Homo sapiens
tcagaaagtggaatgagtgtgcatctgaatggctgcccaatctataacgaatattctatctacagggcaataagcagaaaaggtgatgcagagcagccagscagatactatcatcctcatttctttaacatgtatttctagatccttttttgctcagaacattgttatggcattcctcagaacgcttttagtctctctctt

SEQ ID NO: 11456 - DNA, 201 bp, Homo sapiens
agtgtgcatctgaatggctgcccaatctataacgaatattctatctacagggcaataagcagaaaaggtgatgcagagcagccagccagatactatcatcytcatttctttaacatgtatttctagatccttttttgctcagaacattgttatggcattcctcagaacgcttttagtctctctctttctcttttatactta

SEQ ID NO: 11457 - DNA, 201 bp, Homo sapiens
ccttggtagtactgatgaactggttgttctcttgtaaattttagaaggaaggtggacagtctgggagaaccagaactgacaggagcaatagggtgcattgytaactggcaccctgtgctctgaggtcaaaaggaaacataggaaggtggtttctgagggcaagacctaggctcctctctcaattctcttttgatttcaaat

SEQ ID NO: 11458 - DNA, 201 bp, Homo sapiens
gagaaatttattaggaggatgactgaggtgagcaagctgcttacaaagagagaagggagagaatacattgaacctattcagcttggcggtcacgaccaagygaggtgccattggatatgtggttacttgtgggtgagctcaagtagaagcctcgggctgggctcctctcctggggtggaacccttctgctgggctcctttc

SEQ ID NO: 11459 - DNA, 201 bp, Homo sapiens
ttatgtgagagtagacctccctggagcttcttaaactagccaatgttaatcttggtgctgagacatattgatggtatgtcatatgtaataggttaccaaakaataatgcatatactaaaattatgctaaagatttactaaaaatttaaattaaggcagatcaggcttatggctaaaataacatcatttccatgcacctgca

SEQ ID NO: 11460 - DNA, 201 bp, Homo sapiens
aaaacgtggttaatctgaattgcagtaggtctgatggttggttggcaagttgtccttattctggtgtatgggtgaagggaataagcagtgagttagctctyacctagatccatcccctagaaagtaactgtgtccagttatcaatgggcagggcttgctgggcgttaagcacaggtaacctctagtcttttactatgtttc

SEQ ID NO: 11461 - DNA, 201 bp, Homo sapiens
tggaatcaagtccttggcctggtaatgaaggtccttcgatctggtctgcattttccagctccatctcctactaatctttatatccttatctactgtttccytaggctgttgtcttcacggccgccatggtaggttttgcctatcatcccaaaccttgtgcaggcctaccacagtacttgacatatggtgggggtctcagtc

SEQ ID NO: 11462 - DNA, 201 bp, Homo sapiens
tagaaaaattatgatgtcagccctgactaccccttctcattttaatcttgccaacgtggaggtctttggcctctaagtgcacaggaatatggtgagtgacmctgggacttataactggagaagatggcagaattcatcttcgttgcctgcagctttccaatcctgagcccttttccactttcatcgtgtttccatctccat

SEQ ID NO: 11463 - DNA, 201 bp, Homo sapiens
accactctctggagcatggattggaggatgagtgactcaaggtggggtgactagtgaggaggtgatgaaggagatgagaggaaagaggaagaaacactcayagagtaaacctggccatatctaatgactggaagcctgagtttctcttcaaactcagaagagaaaaatgaatttatggttttgggcgcagctttagttttg

SEQ ID NO: 11464 - DNA, 201 bp, Homo sapiens
ccctagcctattctcatgtcattggcagaggcacgggcaagcttattctcacacctgctttttaagtctctatttgtgtcacattcactaacatcacaaarcaaatcatgtgattaagcccagtgtcaaggggcggaacattctgtcctacccatagttggaaggtactgcagggttatgtggcaaagggaagggtgaaaa

SEQ ID NO: 11465 - DNA, 201 bp, Homo sapiens
ttcacaaacaacccttattatggctgtggaagacacaatagtatgtgtaatgtggtgtttgggctgtatttgctgcttgggaatctggtgcattctgagayggagggaatgccaagtgtttagacaacatgctgcttggcgcctgcaggttcctggaaaggactggggtctccagatctaggctgccagccaggagtctca

SEQ ID NO: 11466 - DNA, 201 bp, Homo sapiens
tccatattgcggggctgtggaccacattttgagtagcgtggtgtagtggacactggaggaagaagtgtagacctgagctctagccccagctcagccctgtrtgtggccctgggcaagtcactgacactctaagactcacaattatgtcaatcatagtgataaagggaaatgaactagaaagactctccctggttctatgat

SEQ ID NO: 11467 - DNA, 201 bp, Homo sapiens
tgtgcaacgggcccattgttctactctactttaactggttttctgatggatgtgtttatgatacctcctgctgggtattgtgcgtgacaactggggactcrataactaaacaatatctgaacgcagaatccctctgtccagggaggggctgaggaagtcacaacagttaatctgtagtaggacccatgtcctcccatctgc

SEQ ID NO: 11468 - DNA, 201 bp, Homo sapiens
cctccttctacttcctcttccaagagtttaactcatggaaaggaaatgaggggaaatagcacatttcatggcatcgaagagggcatctttgaaacctagcrgctttccacctacagacatttagaatgcaacttatgctggcaaagctattgagggtttaaatgatatgctttatagcgtgttgcatttcttcctttgaaa

SEQ ID NO: 11469 - DNA, 201 bp, Homo sapiens
ggagacatggcagcaagttggcaagctggggtcttcttattccaaattcaaccatttcttggcactttttttgtttctttttctgagaggtagtagacagyggagctaaataaaattttctcccaagaaaaaatggttagaagcagcgtgtcccctgcccaggcctgaaatctcttcattccctttccctttccccagggt

SEQ ID NO: 11470 - DNA, 201 bp, Homo sapiens
tgtctctttaggcaaacccaggctttgatccgcttccctgacacagtgatctcacctcctttggctcagtcctctccttcgtcattggcccagctatgagyctggaagtccccacagtgccttctttgggtcaatactattatcgtgcacctgctatttgcctggtgctgtgctagagactcaggatacagatgtgtagag

SEQ ID NO: 11471 - DNA, 201 bp, Homo sapiens
tgccagtttctccctcctcctggtttctctcccattcctcccttctatagcttctcttttttgtacttcctttccctcctcttttttttttttccttctckctgaatcacttatggatataccagaaagcatacatatataatgcaattatttgcatgatgacttacaagttccaaagcacattcaaatacattgcttttt

SEQ ID NO: 11472 - DNA, 201 bp, Homo sapiens
tgtgataaataaaaaatgagggaatgataggcccaagagggcacagatgggcaagggtgatgtgagataatgcactctgcttctgaaataattcctaattmcctttggttttgttcttaaaacacaactggagttcttagaagaaatatgcaatctggcatatagtaagggctcaataaatgtttgaatacatgaattaat

SEQ ID NO: 11473 - DNA, 201 bp, Homo sapiens
atcactgcagagtagctagcaaatgaatgcctttttatcagaggtacatgcccagttggtggctacgaccacatagaacagcagatatggccaaagggggwatcactgacaaaacaggcagaccctcacccagagtggatggtgtttcttggcatctgagaatcagaatatagaggaagatgaaagcactgtcgtgtttac

SEQ ID NO: 11474 - DNA, 201 bp, Homo sapiens
gggcagtagtaaagagtgagtaaaggatttggggtcagcaaaacctggttttgatcctcgatgctacctctttcaatggacaggttaccaagcctcaactsccatgtctgtagaagagactgtcacaacacttgtctctgagttgtgacggctccacacaatagtccaggcaaggaggtaagcctggtgctcagcattgac

SEQ ID NO: 11475 - DNA, 201 bp, Homo sapiens
aagaccaagtttccgggcctgtaaatcagagaatcaggttcatttaacatcctcttagatctcaacttctatcagtagcaagatacatctttgcagatacytacatggagatttcactacatctggcagggatgagccaccggtcctcattttcttaattcctggacaaggtttttgtgtattctaaccaagtattcttgc

SEQ ID NO: 11476 - DNA, 201 bp, Homo sapiens
aacatcctcttagatctcaacttctatcagtagcaagatacatctttgcagatacctacatggagatttcactacatctggcagggatgagccaccggtcytcattttcttaattcctggacaaggtttttgtgtattctaaccaagtattcttgcttttctttgttctgattcattcatctacaaagtgtggtcagaaac

SEQ ID NO: 11477 - DNA, 201 bp, Homo sapiens
acaaggtttttgtgtattctaaccaagtattcttgcttttctttgttctgattcattcatctacaaagtgtggtcagaaaccttgaccaactgctgatatrtacaaatatcacaacttctctaagtctgggatctcctaccacagttgagatatccaaatcattcacagttttgtcataactcgtggattaaaaaaatcat

SEQ ID NO: 11478 - DNA, 201 bp, Homo sapiens
gatttagtcccttctgagccttagttttatcatttgaaaaatgggctagtaaaactttatttcacagggcttttgtgagggataaataagaaatatacaargtatcctaataaaaagttctcatttcagatgaaatatgagcatgtagatatgctatctctattaataattcatttgttctgtgttgttttgaactcttgt

SEQ ID NO: 11479 - DNA, 201 bp, Homo sapiens
attatacaaaaatatacagtgttactagggacacagacctctcctctccagctctgtgtccctcctaacatttttgtccttatgaagtccacagaatgtastgtgacagcatggcatttgctattccagtataatcgccttagttattgagtacttttgatgattctttttggtcttggccaagggtgaaaggatatgtaa

SEQ ID NO: 11480 - DNA, 201 bp, Homo sapiens
ataccttctcaacaacaatgatagctaacacttctatggctgggaactgggccaagaactttattgtattcctgcctcacagcaactctatgaaatatgtrctatggttattcccattttgtagattagggaaagaagggttagagaagttaagtaataagctagagttccatagatttagataagtttcagagctggctg

SEQ ID NO: 11481 - DNA, 201 bp, Homo sapiens
tcaatgtctgacatgttttcattttcagtcctttcttgactaattctttgtctttttctgccaaattttgcctttggtctttggctttccaatgattgcayttggatcttaagtatccacactttggtttcctcctgtgttctctggcttgctgtgcctctgcctctcttaggttgttctgctaggaacttctgcttacat

SEQ ID NO: 11482 - DNA, 201 bp, Homo sapiens
tccccacacttcttagattgcatagtaataaaatataacactgagtattttaatctgctttggaatttctcagagaaatagagtgattattatataaattrtaagttgggtgtcttttagggggaaagaagtgaagaacagaattaagtaaatgcttattaatactaagtatatatcagtattgaattaatcagccatttg

SEQ ID NO: 11483 - DNA, 201 bp, Homo sapiens
ttatttatttatggtgatattctcttctctacactgatgccattttttcccctgtggcctcccacataaaagaagtgtttttgctttaaatacagatctargggctgaaagggaaacatttcttttggtgaatgagtgattcatgtaaggtgagaggaattggtttctggctcaatttattcaaagtttgggatggtttgt

SEQ ID NO: 11484 - DNA, 201 bp, Homo sapiens
cttctctacactgatgccattttttcccctgtggcctcccacataaaagaagtgtttttgctttaaatacagatctaagggctgaaagggaaacatttctkttggtgaatgagtgattcatgtaaggtgagaggaattggtttctggctcaatttattcaaagtttgggatggtttgtcagtcaatgcacagttccatgga

SEQ ID NO: 11485 - DNA, 201 bp, Homo sapiens
aagccaggtcaggaccaaggccaggtattttattgtggcttacaattaaaggaaggaatgtggactacctgtatctattgcaaactataactgggattagrgaccaaggtagtgaggaatttgtgtgtttgtatgtggtagtggggtggtaattggtccttgacattgcctgagtccaaggtcatggccataactttcatt

SEQ ID NO: 11486 - DNA, 201 bp, Homo sapiens
ctgccttaaaaaaatcttctcttgccatttgtggctttaagttgtcctaaatgaaacaaggtgattttatgtgtaattttcttcaaattagggacatggcraagggcctatgcaatttctgctccagatcatcaatatttctttgtgtgtggcacaaaataggttttgtctttgggactgtagttacttcacacctaaaag

SEQ ID NO: 11487 - DNA, 201 bp, Homo sapiens
acattattgctttgggtagcaaggtaaacatcttgctgtacatctttattccattaaggaagatgtacggaaaagcactctgtgggtttggagataagagygtcttgacagaatgggagaaccaacacaaaaggtgaccagaagaaataagagttgagcaaggtggaaagaagtgaagatgcaaatcagaggaaatggagg

SEQ ID NO: 11488 - DNA, 201 bp, Homo sapiens
actttcagtaagagctgtccaaaactgccttcaaagtaatgagttctccaacactcaaggcatccaagtagagactgggcaaccattttgctgaggttatygaggggattctggaatcatatgagtggttttgattttatagatagatctatagatagattgattttatatgatagatctatagttctacgatgaatgacc

SEQ ID NO: 11489 - DNA, 201 bp, Homo sapiens
ggagaagtgccaagcaaaggagggaaaaagccccttataaaaccatcagatcttgtgagaacttacttagtatcatgagaacagcataagggtaaccaccstcatgattcaattacctcccaccgggttcctctcatgacacgtggggattatgggaactacaattcaaggtgagacttgggtggggacacagccaaactg

SEQ ID NO: 11490 - DNA, 201 bp, Homo sapiens
gcacctgcatatcttccctgcaccaaacatctgatactttttttttttgaggaaataaaagccccaaggaaccaagtacgacactttgacagtcattgggytttttgagcctgggccttgttaaggcagctgcctgtaccgttgtggaatcacttcagctactgtctagtcctcagtgctacagcctcagggcattgattt

SEQ ID NO: 11491 - DNA, 201 bp, Homo sapiens
atagaaccagtgtcagaaggaatagggtggagaaaatgaatataaaaaagattggatatggaattaaatggacttagtaaaatattaattctgggacaatkaagagagaaggttcagatatatctacacaaatttgagcttaggtgaccattaacagaaataaggaagttgggaggaggaaccgatgagtttgcttttagg

SEQ ID NO: 11492 - DNA, 201 bp, Homo sapiens
ctttgccttcatcttataaggattcaagtgcttgcatttagggtccacctggagaatacaggatagtctcacctcaagatccctaacttaatcacatctgyaaagactcctttccaaataaaataatatttacagtttccatggattaggatatatctttggggaacattattcagcctactacagagatacctttctctt

SEQ ID NO: 11493 - DNA, 201 bp, Homo sapiens
cgtatggagaatctgaatttagtctgagcttgtggttttatatgaaaacttatttgattcctagaagtgataatgaatttgggacctctttagacatcctrtgtcccttttctccaatatttctttctacctatttctctattatttctacctcttcttttatataaatataaaagaaatttaattcatcagtttcctatt

SEQ ID NO: 11494 - DNA, 201 bp, Homo sapiens
aaaacagaaggaaatgtaggcattctctgggtaggtttgtttagtgcctaagaaaatgcaggaaatgagagtgtgtatttattgagcttctactatgtgcyacacactttgctaaatacagggaatgcattggttatcacatcagaaacacacaacccatgtgtttatgacgcttagtttagaggatcgaaacagtgccat

SEQ ID NO: 11495 - DNA, 201 bp, Homo sapiens
tctattgaaaagacaagacttgtgctgtacaaagataacaaagttgagagagttttaagtgatgagtgagtggagtggacagtttagcggagggagaaatyacagcaggcccaagtcatcagctgcctgagggagagaagggaagtggggcagagacagtgggatgtgtgattccgtggagaccccagaagcaagattctt

SEQ ID NO: 11496 - DNA, 201 bp, Homo sapiens
ccttgtcaggagaaatagtgccaagaagccatctgggcactccagggcacatgcccacatcccctcattctttctagttcccttgctggagtgcatagggrtggggcatttacaacagaacacgtggaaacacattctcagaaagttgagaacagagtggcctgggataagatggcagagggagagaagaaaatacttctc

SEQ ID NO: 11497 - DNA, 201 bp, Homo sapiens
gtggggactgtctctaattcttagtttattctcatgcacctgccttctaactcaaataccttggaagaatttgaagtaataagtgcatcatgtagggttakaatactctctctttttccaatcaagtgggttgggcaagagggcagacagcttcctcattggtaggtaataaaaggattctgatttatcagattgtgggat

SEQ ID NO: 11498 - DNA, 201 bp, Homo sapiens
gcttgtcactgtttgtgactctgcttctgtacctcccagtctgtgtgacatcttcccccatggggagccgtttctactttgtctttaattgctcctcaccraggcgacttgtcagccaaggctgctttctgtcacttgatgccacatctcttcctatttcagccagccatttggggacattcatttagttgacagtctgat

SEQ ID NO: 11499 - DNA, 201 bp, Homo sapiens
cccagtctgtgtgacatcttcccccatggggagccgtttctactttgtctttaattgctcctcaccgaggcgacttgtcagccaaggctgctttctgtcayttgatgccacatctcttcctatttcagccagccatttggggacattcatttagttgacagtctgattttacagagaacattgtaccagacaataatttgc

SEQ ID NO: 11500 - DNA, 201 bp, Homo sapiens
gtcagccaaggctgctttctgtcacttgatgccacatctcttcctatttcagccagccatttggggacattcatttagttgacagtctgattttacagagwacattgtaccagacaataatttgccttgtaagggggtccagcagggtttcctgcctccatgctgacccagggtgccagtacacttctgcgtggctgtggc

SEQ ID NO: 11501 - DNA, 201 bp, Homo sapiens
acaataatttgccttgtaagggggtccagcagggtttcctgcctccatgctgacccagggtgccagtacacttctgcgtggctgtggctgtggttctgcayagagcaggtggggaaggtgaagatattaacaatggagagtcccagttgagcatcactgggctacaagtcccttgccctcctgtccttttcctcttggtag

SEQ ID NO: 11502 - DNA, 201 bp, Homo sapiens
atacctggtttagaaagtcataacagatttttttcccataggttattggggttcaggtggtgtttggttacatgaataagttcttaagtggttatttgtgmgattttggtgcactcatcacccaagcagtatacactgcaccctatttgtagtcttttattcctcaccctcatcacacccttcccctcaagtccccaaagt

SEQ ID NO: 11503 - DNA, 201 bp, Homo sapiens
gcaagtatctttttcttataatgacttcttttcctctgggtagatacccagtagtgggattgctggatcaaatggtagttctacttttagttctttaaggratctccacactgttttccatagtggctgttagacagtcataacagatttttttaactgccatcctcacgttctccacctacctacccactctgcaggaca

SEQ ID NO: 11504 - DNA, 201 bp, Homo sapiens
aatttcttgagagctagtctcactctgccacccagcttggagtgcagtggcacgatctcagctctctgcaatccccacctcccgggtccaaggaattctcytgcctcaacctctcgagtagctgggattacaggtgcctgccaccacacctggctaatttttgtatttttagtaaagatggggtttcaccatgttggccag

SEQ ID NO: 11505 - DNA, 201 bp, Homo sapiens
ccacctcccgggtccaaggaattctcctgcctcaacctctcgagtagctgggattacaggtgcctgccaccacacctggctaatttttgtatttttagtaragatggggtttcaccatgttggccaggttggtcttgaactcctgacctcaagtgatctgcccgcctcagcctcccaaagtgctgggattacaggcgtgag

SEQ ID NO: 11506 - DNA, 201 bp, Homo sapiens
agaataataaatacctattttaaaatttctgacaggaagtttagatatcacctagtccatttccttaattttccagttcgggaaattgagccataaagtgkttcagggattggcctagggtcataaagacatttaggactagaatccctgctctcaaggtcccaggttagcttgtggggtttcatcttctacaatctcatt

SEQ ID NO: 11507 - DNA, 201 bp, Homo sapiens
tgccttctctattctagccacacatctgcctacctcagggcctttgtaggtgccatcccctctgcctggcatgctctctctcctggactttgcatggctgratccttctcaacattctggtttcagcttcacttttacctgcctagagagaccttcagtgactctacattttaaagtagaatgcatgagtaactagcacac

SEQ ID NO: 11508 - DNA, 201 bp, Homo sapiens
agcttggtctatttttttatatgccaagcacacagaatcaagctgaatatccgcaggctgtcaacttctatattcaatgaaaggataatttgcatcaggaycaagtttttgctaagggtatagctctagggctttgagaatgctgtacctgtatagttcttgccctcaagaagtttatcatttatttagctgaggagttga

SEQ ID NO: 11509 - DNA, 201 bp, Homo sapiens
tcaatgaaaggataatttgcatcaggaccaagtttttgctaagggtatagctctagggctttgagaatgctgtacctgtatagttcttgccctcaagaagwttatcatttatttagctgaggagttgagacatctatataataagctgtaataagatgatgtaagacagtagcatgttagtggacagaaaagaaggacatg

SEQ ID NO: 11510 - DNA, 201 bp, Homo sapiens
aggacaaaggaagaaaagagagctttcttggagcatatggaattaaaattaaaattcactgaattttcaagtcagcaaccaccagaacaggagctatgatraggaaatactcatctgggacaggaataggccacaaggggctggtcagtctgtcaggtgcctgggctctttccaagtatgtttgtagggtaacctaccctg

SEQ ID NO: 11511 - DNA, 201 bp, Homo sapiens
gcctccctttttaggcaacctcctatgtgatcctgggtagcagcagcagcagcagcaaaagcaaatgattctgcctggaaagggtgagataccaatcttcratgaggctggattgtgtcattgaaatgctacatatatgccacatggaaatcatgtcataagaaaatagtagggttggcagaggccaggcgtggtggctca

SEQ ID NO: 11512 - DNA, 201 bp, Homo sapiens
taccaatcttcgatgaggctggattgtgtcattgaaatgctacatatatgccacatggaaatcatgtcataagaaaatagtagggttggcagaggccaggmgtggtggctcatgcctgtaatcccagcactttgggaggctgaggtgggtgggtcacctgaggtcaggagttcaagaccagcctgtccaacatggcaaaac

SEQ ID NO: 11513 - DNA, 201 bp, Homo sapiens
gcatgtagtatatgattatgaaaaatccaaattcattttgtgtcttctttagaatattaaagttaaattattaaaatttctatattctcaacacagtctaycttaaatagctttagtttcagtggcttttggtccagaaaactgtaggaaatgaagctatgatgcttctttggaattaacttcagcattaacatagagatt

SEQ ID NO: 11514 - DNA, 201 bp, Homo sapiens
gcagtttagtggaaaagactaaatgggcatctgatgaactcaaacctggtccccaaagatgtcagctcacccgttcgaggaatgagtctcagccttggtcygtcacttccagcctaggtgggggaatgtcagctgatatgaaagctttaccctcccctcccatttacctctcagaccccaccctcaggacagtggtatctg

SEQ ID NO: 11515 - DNA, 201 bp, Homo sapiens
aagaatgtctgaaagcacaacatttttggacaggccaagatgccatgggagaaaacacacacacaagcctacgtgctttctccaaaacttggctctgaagwcagtcatatggcagtcacaccacaatccaatgaattgttttacctcaggttttggaagtttcactgctcccaatagcttgcattaagccctaaataataa

SEQ ID NO: 11516 - DNA, 201 bp, Homo sapiens
ttattccattatgtaggtaatgaaagtttgtatgtaaataaaagtttaagcttctctttataataatttatcacaggaactgcctgcaaatagattctaaygataagaatgttcttcttttagctataaatccttagttttctacttcttgcaaataaacagcttagttaaataaactcaagacaccatcattaaacaatt

SEQ ID NO: 11517 - DNA, 201 bp, Homo sapiens
atgtcagtttactaatgtagaataagaaataaaatctcagaagacctgagctctcctgtcagcatgacttgcacttgtacttttcctttttgtagagaagytaaattataatcagaaagttgttttggtgagcttggaatcagaaaataggagtttaagtcatctgttcaacatgcagctttcctcagctgtgatagcttt

SEQ ID NO: 11518 - DNA, 201 bp, Homo sapiens
gtggaggagagatagtaagagctgttaggctctctgaagcctcttagataaaagaagtccttagctttgactataataccagctatgctcaagcctttttycccccactatattctttacaatttcacagttaatctctgcattatggttctctgtagccagaagacattgcagacagggaattgagaggatgcttgagtt

SEQ ID NO: 11519 - DNA, 201 bp, Homo sapiens
gccacaggcagaattcatctcagcagaaaccgaagtcaccaatggcaagtgttcgtgtatttgtgacattccttgggaattgtgtttgtccttgcacttgygattttgccttttaaaagagcattttggggccaggcgcggtggctcatgcctgtaatcccagcactttgggaggccccgaggcaggcagatggcttgagg

SEQ ID NO: 11520 - DNA, 201 bp, Homo sapiens
tatttttgcaaatgaggacactggggcttgatgaagttaaataacttacccagatataaccattgtaagcagaggagtaaatattttgattacataaatayatcgctgagttctgtcattcagtcttttctcatgacttttcctcatttgtgtcacacatcactcatcagtcttggcatatcatttttcctctggagattc

SEQ ID NO: 11521 - DNA, 201 bp, Homo sapiens
tggattcatttactcaccttgggtcctgcagaggaaaagtgaaagcaagtgtttaaacgttgacactcagatctcttactccaaagaccattctctttatyattaaactattgattagcagtgattcacaaaggtctgttttgtctcctacaaatgtgtcattgtgtatgcatgactgaacctgtcttcttaggaaatcac

SEQ ID NO: 11522 - DNA, 201 bp, Homo sapiens
taataagcgttgtaactttctctttcattgttggaggtaacacgtatgaaaggaaagcagcaatcagaacaatgcagtttcccagagggctctttagcagmagtctcctgtggttccatgctgttgttaatgctccccttattttagtctcctggactccctaaatgctttggaccacttgagcaaggccacgttgctaat

SEQ ID NO: 11523 - DNA, 201 bp, Homo sapiens
aggcaagtgacactggtttcaatgaaaatgtatgtaaatgaaaagaagtgaagcaatttaaggaaaaagacgaaataataattcaggtagtatatagatgrggcaaaaatatgtgatattgacgcaccattgaccaaagtttgggaaaaagaggagtcatagtaaaatgttgatccttgtgttgaagtttctgatcctcct

SEQ ID NO: 11524 - DNA, 201 bp, Homo sapiens
ccacacaggttcatataatacaaaccaaaacaaaacaaccttctcacacgaagagaaaagaatactttgcaaaatggctgctgcatcttcccaaatacatmtttcacctccccaaacagattttccatccttgaccttctcgttggaaacctctccttaagcagttacacacagctctgcaaatgttagagtgacatttgg

SEQ ID NO: 11525 - DNA, 201 bp, Homo sapiens
tcatctagtgttttgcaatataattagttgttgactcaaggactgctgaacagtgtcactgagtcataaagacggctccaagaggaaaactttgggcacarattaatgctatgtaccctctactttctatcttctgctgcagcgctattcttggcccactcatttctaagttttagcaatatttctcaggctggtgtgcct

SEQ ID NO: 11526 - DNA, 201 bp, Homo sapiens
gatacattatatagcatccaacagtcattccaataacatgctaagatctgcaaaactgtaactgcatatttgaattcaaatccagggacagttttttaacstaggtaactctagattctactgtacacaaagttagagttgtgagatttctctttattaattctcttttttctcttagccacatccactaaaaaaggtact

SEQ ID NO: 11527 - DNA, 201 bp, Homo sapiens
aaggtacttttatttcatgtcctgtatgagttgtatgtaacgtctggctctgtcaccattcctttgtgttctcattccatagctaactttccttaagaagygttgtaatagcatatatttcagtgttcacaaaaaaacacaaaagcaatgttctgactaggtgactcaatagattttatgtgttttatatatacttatgta

SEQ ID NO: 11528 - DNA, 201 bp, Homo sapiens
tttaatcatctgtttcacaacattgttgattttgtttttcctgattttggaagcaggattccaaataaggacagtaaaaagcaaactttttcatatctctrtaagaagggaaatcaaggctttaaaatattacctcagtttcctcaggtatgaaataaaaggtatgaatgcaggtaaatttcaactttctttctaactcta

SEQ ID NO: 11529 - DNA, 201 bp, Homo sapiens
atagaattgaggtttgttgaactggcacattgtgaaacaactgccaggaagaaagtatattttcttctgccaccctaaaggatttatctctctgatctggyctcagataatatggaagcacccacattctagtgagtacaactgtgtgtggagcagttcagttatctagcccttcaacatagtcatttggaaatcaaaagc

SEQ ID NO: 11530 - DNA, 201 bp, Homo sapiens
actggaccatgatatcaggctcaatcactaaacatagcctgcccatgactgttatgagccattcttaccctcaaagaaatataaaagatttaactttggakttttgaatgcaatctctaccatgattgtgaaagtagatccattgtgtagggagtttgagaacagaagaaagcagaacgtcgcccttatttctctatttaa

SEQ ID NO: 11531 - DNA, 201 bp, Homo sapiens
aggaaattcaaacacatatgtacatgcatatatatacaacatgtactgagcatgggttattatcaggcatggcttggatattttcacattcatacttcagkgttttcctttgtgctggatacattttccttgcaactctggatccatttccaatctttctccacccttcttcattcagttttgcaccttggaatgtgattc

SEQ ID NO: 11532 - DNA, 201 bp, Homo sapiens
tgagtggttgggacacagggcaccaagtccctaggctgcacacagcgaggggtttgggggtgtggctcagccacaaacaaaaccattgtttcctcctagcytctggggcgcctgcagttggagaggctgccataaaggtctctgacataccctggaaatatttgcctcattgtcttggccattaacatttggccccttatt

SEQ ID NO: 11533 - DNA, 201 bp, Homo sapiens
aatagtaaatgctcaattttaggtatcattattgatcttctttagattctgcccttccaggagataaaagatttgttttgttttgcttcacatctggatcrtgtgttaaatttagattgtttccaatctaagaagagatcttcataatatgtcttattgtaacggtgtttgcaactgtcacacttttatctgtaatcgctt

SEQ ID NO: 11534 - DNA, 201 bp, Homo sapiens
tcaaacacttacaaaaccatcagatagtgtgagaactcatgagaacagcatgggggaaaccacccccatgatccaattatctcccactaggcccctccttygacacatagggattatgaaaattacaatttgagatgagatttgggtggggacacagagccaaaccacatcagatgtttctgttaaattgaatagtttgtt

SEQ ID NO: 11535 - DNA, 201 bp, Homo sapiens
cagcttccctcctctgaatgttacttgctttgtatttatttcctgtgtcatttaaccacttgtatgttccagtacagttacttgtgcattctgtgtctccytttagaacagggaccttgtctgtttcacctttgtattctccatagtgcatgtaggtagcaaatatttgacaacagccaatatttaataaagacctactca

SEQ ID NO: 11536 - DNA, 201 bp, Homo sapiens
gctctttttcttgtccaacttcatttgatttctgttgtcagtgtgtctcttggtttttcttttgtttgtgtattgtgtgtttggtcattttaggttatatktttttcttttgctggatctttttgtgtgcgtgtgttcctgagtttccaatcctccccgccatcaaccatggtaaatcaaaagatggtattcaacccttca

SEQ ID NO: 11537 - DNA, 201 bp, Homo sapiens
aatgcagctcttcatatccacgccttgtttaaaggttttccttccgttccctccccaaaatatacccctttgcaaatattttctttctctttgccgtgaayttgtgtttcatttttctcaattacagaagaaaatgtatccaagtagaatttgtcttcacatgcattccaccaaaattaatttcaaatgatcactttgctc

SEQ ID NO: 11538 - DNA, 201 bp, Homo sapiens
tgcagtcagtagctgaagccatcacctcttcctccctccctgccctccctccttccagtcctcaccaggggcatggcctcctctgtctggtaatcataccrgttgctccagggctgtttgctcccacttttctgttgcggttgacgacacatgacaaacctaaccgcacgaaaccaaacccagatttttctcaagagatgt

SEQ ID NO: 11539 - DNA, 201 bp, Homo sapiens
tgggtgtttgtgcggttagctgtttgcaagtggccattttatgacaggaaatgaccaggtggtgttaaccctttccttaccactaaggaagatggcaagtstgcctatgcaaatttctatagcatttggggcccaacctaaggagagggtggagggagtttgattttagaaaaagagaaagggttaagtacttcactgagc

SEQ ID NO: 11540 - DNA, 201 bp, Homo sapiens
agctttttactactaaaaatgtaagaagtatatacttttgttcattagttaatgcatacatgtataagaagatctattggataaattcctaaaagtagaaytgctgagtcaaaagataagtgcattataaatattgatatatattaccaaattgcactccaaagaggttttacaaagttatatttctaccagcaatatatg

SEQ ID NO: 11541 - DNA, 201 bp, Homo sapiens
tttcaaaatgttgctgtcacatatttatttcccatagatcttttcctcccatcctttaacatcttcaaatatacatagggatcattgtcattcatgacttyggtgacaacttatatcagaaatcttttaatagcaatctgctgtagcaacatttcatatgttaatcttgttttgataaacagggatattgtagaaaagtag

SEQ ID NO: 11542 - DNA, 201 bp, Homo sapiens
catttagtgcaattacaaagagcaaggaggacactggagccaaatagcctgggttcaacacttgtctatgccacaaatgagctacatgtctttgacaagtwgcttcaactcttagtttcctcaattgtaagtttcatatgaaatttagaaagaataaagggaatgggatctagcaccaaattaaaaagtaaacgtgatgtg

SEQ ID NO: 11543 - DNA, 201 bp, Homo sapiens
gcaggcagcaactgtttattgatgaggattttaccatagttttatgtgattacatgttagtttagctttcccttctaaatcaccacttagtttatagttcratattatcgatccaagtgctaccagagagcaattctattgatggcatgttacgtgtttggaaggcagtctaactttcaacccacactctcttttggagag

SEQ ID NO: 11544 - DNA, 201 bp, Homo sapiens
tttatacctgatcaggtctgccagttgcaaagctatacaatgtagtggagaactgcatacggttaattatgacaattacaatcagttctttacaatctctsctgctgttatgggatttaaataccataatgtatgtcaaaaggacaaaataatgttcctatgttttctgcttacagctgcttttatgattgggttttgctc

SEQ ID NO: 11545 - DNA, 201 bp, Homo sapiens
ggagttgctggaagtgatgaatttaccccaagccatgaaggatgggtaagattagaacagataaaggaaatgaaagtgaacgtttgaaatataggggccaygggagcaggagtgggtttgtttttgaagtcagtagcaagcaagagttgagagtcagtggtaagtaattatgcacagagaaaacttggcaaatagataaga

SEQ ID NO: 11546 - DNA, 201 bp, Homo sapiens
tttttgaagtcagtagcaagcaagagttgagagtcagtggtaagtaattatgcacagagaaaacttggcaaatagataagaaaaaatcacattaatatttraagtggtttaatatcaattgaatcacaaggacatcttaggtattcattatgaagctagagacagtatagcctctggacttaaggagtgggtctgtattca

SEQ ID NO: 11547 - DNA, 201 bp, Homo sapiens
gtattcaaatcgtagttctgacacttctgagagtcctcaggcaagttagttagcttctctttgaccatttttcccaatctgttcacttgggatgagaagakaatgtatctttagactcagatacacaaacattatctaaatccaggatgtagaagttgagtgcaaggaaagtctcagttgtccccaggctgcatatcattc

SEQ ID NO: 11548 - DNA, 201 bp, Homo sapiens
ttattactctcacttttatcctctcccctccatcagtgaagactcctacttgccatctttcctctaaagatccttagtccctgagaagcaagagctactgwagattatatcctaataagtttctaaaactcaaaagttttggtaggaaagaacatgtaggcttaattcctttctctttgacagtttggcccaattggatgc

SEQ ID NO: 11549 - DNA, 201 bp, Homo sapiens
agtccctgagaagcaagagctactgaagattatatcctaataagtttctaaaactcaaaagttttggtaggaaagaacatgtaggcttaattcctttctcwttgacagtttggcccaattggatgctcaggtgtaatatgctattattagccctgagatgaaaatttcagggccaaaattattagtaaaacacttaacatt

SEQ ID NO: 11550 - DNA, 201 bp, Homo sapiens
tgccttgactctcaattttgtttcttgaagcaatgagatcattgatttgatctctaattataaagtaattaaaaacaattttatttcagtccacaaatacrtaaatattctaaaaaggagcctttaattcatttaataatccataaaaataaactgaaaaatcaagcgtggacttctttgtcactttcctctttttcattg

SEQ ID NO: 11551 - DNA, 201 bp, Homo sapiens
agagagtttcatgttgtataaggggagtgttgatttaaaagccttagattaaaatctgcaaatgaaactaaattaaaggtgttttgaagtgattttaaccdccaaacaaattgcatttaatacataataattactttattctcccattaaaataattatttttaagtgaataacagcttctttgaccaccctacctgtagt

SEQ ID NO: 11552 - DNA, 201 bp, Homo sapiens
aacacttctgcccagaggtgatgccagtcaccttgatcgaagcaagtcaatggctacatcaaatatcaaaaaagtgggaagtgaaatcttaaaacacccckgaaaatactggaaatttttattttagttttacttgaaaaaagtataaattttgattttctgtattaaatcacttattcaaacaatgatttattcaacaga

SEQ ID NO: 11553 - DNA, 201 bp, Homo sapiens
tgaagtagttacaagaaccagagttgagattaagaaagggatacaacagctgggaaacactggtcctgttacaccattgccctcctggggagacacaaggrcaagtatatctggccatagctatcacttgccaattagcctggtgactagatatatgttttatctctatgtatcaaccagagcaaatgtggggccagaatg

SEQ ID NO: 11554 - DNA, 201 bp, Homo sapiens
atagcttctctctttccctgtgttccttaggtataatgcaaagaactcatagtagtattaaagcacttaaaacattgtattacatttttatatcactctcyactccattagactgtaagtaactttgatccagggatcaaaatatatttctccttttatctccagccactagtcaatgtccagtgtgttataaataagcag

SEQ ID NO: 11555 - DNA, 201 bp, Homo sapiens
tatcactctctactccattagactgtaagtaactttgatccagggatcaaaatatatttctccttttatctccagccactagtcaatgtccagtgtgttayaaataagcagtaaatatttgatgagttgttgagttaatgagtaataacaaataaatgttattgtacaacaagttggcagatatttgttccttgaatagaa

SEQ ID NO: 11556 - DNA, 201 bp, Homo sapiens
acagttgatgacttccagatggcctgagtgcccaccagcagggtatctagtggacacctctgtacctgttcttccacatgattggtgtttatttgttcaaytcccccagcagactctaagctcctttagaacagtgagtgtatctttttcatcttcgcaccccagaaactttcacaacacctgtctagtaggtcatcaact

SEQ ID NO: 11557 - DNA, 201 bp, Homo sapiens
gcactatttttttcattactgtaccattatcctttatgtttgaattgagacttttgcatttggggactcctacagagaatccactggatcagtaaaattcraatggactttgggtggaatataattccttgaatgctgctgggtcatgtgcaccagtgtggttttgacaaccctgatgcatgagcactactttcagaattg

SEQ ID NO: 11558 - DNA, 201 bp, Homo sapiens
gtgattatgcagtatttagcacagtgcttgccttatatggaattttcagtagtcttggttttggcttgttatctttctccccagttacttctctttccccygaagtttgaaagaagcggctgtgaggtatgaatatatttgccccttaagtagaaaggaggttcagtttgcagacagcattcagaggagatgagtgaaagg

SEQ ID NO: 11559 - DNA, 201 bp, Homo sapiens
ggacactgaggtttagagtttaatatcaccagcccaaggtcacattactagtaagtgattaaactggattttaaagcccatgacctttcgcctattatgcygtatggtgtgagtctgggtttgcttatttccaaagcagaaagagtacatagatgaccagagagtatctgagagtgtcctccatgctgactttatggtaga

SEQ ID NO: 11560 - DNA, 201 bp, Homo sapiens
tcttattcagtctttccagacacatttctgttgtcttgtcactttctgtagtatacaaagaaagtcaccatcttttctcaaagggatatgtgactattttmgtgagagttattcacatatcaagagcaaaaataacttataccattcctatacaggaacttcctaaggcctttggatgttttaagatattaataattaata

SEQ ID NO: 11561 - DNA, 201 bp, Homo sapiens
tgttttatgaaaaattatgattattaagtccccagaattgtctgtcatgcttataaacgtaacatttgatacagatttctgttcataaaattggacaaaaygagatcttcctgtttaactgaattgaaatggtatttgaaagttttccttgtaaaaaacaaaaacaaatccttacatcaagacgtcatcttttcccagttg

SEQ ID NO: 11562 - DNA, 201 bp, Homo sapiens
tggcctttgccccttaatgcaagtgaagcaaattcagtggaattgataaataacctataatccccgccctgtatttggtccctgatgaacttctgacaaayggaaaagattgcatactttgcagagtgcagacatgctcctacactcaggttttggaagcatgatatagcaaatcaagggtggttacaattcagatcaccc

SEQ ID NO: 11563 - DNA, 201 bp, Homo sapiens
tgttctacctagaaaaagcagtctcactatatcatagaccattattttctatagcagccttgacccttagagttataattggctatttcatctcacaaacwtcttcaaaatgaagttacctgcatgatattctatatgcttacctttgttgataaatttttggtggcgtagcctgtatcaggactcaagtgttaaccttca

SEQ ID NO: 11564 - DNA, 201 bp, Homo sapiens
tcgttgatgggcatgtgggttgattccctgtatttgctaatgtgaatagtgctgcaatgaacatacgcatgcatgtatctttgtaatagaatgacttataktcctttgggtatatacccagtagtgggattgctgggtcaaacggtatttctggttctagatctttgaggaattgccacaccgtcttccacaatggttaca

SEQ ID NO: 11565 - DNA, 201 bp, Homo sapiens
ttggagtttctagtctagaatacaaatggtattcccactaatacgcaggagctcttgcctcatgacttgatacactatccaaattccaaagacattccctygctcggtttcttggcccctgccttacagctagaaaaagtcatgtacttggcaattacttcctgtaaatccatatcctcttaccttagcaatgccctcagt

SEQ ID NO: 11566 - DNA, 201 bp, Homo sapiens
tcattttctacgttggtagttagtacttactcagtagaagttatctgatgagagtctttcttcatatttctttgtgtcaaaatgcatttttatgtttaaayatctcaaacctccctggcaattaagacattttgggacttttctccaaacataacattccatttaagtctgggactcactttcataaacccatgcacctgt

SEQ ID NO: 11567 - DNA, 201 bp, Homo sapiens
ctgacataagcagctttgtgcagtgggaaggaaatgtttatgttattatacacctgggacctctaagtccacaaggttcactttttattgtacacctgggmcatccttatctacacttctggctcaatttgtttttggtttggtttagaaggttttcttctccctaaaatctcccttaagtcttaggccctttttatgcag

SEQ ID NO: 11568 - DNA, 201 bp, Homo sapiens
aaaaataatgttttcttctgagaagaggaaagaggaagggagtgctctagcttcttcatccagaaacagactcttatgtaaaacccccaggagattctatragatatcagggaagattcacctaaagattaggaccctttgagcctgacaaatctcctgttgaatgccttgctttcaaccaaagctgagataaaaagtgcg

SEQ ID NO: 11569 - DNA, 201 bp, Homo sapiens
gaactcttcattcttaggagaggccccagaataatcacaaaacttggaactgtatctatggaatatagaggtttccttgtcttggagtggattcttagagyaaaacatgcctatatccttctgttcttttatcaacttcaactgactgtgaatgatgtactcactgagaaaaatccatttgctcaggtctaattttaggta

SEQ ID NO: 11570 - DNA, 201 bp, Homo sapiens
tgcctgcctgaccactttcttcctttctcctctctcataatgatgtaacagtaaaaatacctgagttcaaatcctgatttttccttttaatagctgttgaytttgggctatgtgcttaaaaaacattttttgcagagctttctcaatacttggcacattattgtcactgtttctccctggatcttagttttttgggttgct

SEQ ID NO: 11571 - DNA, 201 bp, Homo sapiens
gcagagctttctcaatacttggcacattattgtcactgtttctccctggatcttagttttttgggttgctaagtgagcataataatccatagttcagaaayttttgtgaaataatgtatgtcaaagagcatggtttttagcaggtactttcattcatagagatagtagctgagtttaggtgacccgttaaatttgggaaag

SEQ ID NO: 11572 - DNA, 201 bp, Homo sapiens
atttaaagtcaaggagcagatccattatgacaccataattagaatggataaccacatccgcagaaagtgcgctgcactatgagtaaatgtaattttgttcrtaaagtgctgggcctagggttaggggagataagttcttaatatgtcttaatatagccttgggttctgggatatgctaaaaaattattcaactcattagtg

SEQ ID NO: 11573 - DNA, 201 bp, Homo sapiens
gtaataaaatggcatttgttcagtccagttttaattgatgagatactaaacagagtcggcactaaagaaaatttccttggagaaacatttatgcttagctmtttcagagctggaaagtccctttggtttgatataaacggccttcatttttatggagctggcatcaaactgattttagaaagaactggcctttctccaagt

SEQ ID NO: 11574 - DNA, 201 bp, Homo sapiens
aacaccgcatgttctcactcataggtaggaattgaacaatgaaaacacatggacacaggaaggggaacatcacacaccggggcctgttgtggggtgggggraggggggagggatagcattaggagatatatctaatgttaaatgatgagttaatgggtgcagcacaccaacatgccacatgtatacatatgtaacaaacct

SEQ ID NO: 11575 - DNA, 201 bp, Homo sapiens
aaagaagccgaattatatgatttcttttgacttcaaaatggaaaatacatgtcgatactgggggagaaattaggaggttcttgccataatacaggtggcawatgatggtagtcttcaggtaatggcagtaggaatgcatagaagaacacagatatgaaagattcttagtctggcagacacctggaagcaagggtgcatagg

SEQ ID NO: 11576 - DNA, 201 bp, Homo sapiens
caggtagtctgaaatcttgccaggactttagtgcctcttgggatacttctgaggtagggcaaagtcccattcaatgttctgttggaggagagaatctttaktgaaatctcaagaatgaaagccaagaagccttaagataagagcgagagattcaacagcaagtactatctgtaagaactttgatttcattgcatttaagct

SEQ ID NO: 11577 - DNA, 201 bp, Homo sapiens
cagcttagcacagttcctgccctatggtacatgttccttatatgtacatggaaattagccaaatgtcaggatgccactttttcatctccatctctattccwatgatggatgactagtaaatacttctctgactatgtatgtgtagttcaaatactctagtttttttttagcataaagtgctgtgaaatcccaccatcaaaa

SEQ ID NO: 11578 - DNA, 201 bp, Homo sapiens
tcctgccctatggtacatgttccttatatgtacatggaaattagccaaatgtcaggatgccactttttcatctccatctctattccaatgatggatgactrgtaaatacttctctgactatgtatgtgtagttcaaatactctagtttttttttagcataaagtgctgtgaaatcccaccatcaaaagagccaaagtaata

SEQ ID NO: 11579 - DNA, 201 bp, Homo sapiens
ctggggagacaacagtgcataaagagatcccatctttgttcatatgaaactatattctagaggaagagacacacactaattgaatactctcacaagcaaamgtacttttgtaatggtaattcatgctacaaagctgtagaccttggtgctatctgatacagagatctgatggaatcagaaagttcaggaagagatcgtctg

SEQ ID NO: 11580 - DNA, 201 bp, Homo sapiens
atcaagaaaacattttctcaagccagactgcctgtgctcaaattgcagctctgctacttactggctgagtgaccttggacacgttatttaacctctctgtrcctagtaaccactacataggagggtattttataaggattaaatctctgtaacacacgtagaaaagtacctgccatatggtaggcacaatatacatttttg

SEQ ID NO: 11581 - DNA, 201 bp, Homo sapiens
tctgtaacacacgtagaaaagtacctgccatatggtaggcacaatatacatttttgttaaataaaatgaagcttagtagtttacctgcattgttcacattwtctaacacattaccttccacatcgtaggtacacaatgaatattattagtcatgacttatacatgactaaatgtattcttaaattggagtggtacaaaaaa

SEQ ID NO: 11582 - DNA, 201 bp, Homo sapiens
tttttatttctcaaattactaaatcagttctaggggaaatatgctagtaaaatagttaaggcttgacagatataactggtccagaggtcggtagtcatcaygagtactaagacctagatactaggggtctgtgtttgttcttgagaatacagcaaagtgtttcaaggaaggaggcttctcctttacttaccaggcctgttc

SEQ ID NO: 11583 - DNA, 201 bp, Homo sapiens
tatactagatgatctataagccccttccagccctaacatgctattagcccatgattcttgtgtagggataccagaagaagatgaaagagagaacctaactyattttctgtcaccagtccttataattcatggcattgtgtatttctccttgagtcaacattgcttcttttagtgacacaagcaagcctgctttctccagct

SEQ ID NO: 11584 - DNA, 201 bp, Homo sapiens
ttgtgaaactgcagactgattagaaaactgtcatagtaaaatactttaagcatgtccttttctcattttaaaataacaactggaaggaaaatataaatatrtcactgaaataatggtttctccatgaagaaaaagacatttagacaaaccaaaagtgtatattctatggtgtagtaaatcattaccttactatattaggtt

SEQ ID NO: 11585 - DNA, 201 bp, Homo sapiens
tattccaaaaaagaataatagattggtattaatgtttctgcctcttttactctttggaagacgtgccaataggcaggtaaagagatcaaaaagaaaaagtygggcagggtgcagtttctcacacttgtaatcccagcattttgggaggccgaggcgggtggatcacaaggtcaggagttcgagaccagtctgactaacatg

SEQ ID NO: 11586 - DNA, 201 bp, Homo sapiens
ggcccctgggttctactgaggttaagcgtctaaagtgtccttgactcactcaatttcaaagcaaattcaatttgatctcttgcctaataataaacactggkcagaagcagacatggaaggatttggaaaatggtgttaaaagatcaaagagatctaaataaactattttgtttgaactagagttaccaagtagaatagatt

SEQ ID NO: 11587 - DNA, 201 bp, Homo sapiens
caccttatcatgcacgttacatcaggcatgaatactggaaatctttctaatgtagggacatccaagcaaaacaagttgcatacatgtcataaaaaactttwaaaaattcagatttacttctggcaaattcattcaggaattcaaactcagataattaaattaatttcttaatattcaaataaagaccagatacacattggt

SEQ ID NO: 11588 - DNA, 201 bp, Homo sapiens
attttttctgcctccttcatttttaaatggatggtgacatgcttcacagcagcatctccaaacaaaagatgacaaattcccatttattttccatcagtggyactgtgtgagatgttgtactaagtctaagcttgttgttcctgaggcacagaagtctttttcctgcagcatatagcattactgtaaaaataaccattccat

SEQ ID NO: 11589 - DNA, 201 bp, Homo sapiens
agtattggcagagtgaagaagacttatttgatttcactaaagctattagtttgaaattctgatctgtaaatctggatgggaaccacacgagggaaaggatscctgccagaagcaatgggtcttgtacattctcaaaaacaaaggtcagatgaaaacactggattgaaaatagagccctagaaatgaagcaagaaggaagga

SEQ ID NO: 11590 - DNA, 201 bp, Homo sapiens
atgggtcttgtacattctcaaaaacaaaggtcagatgaaaacactggattgaaaatagagccctagaaatgaagcaagaaggaaggaaacttatattgagygtttgtaatgttccaagcattctgttaggctgtttacattatgtacttgaaaccgtcaactggattcatcttttccttcctttttccaccattgctggca

SEQ ID NO: 11591 - DNA, 201 bp, Homo sapiens
cttttccttaactttcaaggacctgtggggatagtttctactcaatgcttctttttattcgctttcctaataaaactaatatttaattataaaattaaaakgaaacaagtttggacttccgtatgaaaagtcttatacttgatctgtaactacaagatgttagatgttcttcatgcagatgacaggcaaaggttactttta

SEQ ID NO: 11592 - DNA, 201 bp, Homo sapiens
agctaaggaacccagaagtggccaacctgaagatcaattccttgtctacgaggaacatctgatcccctggcctgtcccttggaacatgggccatacaaggrgttgaggccctttgttttggattaaatgaaggtttccaagcggacgtggttaggaggagggtactaagtgaaaatgtgatgtaaactgcctgccttttgc

SEQ ID NO: 11593 - DNA, 201 bp, Homo sapiens
aaaaaatcttttatgtttgagaacttacctggaagagtcctctggagagagaataagaagatgctttcagttgcacttggagagaatgtgagaattaatcrcctgcttgtttgggaaataacaactagttgtttctggttaaagcaacaccagtatttggatgagttggagcaacgtcagaatgattggaaattgctcaaa

SEQ ID NO: 11594 - DNA, 201 bp, Homo sapiens
agcctgaagttgagaacagaagaaacaggaggagaaaaagcaccagaagcaaatttattctcatatcccagttttgagaaaagctagcctactgtaaccckaggagtttggcggctgctaatatctaaaaatgcgctggctctgtagcttggaagaaaaagaggaacagccattctctttctgctttccaagggtaagcat

SEQ ID NO: 11595 - DNA, 201 bp, Homo sapiens
agaatttctgacaatgtaagctgaattgacaagaacaaagttctgaaggaagaggccaaaccattactgaatgggtgatttgtggctgaactggatgaacmgatagcattccatggctagaatttgtgtcactggttcattctgtgtttcctcttattttccaaattgcattcaatcgatatggcagaaatgaatacccct

SEQ ID NO: 11596 - DNA, 201 bp, Homo sapiens
agctagccacgacagaaaaacgtcgggatgaggatggttcttcagtcatggtggagacatattttctgtgggtcttttggctgtagtgctttgggccatgycctgtgttgtctgtttgaagtactcccactccaggtgtgttcagtgatgtgtggtcagcaacgctccctctgaccacgagacagcttctgcaaacatctt

SEQ ID NO: 11597 - DNA, 201 bp, Homo sapiens
gtcctaatcccttgttcctgtgagtgtgaccttatttggaaggaggttctttgcagatgtgattaaaatggaagctaagatggggccattcataagatggrgagtattgtgggtcctcaatccaatatgactggtgttctcaaaagaaaagaaggtaaacacagagacaggcacagagaagagagtgccatgagaagatat

SEQ ID NO: 11598 - DNA, 201 bp, Homo sapiens
gaccgacctttctcagcctcagctctgttgacattttcaaataacaacttgctgttagggactgttctgcacattgtaggatgtttagcaccattcctatsttatgcctgctagataccagcagcactccccttccaattgtgcaaataaaaaatgtctccagacattgccaaatgtcctctggaagtcaaaaaagcattc

SEQ ID NO: 11599 - DNA, 201 bp, Homo sapiens
cttgcatacacagcatattaataaaatctcaaaaattgcttactctttacaagtaggagatattttgctttttgtgtccatactttccctttagaatgagraggattctaagtaatcttattgtatcacatttctacttcattgcattgctctctaggggggaaattaacagcagaagacttgtcacttgagttctattca

SEQ ID NO: 11600 - DNA, 201 bp, Homo sapiens
tatgttgccctgctaagagcaggtcatggtccttaatgtaagccatgtcatttgcttacagtctttattatttaatctctgacagatggaaattggttgasaacaggtaatggtacagagtcttctgtgtgtgcttgcatgccagtgagatctactgggagaattaacttctactctcccagcacaatcggtggtcatttt

SEQ ID NO: 11601 - DNA, 201 bp, Homo sapiens
gctttttagagtttccagtttttctgctctgttttttccccatctttgtggttttatctacttttggtctttgatgatggtgatgtacagatgggtttttsgtgtggatgtcctttctgtttgttagttttccttctaacagacaggaccctcagctgcaggtctgttggagtacccagccgtgtgaggtgtcagtctgcc

SEQ ID NO: 11602 - DNA, 201 bp, Homo sapiens
ctgcgatgcaggcccaacaatgggctcagctaaccccacgaggagctctgacactaacatgacctttcagtttgtcctgagttgggccaagatggcaaagyctttctaccccatcatcaacaggtcattgaatgcgggtcactctgggaagagcatgatcttaggcaagatggtgctctgtgtctgaggccaaccctgaag

SEQ ID NO: 11603 - DNA, 201 bp, Homo sapiens
cttgcctgaaacatcaggctaaaaatagttcttgatatatgaagatgatctgaaaaatgagccaaaatttgtgttgcaaaacagcaattcaagaattcaakcttaaaacattgcctatttttttcttcagaaaacaggatacaaaagtcagtgtgaatgagcaaagccattgagttgctcccaaagcagaagaaattagac

SEQ ID NO: 11604 - DNA, 201 bp, Homo sapiens
aattgtgcctttgaatgagtaatgacagatttgaaataagaacattggagcattttaagtgtccagtaatatttgctcctggatctactttgaatggtggrtgtgtgatgactggtctccatgaatgggatcatctaatgccttttaaaaattaaagacatagtgtcatttggactttttatgatgcagtactatcttgtc

SEQ ID NO: 11605 - DNA, 201 bp, Homo sapiens
ttatgatgcagtactatcttgtcacagaagacttcaggatttctcttggttagcaagtcaacagagacctgtgcatctaggcctgcatatatgcatgcatrttgttacttgatgtattcggttataagaaaaggaagtcagtcctagttaataacaccatccatatgagatttatgggtttcacttataaatattaaatta

SEQ ID NO: 11606 - DNA, 201 bp, Homo sapiens
ctatcttgtcacagaagacttcaggatttctcttggttagcaagtcaacagagacctgtgcatctaggcctgcatatatgcatgcatattgttacttgatrtattcggttataagaaaaggaagtcagtcctagttaataacaccatccatatgagatttatgggtttcacttataaatattaaattaataaataaaatat

SEQ ID NO: 11607 - DNA, 201 bp, Homo sapiens
gttagcaagtcaacagagacctgtgcatctaggcctgcatatatgcatgcatattgttacttgatgtattcggttataagaaaaggaagtcagtcctagtwaataacaccatccatatgagatttatgggtttcacttataaatattaaattaataaataaaatattatcctatcatacttagtaacaaaggtataaggct

SEQ ID NO: 11608 - DNA, 201 bp, Homo sapiens
ataaaatgatgaatagagatttgtccattgaaaagggcagacaggccaggcacggtggctcacgcttgtaattccaacactttaggaagccgaggtggacrggtcacaaagtcgggatacaagaccagcctggccaacatggtgaaacctcatctctactaaaaatacaaaaagtagccaggtgtggtggcgggcacctgt

SEQ ID NO: 11609 - DNA, 201 bp, Homo sapiens
ttcctgagtattatgtgcacgcttagtacagtcattgagatacataaggcaaccatgtgccttaatctgtatgaagtctcagttcatatgtgattatttargtaaagtatataactgaaattttacatcttttgatctctttgcaaaatttccctgagccacttaaaaataacctttctttactcctttttgtcttgaaac

SEQ ID NO: 11610 - DNA, 201 bp, Homo sapiens
aaatttccctgagccacttaaaaataacctttctttactcctttttgtcttgaaacatttttattggaagacttcagacctaactttagtaccagagaccraaagtcatatctcacttagttctacaatctctagtccacttttgatactcagaatagatagtaaaggtgctatttttttaccccagagtgacagactgtt

SEQ ID NO: 11611 - DNA, 201 bp, Homo sapiens
gagttgtcaggagtggacttgaaaaaaagagtgacaaccatgaggtctgataggctttagaacgcaggtcttaaagagcctggagaaaagagcgtgcatcwcaaatcctacatagacagcaaaaccactgcccaggtaaaccaaggccgcagtctaatcttggaaggagagagtaatttaggacagcaaagcagaatccat

SEQ ID NO: 11612 - DNA, 201 bp, Homo sapiens
tctccagcagtgaccttctcctcatttattcatgacagaatcatacgtataaaaattcatgtattctggtcaccgttctaaattctggatggtgaaaaaaratatgcagggcccctccttttatggaactttcattttaggaaggaggaaacagtaagcaagtgaacagataagttagtggtataaaattgtttaagagtg

SEQ ID NO: 11613 - DNA, 201 bp, Homo sapiens
tataaaattgtttaagagtgactggatgggaggagggtttactggaagctcagagggttcatggtagcccactctgcagagatgagagttaaacagtgttstgaatgattgaaaagagccaaccattcacagatctagggaggcatgctcccagaagctgagacagctagagcaaaggcctgaggtgggaaagaacttagc

SEQ ID NO: 11614 - DNA, 201 bp, Homo sapiens
gattatttcagactcgggagtagggatgtgtttgcacttctagctctataggccctcatgagcctgttggacacattgttaaattgatgccaagtagctcraagcagaacccagtcccttgtccatcatcttctttctgctgacttcataggaacatggttcactttcactgccttcctttgtggacatactcagcctgcg

SEQ ID NO: 11615 - DNA, 201 bp, Homo sapiens
gatgtgtttgcacttctagctctataggccctcatgagcctgttggacacattgttaaattgatgccaagtagctcaaagcagaacccagtcccttgtccmtcatcttctttctgctgacttcataggaacatggttcactttcactgccttcctttgtggacatactcagcctgcgaattaaaaacagaactgattttct

SEQ ID NO: 11616 - DNA, 201 bp, Homo sapiens
ggccctcatgagcctgttggacacattgttaaattgatgccaagtagctcaaagcagaacccagtcccttgtccatcatcttctttctgctgacttcatargaacatggttcactttcactgccttcctttgtggacatactcagcctgcgaattaaaaacagaactgattttctcatctcccttggatcctggggaaatt

SEQ ID NO: 11617 - DNA, 201 bp, Homo sapiens
cttccctcctttactgaatggatggctgggtggatagctgttctttgcacatgttcgtgttgagtaggtgctgtataaaatcacttgttctttttttaacrtgactcacgaaaaaattatcccagctttcagtaatctcaaggaaaaaaaaacacttgccatctgcaatttactgcttttaacctgaaaaataggatctaa

SEQ ID NO: 11618 - DNA, 201 bp, Homo sapiens
ctgactcttcacccatcagaaagatggagttctctctttgtacaccttgcacctatcactggcttcatcacaggatccctatcacagtctttttgatgaakcattgttggatggatagatggatgcatggactaggtgataaatgaatgatgaaccattaagtgaaataaggagtgtggtatagacttggaaaagaaaagt

SEQ ID NO: 11619 - DNA, 201 bp, Homo sapiens
gctgctacctgcaacctgctttatagtgataaacgtgctgcttatttcattttaattgaaatttgaaatcatagtctctagcaagaaataaatggactcaytccccatttttcccccttggccacacaaaaacaagtattagtaggaaatatctgagcatttttaaaaagtaaatatcaaatttttgacagtatgttttcc

SEQ ID NO: 11620 - DNA, 201 bp, Homo sapiens
tggattaactctagtctataatcacaactcttctgtttccttgtctgcactgtgctcacataatggctatgtctcttaccgccaaagcccggctcactgcytacaacggcatcctgtttcttcacctgtttttcttttgcttacctgacaagctcttgcattcataaaagtcgaaaggattccagcttaacgtttcaatcc

SEQ ID NO: 11621 - DNA, 201 bp, Homo sapiens
cacaaatactttgcttggtcctataggctctcaggtttttttgatatcatgtggcatttgtgtcaaattgagttgtgctgtaattttattaacaagcttcmcatctcagaatattttacagagatgcacctaacacagttgacatgttgtctattaaaagttacatcatcttaagaagttattagtccttttaaacatcat

SEQ ID NO: 11622 - DNA, 201 bp, Homo sapiens
acttggagtcaaactgtctgggttgaatcaaggctgtccccaccagttactgtctgtctgaccttgagaagttatttaacctctcagtgtggagatgttcrtggtacatatctcatagggtttctgagtggataaaatgttctgatacatgcaaaatagttagaatagtatttgcctggcataccttaagcactcagtaaa

SEQ ID NO: 11623 - DNA, 201 bp, Homo sapiens
tgatagtggagagtctctttccaaatataagacctagcattaagaagtatttccaagtctcctattttaggaatctcaaatctctaaattcgagatatgtkgaaaaaataggcaattttcaagaaaatttgtgttgctgctagccctttggcttgtacaatacatatttttttttttagaatatactggaaagatgaaatc

SEQ ID NO: 11624 - DNA, 201 bp, Homo sapiens
tccaagtctcctattttaggaatctcaaatctctaaattcgagatatgtggaaaaaataggcaattttcaagaaaatttgtgttgctgctagccctttggyttgtacaatacatatttttttttttagaatatactggaaagatgaaatctctaataggtatctttctggagaacagtctttatagcaaggttttctttac

SEQ ID NO: 11625 - DNA, 201 bp, Homo sapiens
attttcagattaagttgaaaaggtccataatccttacggaaattttttttttaatcatcatcaggctattcttgacagtcagtaaaatatcaggtctttcycatttaactgacagatttcttctttttgctttctttcttccctctctgtatctatatctactctctttccagggctcacggcatatagtaagtattgaaa

SEQ ID NO: 11626 - DNA, 201 bp, Homo sapiens
tctctcgatattccgaggttatatatcaaaagaagccgtgtgtatggcttccagttacccatccagagaattcctgaaaaaagcaaattattcttaagatyccctggaattatgaatctcttggtggagatgcatggtagggaaaagggaaacttgatctggtttattctgaaccctttcttctcatcttatccttctact

SEQ ID NO: 11627 - DNA, 201 bp, Homo sapiens
ccaaaacaattcagtatgaatcagacgtacacatacataattgtctcattgagtttcccatctccactaagtcatggtcactgttttgccttggttatggyaactaaaagccaatggagattaatggaaagccccccaggagaaaatactcttttgcggtctttggatgaaggcctgagtatcagcaggactggagttcta

SEQ ID NO: 11628 - DNA, 201 bp, Homo sapiens
ttgccaggcatgtgacatacgactctgaaatcttgcaacaacccagttagaacgacttactaagacttgaagttaagtttgcctaaatgtatacagcaggygattaaaatatggatttaactgctgatttgttcatatttaagatccttgacctttccactgttataatagtacatattgatattccactggcgatgagta

SEQ ID NO: 11629 - DNA, 201 bp, Homo sapiens
tctgcttctggaaatttctagcacataagaagatagctggagggtatgtttgtctgtatagtttagaggctggctggtgctataaaggaaagtaagaaaarggcaaagatatccttcagaggattcccccagaagaaagtagcagttatgaagttttattcctgaggtaggacaggcagtcagacccaagaggtctcagtg

SEQ ID NO: 11630 - DNA, 201 bp, Homo sapiens
aggacaggcagtcagacccaagaggtctcagtgtctctccctgtgttggatgtaattgcttttcattgtcaatactgaaagaaggcacacaagagacaaaygaaatgtgtgtgtataaacctggctttggttttcagagacagtcttcttacaccttcagatctcctagatgagctgggccttacagaaaatacaagtctt

SEQ ID NO: 11631 - DNA, 201 bp, Homo sapiens
taactgatttttctaatttaagggagttattttctgtggaggaagaggctataaagtcacatttttatcttattttcttttttttttctctgatatttctkctctgttttccacattccttgtcactgtcaaaactggtaattaatcaagagttagtcatggatggctccttttccctccccttcttatccttcattttcc

SEQ ID NO: 11632 - DNA, 201 bp, Homo sapiens
ttcttatccttcattttcctgcctgagtgataacgaatgatgtctcttgtcctgtacccctggcttcctctcctcagagcattcaagccagaccccatgayaagatgctcccagtgaagggagaaaactgggaatgacaaatgtgagtctgggaacccaggcatcaaggggtggacttcctgatctctaccacttgccatc

SEQ ID NO: 11633 - DNA, 201 bp, Homo sapiens
ggccttgaaggccagctgcgtcatctggagatgaagatggaaggaaatggggatcactgaggatgaagaagaaaaggagccctaaaggtctcttacagtcrtcattttgtccgtagaaacacatctctgggaaggaatgagttaggtttttcttattctttcttcattaataaaaatagaaaaacaggtggtgaaacaaat

SEQ ID NO: 11634 - DNA, 201 bp, Homo sapiens
ttcatttctttggacaagtatgttaatttcttcatatgcagttgtcaatggtccaggtttcggaaccaaatagcctaaatttgtgtctggaccccactacytgctattattgactttgggcaaactagttaacctttctgtgcctcagttttctcatctttaaaatggggctattaagagtacttctctgtattgtcattg

SEQ ID NO: 11635 - DNA, 201 bp, Homo sapiens
gctagaagtgactggcatggctgagacctagaattacctggaggcttctttattcacgtgtctgtgtctgagcctggaatgggatgatttgaaggctgaasttagctgagatggtgtggcttttccatgtggctcaggcttttcatgcatggtggctgcgcttctgagagagaagtcctgagaggaagtatctggaaaggg

SEQ ID NO: 11636 - DNA, 201 bp, Homo sapiens
tgagcctggaatgggatgatttgaaggctgaagttagctgagatggtgtggcttttccatgtggctcaggcttttcatgcatggtggctgcgcttctgagwgagaagtcctgagaggaagtatctggaaagggagccttccaagagaaccaggtggaagctgcattgccttttctgacctatcctctggaggcacacagtt

SEQ ID NO: 11637 - DNA, 201 bp, Homo sapiens
cagttacatttccaccacatttcattggttacatgtgaatcagaccaaacagattcaaggggagaaagaatgagcctcacttctttgcgcaggagagtcarggtcacattgcaaaagagcgtgttggatggaagatgttacatctgattttgaaaaatatacttctctacaatattgtttggtcatcttataaaagtaaaa

SEQ ID NO: 11638 - DNA, 201 bp, Homo sapiens
aggaattaaaagcatccattcttttattcaggaaacctttgagcacatgagtattccaagattgtattctgtacttggagtatataggaatgaacaagacrgccacacttagcagaatgggagagggaggcaataagaaagttaaagaagagatgacaatgtcggtttctgatagaagctgggataaaaaaaggaggtagc

SEQ ID NO: 11639 - DNA, 201 bp, Homo sapiens
ctcgttgttttaatttgcatttccccagtgacaaatgatacagagaatcttcatatataattattgccatctgtattactttttgggtgaggtgtgtgttyagatctttggccatttttcatctgctgttttcttattgttgaatttcaagagtttttaacatattttggataacagtcctttatcattatgtctttttca

SEQ ID NO: 11640 - DNA, 201 bp, Homo sapiens
tttcatctgctgttttcttattgttgaatttcaagagtttttaacatattttggataacagtcctttatcattatgtctttttcaaatatttttcccattmtggcttatcttttcattctcttgacagttacatcatgcttttaattgtagaattagacaacaatgaaataaccaaagccttagtaatcttaattagagat

SEQ ID NO: 11641 - DNA, 201 bp, Homo sapiens
gagtttttaacatattttggataacagtcctttatcattatgtctttttcaaatatttttcccattatggcttatcttttcattctcttgacagttacatyatgcttttaattgtagaattagacaacaatgaaataaccaaagccttagtaatcttaattagagattatcttctattattttctatttttcttgtttcac

SEQ ID NO: 11642 - DNA, 201 bp, Homo sapiens
gcttttaattgtagaattagacaacaatgaaataaccaaagccttagtaatcttaattagagattatcttctattattttctatttttcttgtttcacctsagttagaaaactgacctgcactgacttcctctttcacaataattccagtgaaatgaaagtgattagaaagtcttagcaaattcaccaaaagttagagcca

SEQ ID NO: 11643 - DNA, 201 bp, Homo sapiens
aaagccttagtaatcttaattagagattatcttctattattttctatttttcttgtttcacctgagttagaaaactgacctgcactgacttcctctttcayaataattccagtgaaatgaaagtgattagaaagtcttagcaaattcaccaaaagttagagccagaagactcacatttcaattctctacctaaagagaagg

SEQ ID NO: 11644 - DNA, 201 bp, Homo sapiens
aattcaccaaaagttagagccagaagactcacatttcaattctctacctaaagagaaggacaggcagaagccaaatatgtaaagagtttgtcagaagtatrccttggagccatgggcattgttcattactctgctgaatttatcttatggattttcccctccacattaatgtttcaatgatcttggttagattgttgaagt

SEQ ID NO: 11645 - DNA, 201 bp, Homo sapiens
ttatccctatgagcaattaaatacttttaatgggaatgtcatgtttttaaatcacatttcttataagaaaaaaatggtgtttactcaaatgaatgtggtcygatggtgatcctgatctatgagcagtaattgagatcatggaaataaatacaggaaagctggctccctgctcccttcaataaccaaatctatggtttagac

SEQ ID NO: 11646 - DNA, 201 bp, Homo sapiens
aacctaattcccttttaccatgtagcctaacatattcacagctctagggattaggatgtggacgtctttcaggagccatgatccttccttccacacattawctgcagctaagcaacatgactccccatcacgacagagtagaaggagaaactgaactgtgagaggggaaacagctttatcaaaacatagcaaatgtcaatt

SEQ ID NO: 11647 - DNA, 201 bp, Homo sapiens
attcttttataaacttgctgatatggaaattaaaaattaaatctacttaatggaaaatatttgatataagaacatcagacatatctttgataggcaataarttactttatagaatcgtttagcatcttatcttcagggctattttttggccctaactttgagcacattaattttgagttcctcttgtttctcttctatttg

SEQ ID NO: 11648 - DNA, 201 bp, Homo sapiens
atcaacttatgtctcaacattttgttgcagtagaggaatttggaagaagggaaaagagaatagcaatgaattgattggataagaggcagacacatgttttwaaaaaaggatcagagcttgcccagtttctatttaaagtattgtaaggacctaatagctagctatagtgatacatttaagattaaaatgagcagatttggc

SEQ ID NO: 11649 - DNA, 201 bp, Homo sapiens
taaagagtcaacctaagtgttcatcagaggataaatggatgaagagaatgtagtaatgtggtatatacacaatcgaatattattcagccttaaacaagaargaatttctgccatttgcagcagcatggataaacatggaggacattgtgctaagttcagaaataagccagacacagaaagactaaaacagcatagtttcac

SEQ ID NO: 11650 - DNA, 201 bp, Homo sapiens
agcgaggcaggagctgccaaacacttttaaagccatcagctcttgtgatgaactcactcactatcatgagaacagcatgggggaaaccacccccacaatcyaatcacctcccaccagatccctccaacatgtggaaattacaatttgagatgagatttgggtgggaacacagagccaaacgatatcatcaagcaagtgggt

SEQ ID NO: 11651 - DNA, 201 bp, Homo sapiens
cacctactaacccagaatattcccaatgtcctagtcaagagatactatagtcaagtacctggccacataggaaatgctttctaaaagggtatgtatttggrattttaggttaggataccaatgacatatttttcaccattacagatttgataacaagatctgggctacccaaacacctacttgctgtctgcaaagatccta

SEQ ID NO: 11652 - DNA, 201 bp, Homo sapiens
ttttgtctggcaataatatttccgtatctgttttcttttggttaacatgtttcaagcatattagttagaatatttgtttgacagtatggtagttctgcttstctaggtcacctccagatccaggttgcctttttcttgttgctcagccacagcacattgggcaacctatcagttcagcaaatgttaaccagaagaaaacat

SEQ ID NO: 11653 - DNA, 201 bp, Homo sapiens
gtagataggtggtttgggttcaaatactggctctggcacctcctggctgtgtgagtatagacaagttacaatctatgcctcattttctccaattgtaaaayagagatacttataataatatatatcttatacacattaatcaagtattggttattattattacctttatttttcttctgcagtttctagaatgcctttgtt

SEQ ID NO: 11654 - DNA, 201 bp, Homo sapiens
agtgccctaagaggtaatgttgtgtttacagatatggggaaaaaaacagctattggttcagtgaagacttgtgttttctttcttctcagtttatcttctgkgactgagtccagatctttatttgcacatagactaattctgtctgactgcagacacatgctctaatgtccacacattaaagctttctttacctagacctgc

SEQ ID NO: 11655 - DNA, 201 bp, Homo sapiens
ctcaatactcagtaggccctttaaaaacatcagttttagtttgtacttttcccttgattgagaatctctcctatttggtagactgctactaatttttcacrttgcagctgactccataatatctggtctgcaaagttttccctatctcccactgcacagtgagtttcccagccttctgtgtttacttttttcgctatagaa

SEQ ID NO: 11656 - DNA, 201 bp, Homo sapiens
cgtttagcctcatcactcaaaggtccttctgccttcttgattccagcgccctggccttctcccaaccattcatattcaccactacagacttgcctttgctyatcctatttaagcagaatcctcacttcttcctttgatggtcacctactcagaactaagaactcttctttagtgtagcacctcctcaaggaaatccccctg

SEQ ID NO: 11657 - DNA, 201 bp, Homo sapiens
taaaaccagtaacggagagaaaaataaatataatgcctctcatttatatagtgcttcacaacttttaaagtgctgttttatgttccccattatgccccttkgtaggagagtattgtttctaaaaagacagccatttaattatcacttttctttataaattcaattacatttcccagtccatgtagttcatcagttcagaga

SEQ ID NO: 11658 - DNA, 201 bp, Homo sapiens
ataatgcctctcatttatatagtgcttcacaacttttaaagtgctgttttatgttccccattatgccccttggtaggagagtattgtttctaaaaagacarccatttaattatcacttttctttataaattcaattacatttcccagtccatgtagttcatcagttcagagatgtttgtcttcatttctgtctatttttta

SEQ ID NO: 11659 - DNA, 201 bp, Homo sapiens
gaccagccagaggctaatttctgtggtatttcttcctgatgccagaataggtagacaagtcagaagcacccacttcagataataaagatataattccagtyattcaaatttgtgttgaaagcaaatcctttcactgcttatttttcaattagtgccaagtgtggctccatggcttctagctacagaaggccaggtgatcga

SEQ ID NO: 11660 - DNA, 201 bp, Homo sapiens
tataacaggagcagcaactcttgagagcttggaaatcatacaagaacactttcgctgtattctgttggtcaaagcaagtctcagaatcaggctagattcartgggcagggaaataggtgacgtgtcttagtgggaggaacagcaacatcatactacaaaagggtgagcgtgcaaggatgggagggtttcttgctgtgtttg

SEQ ID NO: 11661 - DNA, 201 bp, Homo sapiens
gcgtgcaaggatgggagggtttcttgctgtgtttgccaacaatttaccataaagtgataactgagttggaccttcacagaaaataaagatttgggaaatamagactttgccagagcagggattataaagaagagcattacttcagattagctgagaatgaggccacacgcctatattgcattattgaggaaatttcctctt

SEQ ID NO: 11662 - DNA, 201 bp, Homo sapiens
ctgtgataggcctttgggaataattcttttcaaggcctgaagcatttaaagtgcactgtatattgttctaaatgcaagaccaatgccccattctatcagakaaaagaaaaagggtatctgtgggaaactatttaaaagattaaaggagctttgactgaaatgtggtttggtggcaaagaaagggaaaccaccatcccttgg

SEQ ID NO: 11663 - DNA, 201 bp, Homo sapiens
gagttctgatgggaaagataatgagaagtgtttacttagcatctaggccagcaagctaagaaaaacattgtgccatgctagtattgacaaggtgacagagwgcccacacttgcctcacatgttggccactcccgatgctacatcccactttactcttgctggaggactgacattaatgcttactgttttgaggtctggaca

SEQ ID NO: 11664 - DNA, 201 bp, Homo sapiens
atgattctttcacattaaatgcaactccttttcaacatatgtgtatacttggccctttattgaacctttttataagctgccaattggaaatacacagtcayggtagatatgacaatgagcaagtcacttaataactatcagcctcagtttcctaatctacaaaaggaggctattaagagcacctacctcacagtgttaata

SEQ ID NO: 11665 - DNA, 201 bp, Homo sapiens
ctcataaaatattagctgaatagttattatataaaaaggaaatgatcagaatatcacatttcgggtggtggtgtttagtttgtgggttccttcatgtgacrggttgaactgggtggtagagaattctgagttctgtacaacagagtgattgatttctcggtttgcatttcttggcatctggcagtgacaccactgcagacc

SEQ ID NO: 11666 - DNA, 201 bp, Homo sapiens
aatgttataaagaacttggccaagtccataaaatgtccatggtgtataacaaatcttttatggtgagtgatccatggaattaggtacttagaaaagtcgaytgaaacatattcacagaaaggcaaaggtttgatgacctggtgcatggaatgagacagagacactgagaaattttgattgtacaagtttttcctaatatcc

SEQ ID NO: 11667 - DNA, 201 bp, Homo sapiens
ccagactggtcctactaacattcttgattaccacttatttaagtgaccatcaaaccagttttatatctgatatgtttaatccaaataaatgtctttttttwaaaaactgtttaaaaaatggtatttaaatccttcccagattttagctgtgtatagtctggaaggaaacccattcacatggttttatcaggtttgatattt

SEQ ID NO: 11668 - DNA, 201 bp, Homo sapiens
accaaaatggcagaacatttaaaatcagtctgccaaatatcttttctcactttacttcatttgttgaacaatttatatgctgatatagatggccattttarcagtgtatacaaagcatttatatccacacatgtacatttaatcaaacctacatgtctacatacacatacttaagacacacatagagagagagtgtgtgag

SEQ ID NO: 11669 - DNA, 201 bp, Homo sapiens
gttgtcaccacctgtgacatttaccaagacaattttgggtaaaaaaggcagatttattggagaaagtacaaagataccttgcaagaaagcaatgcgcaggrcaatgggctgtctaccaagaggcaggagctagagggaagttttatagggtcatactggaggggctatgtccagataagttgtgcagataaggtcctgctg

SEQ ID NO: 11670 - DNA, 201 bp, Homo sapiens
cctgacactcttggacttaaatgttcacctacactcaatctgatcatggacaaactacttaatctcactgagcccatgtcctcatccataaaatgagggtrataatagttccacgttttagtattgttaggatgattaaataaaataatgcatgtaagtaaaataacccagctattggaacaatcgctgctgtataataaa

SEQ ID NO: 11671 - DNA, 201 bp, Homo sapiens
ggaaactaccctgaaaactgtagaacattctacaaatattatctaacaaaatatatgaatgcataattagtgtcttcaagggatgtcataaatatcgtaawactaaagggtgagctgtatcaaaacttggaagggattgggatgaaaatcaaactgtctaaaatagaatggccaaatacattgggacttggctccagaaag

SEQ ID NO: 11672 - DNA, 201 bp, Homo sapiens
cttggggtttcataatttctgcctgaaatcctttggtttcctctcaggaggcatggagtgaatttatagggagattcttcaatccagacacaaaaaaaggytttaaaattttttgtgtgtctccatatttgactttctgtctcccattctcatttcctttactttcatgtgtgtgttttcttcttactgtgccaaacacat

SEQ ID NO: 11673 - DNA, 201 bp, Homo sapiens
gcaggtgacagtaaattggagcacttggccaggcaagccctgcatctgccacagtgagatcagttactggagagtcatcccaggcctatttcacactgccrtctgggaatgtgggactctaggttcttaagtgttaactatgggcaaaaaagaaacaagaagtataaagtcattgagaagattgtctgcagtagggcaggc

SEQ ID NO: 11674 - DNA, 201 bp, Homo sapiens
ggactctaggttcttaagtgttaactatgggcaaaaaagaaacaagaagtataaagtcattgagaagattgtctgcagtagggcaggcatggatgaaaatygaactctactttgtctgtgggtgaattatttaccttctatctgtcctgggtctgtaaaacagttataagaatagacagggttaatttgtgaaacttagat

SEQ ID NO: 11675 - DNA, 201 bp, Homo sapiens
attaaaacaaatattaattcctcaaagtttaattcttaacaaatattaattctacaaagagctaaaaggctctatgtaggtagataacggcattcagattyacctcctaatctttacagtaattggttttaagggttggagaaagaagtaaaggaggtaaaagaatgtacatagacaataataattatgaataacatttac

SEQ ID NO: 11676 - DNA, 201 bp, Homo sapiens
gccatagcttaggggttaaactcacagacatttaagtcacatgttcttgagttcaagtccaagttgctggccctttgggacttttaactcccctatgatcrattgctataaattaaaactcagttaatagaatataatgtaagtagttatatatcggaaccaatgatagtacctacttcttagggttgtcaagagcatcca

SEQ ID NO: 11677 - DNA, 201 bp, Homo sapiens
atgtttatgttgataatttctccccttttatttttctatcagtcagatttataataagaatcagctgttctttctaaaagactattgtgcctttatattaytttctttaattttcaataatcctatgaattagcaattattatcctcatttttacaaatgaggaaactagagatccgaaaagtaaacagcctcccagctaa

SEQ ID NO: 11678 - DNA, 201 bp, Homo sapiens
ctgagagaaatgggaagtcccctgagctgaaagttgggagcactacatcctcatcaacctaaatctgccacatacaatctctgtgatcctggggaagtcaytggacctctttgagtcatgctgtcctcaaatgtaaaatgagttttacatttaaatgttctaaataagttcctttagaatgtttcaattaaaaatttatcc

SEQ ID NO: 11679 - DNA, 201 bp, Homo sapiens
agaggtaaaccaataggctcactttccaaaagaaaatctgaagcatttaagattatttaataaggaagaatttcctctggtgtcctgaatgaggaatcttyggggcaagaagggtcctgtcctatttattatccttaagaaattccttgctatttttagttctcaacatcagctacttctcattactaagtaaaagccaga

SEQ ID NO: 11680 - DNA, 201 bp, Homo sapiens
acttacttacaaagggtcatgatgtgtttgtcaaaactcatcagtgtgtccagaaactatgtgcgtgtgtattttagtcaaactttctgggagttaaagtrtatataaggtaacacagcaatggaacatcgcaatagttggcatcagatttgcaaatggcacaattatttgtttcctcttcactggtccttgaaaaataca

SEQ ID NO: 11681 - DNA, 201 bp, Homo sapiens
tgcctagaagagaaacctcctgggaaaaagaaaaagtgatagaagacacaagggggagatgaaggcaggtggttttctcagtttttttactgctataacaraatatttgagatttggtaatttataaggaacataaattaatttctcacagttctggaggctgggaagtctaagatcaaggtactggcaggtctggtgtct

SEQ ID NO: 11682 - DNA, 201 bp, Homo sapiens
tgtaacctggactagaggcagctctctgcaggggagctggtgtgtgttttctcagatctctattattcccatgatatttctatctaaatctgtttactttkattccacacatggttttgagaggcagcaagccatagtagaaagatgtgcttaatttgaaaccaaaaaaaagttggatttgagttccatttttcaatccat

SEQ ID NO: 11683 - DNA, 201 bp, Homo sapiens
gctcacaggacttaatggcaagcctcccttaacaccatcagttggatgaattatctcattgacccaccgcttacactgctccttgtcattactcctggggyattgttcagtgcaacagggcaagaaataactcattgactccctgaagctatagatgatggattttagatccctagctgtattcagaaggcataggagctc

SEQ ID NO: 11684 - DNA, 201 bp, Homo sapiens
attcattagccacccactccacagaatcagtttcttagatcctggtgctgtcactgctgctgttgcaacttgttagtgtttcagggacagacgtcagaggraactgtataactacattagcctcacagatagtaccgacagccagacctgtcatttcctggcctgcgatgacacctctggagcctagaatcacttaaagat

SEQ ID NO: 11685 - DNA, 201 bp, Homo sapiens
ggaatctgaagaaagagcatacctgatgaagataccagcatgagtgtcatatcaaaggaaatacaggatgtgttctcaaattcatgaattcaattggaccrtaatgaatggcataagaaaagaggcaggtaatatggattagcacaaagaacatatgatttaggggcaattggtctctgattcaaggtctagttctgcctc

SEQ ID NO: 11686 - DNA, 201 bp, Homo sapiens
acttaatttttagggagattattttggctctgttaaaagaatgttgttcagtgggttcaaggaaaacagcagggtcttgagtaagtgtttctagagaaacrtctttaaagacttattctatgatgatgcatataggaaggtaatgaggataaaaccaaagaacagttcagagattgaatcggcaggtgttgtcagcaggtt

SEQ ID NO: 11687 - DNA, 201 bp, Homo sapiens
ttttgtcaatatagtaaattgagtaacagcctctgagggccctgcaaagagccaaggcccaatttaactccctagtgccagggtctccaaatgtttttggytgtctatacatactagaaaaaaattaactctgcaccaattaaaaatatgtatatatgtatgtagaatacacacattgcttatattatcacacatacagaa

SEQ ID NO: 11688 - DNA, 201 bp, Homo sapiens
tatgtagaatacacacattgcttatattatcacacatacagaaacatcaggcattttaaaagataagattagatacatatatatcccagtattattccctkaagttcccatgaaccaaccttggcacccctgtggatgcccaccccaacttggagaccactgctgtggtgggaaaaccatggtgacaaacggagccaccac

SEQ ID NO: 11689 - DNA, 201 bp, Homo sapiens
ctaagaaagtgctggggctttagggaaattgagagagatttcttttcttccccctccacaaaaggtaattaatgagtacaacagacaattcaaagcaagaraatagaatctgaaagcttgaaagccatacattcagaatccatttagagatttacagaagggctttagcccagaacagtgcctacaggagctacagtggtg

SEQ ID NO: 11690 - DNA, 201 bp, Homo sapiens
tagctttatattatattaccaatccaatctaagtgcattaccaaagctttgaagaccctgtttgatcctacctctcaataccctccagaacatcctcctcrtctaccactttcctccacatctaccacaccctgggctgtttgtcaaacatgcctggtttgttctagctttgagcttttctctgtctgggagacttcttcc

SEQ ID NO: 11691 - DNA, 201 bp, Homo sapiens
ttcttccttcagcaccagagctgacttttccttgttttatacatagtgagatgtcagctcagatgttacctcctcaaaatgatctttttgatcatcataayttagtaagctctctccctccaccagtcacactgtcccacatctcttcattctgtccagtattagtctgtaattaccatgtgcttacatgtttaatatctg

SEQ ID NO: 11692 - DNA, 201 bp, Homo sapiens
ggtctctttctttaattaagctttgattaagatgctcccagcaaatcccacactgaacatttccattgccccctccctcccccgcttctactatgagagaycgagatccatgtgaggtattctgtgatgaagatcttgttctgtttttattattaagcgtacatcttccccttttctgatattaccactatgcatcatcag

SEQ ID NO: 11693 - DNA, 201 bp, Homo sapiens
cctcaatcaaagcccaaaccataccccaagggcactctgcatcgttgaatttatagatgagatctttcttttgggataaagagctattctcaacttgactrttataccttggccttcattccctaaagaaaatgggcagggaggcttgcagacagaagtatatagtgtggaaaatgaaccacctcttttgactctttgcaa

SEQ ID NO: 11694 - DNA, 201 bp, Homo sapiens
gtttacctaagataattgcagaggctttagtctaagagaatcaaagttaagtgatagcactgtcaaaaaggtttcttaaggaagaagatctaggggttctygggattcgttgaatttgatgccatggctgaaaaattaagtggagatacactgtatgccattggagtcaggcactcatgtgaaagatcagcactcacattt

SEQ ID NO: 11695 - DNA, 201 bp, Homo sapiens
tatacttttccaaaaagaggtggagagaatatttattgacttaggtatgtctgtgatgatctaatgaaatgtcatggaacaacttaaagtcatagccaaakgaagaggaatgttaatatgtaagaatttgcagatagattattaacatggaatgatgccaaaatagcacagtagaaaaactaaaataaattaaataggcct

SEQ ID NO: 11696 - DNA, 201 bp, Homo sapiens
ttttcttgcttacttgcttggttgctttctctctttcctagctgaatagcattacaggccacttctaaaataaactgggttgtggaatttccactgaaggytggagatgaaaaacatactcatttacactgtgtgcgaacttggtggactaacattggttaaactttgaaattaagagatttttttttcctgatttttggc

SEQ ID NO: 11697 - DNA, 201 bp, Homo sapiens
tgaaggctggagatgaaaaacatactcatttacactgtgtgcgaacttggtggactaacattggttaaactttgaaattaagagatttttttttcctgatwtttggccatctctttaatgcaatttcaggtagccacatggttcttaaaaccccaaatgcagctatcttcagtaagtacaaaatgaaaatatgttgcatcc

SEQ ID NO: 11698 - DNA, 201 bp, Homo sapiens
ctgagcccacattcctttttttctgggtagggggcaaaactttttctgaaatgggggtcttatgacctataatcaaacaaggtagtcaggcagtttctgcrtggtcagtttttacacagaaaggcagagggaaattggagtaatatttttaggtcttatgactagctttgaggaagagggatcctagtttctatggctagc

SEQ ID NO: 11699 - DNA, 201 bp, Homo sapiens
gacatgtatgttaagtgactagcacagcgcttaccagaggaccattctcccgctgtagcaggacgagccgcagacgaaacctctcagacaccaaattgtaraaggaagggctttattcagctgggagtatgggccagctactctctcaaaatccgagctctctgagtgcacaatttctgtcccttttaatggctcacaaca

SEQ ID NO: 11700 - DNA, 201 bp, Homo sapiens
aacatcggtttctaagttatgagttgatttttagctactgggtttaggccaggcaggcccaggcctggtttcgggcctggcgccgggctgcctgtctttgrttttacttccttgttgttttttcttaaaacaggtactgagtataaaacaatataaaacaatatgagagggtctctctcttccctcaccacatatgtgaga

SEQ ID NO: 11701 - DNA, 201 bp, Homo sapiens
ctgtctttgattttacttccttgttgttttttcttaaaacaggtactgagtataaaacaatataaaacaatatgagagggtctctctcttccctcaccacrtatgtgagaaaagagaaaatatggctaagtcatgtacttaactgagtattaaaacacatgtcttaccagaaatagcaatttttcaagtgtgtgaaacaca

SEQ ID NO: 11702 - DNA, 201 bp, Homo sapiens
accaccacacctggctaattttttttttgtatttttagcagagactgggtttcaccacgttggccaggttggtcttgaactcctgacctcaaatcatccayccacctgggcctcccaaagtgctgggactacaggtgccccgctcaagacagattttaaacctagcattcttgctccagaattcatgctgttaatcactgc

SEQ ID NO: 11703 - DNA, 201 bp, Homo sapiens
gagtacctattatgttttagtcattatggtagaaacatggcaaatggatataaacaaaaaacatataattccatgcctctgttcagattgttgtctgcccytgagattcctctttttcccactccccttgactaactcaactagccctgctttttgtttgcctgtttgttctatttattttttggaggacagggtctcact

SEQ ID NO: 11704 - DNA, 201 bp, Homo sapiens
gaattcacctctctaagattatggactacatattccaaatgtgtagattttgacctaaattttacccattctacagaaaaccaacaaactccacctcagaragatgttctcactatatctacccaccagggtaccagtctaaaaggccccaatattttctcctgtgttttctgaataattgtgtttgagctagagccggga

SEQ ID NO: 11705 - DNA, 201 bp, Homo sapiens
catttttatagaatccagaaataatgcatgtaacttgccattcctccccattagtacacttgagtccaaaggagaggttcacagcatcgtgctcttttgtsatgtggtttagaagaaaaccagctcaggacaagtggactctgaaaatagcagactttcctttactcatcttttgagttttcagagaagagtagagattca

SEQ ID NO: 11706 - DNA, 201 bp, Homo sapiens
ccaagaattcagtagaagacggaagcgtggtaaggagaacaagaactgaagacataaacaaatttatttgaaatatggttgcagtggagcagggagagtgrattcaggggaaagaaaaataaaatgaaataagatgctgaggttcaagaaaggataaaaggtaaagtggctgaatttaaatgacctgggtttcagttttta

SEQ ID NO: 11707 - DNA, 201 bp, Homo sapiens
gaaaagaaacacacttgccccctttttgcagaagtaagctcctttagtgattttcatctcattttcttctatactttttttttatatttgttgtgagcacsatcttctcttttttaataaattcatatttttcaattatttttattattaaggtaagaagtgtgcttttgttggtggaggaagaaggaagcccctacatgc

SEQ ID NO: 11708 - DNA, 201 bp, Homo sapiens
gttcaatacaatttatatattgaatacaaaagagattttcacttattgatatggctttctaggtgtttaaattctaactcaatattttaaggattcagtartagtagggtttccatttctacatggtaggcattctctagtttacttttcctcttctttctgtagaaattaactatttttgcttcacagtcatttcatgat

SEQ ID NO: 11709 - DNA, 201 bp, Homo sapiens
acaactactaagttacacattcaataaaaagactttttctttgtaatgttatatgttaatggtcagcctcctagatactgatgaagcccatcaatttctastgatagttaagatcaattaaccaattagttacccattttcatttttcctgtatattctttgtagatcacttactaaaatgattttctaagaccttcactt

SEQ ID NO: 11710 - DNA, 201 bp, Homo sapiens
gaaaaataatgagacatctgatggaacttaggatcttatttgaaaaataagccatcaagtactttaactttctggtatttcaaaagtaaaaacatatactmatcacttgtttttatttcacttatttgacactacacatctgtcttagtacaaactcatgtttatgcaatgagatttattagactgatagttcatatctta

SEQ ID NO: 11711 - DNA, 201 bp, Homo sapiens
atttcacttatttgacactacacatctgtcttagtacaaactcatgtttatgcaatgagatttattagactgatagttcatatcttagccccttttcatasagaatcattgaaaaaaaaactgttcactgtgagaaaactctctcccctcactactgatcgcttatagtaccaattcagtatatgagaagacactattttt

SEQ ID NO: 11712 - DNA, 201 bp, Homo sapiens
tctacactctaaaccagaagggacttattccaccaaaagaggttaagggctccttaccacagtcacaaaaccagaatatatattctttcagagaaaacccrgatacagggcatgagattagaaccctagaatggcatatcaaaaacttctggagtctgttgagtagaagtttggagaataaacaaattgatagattgatat

SEQ ID NO: 11713 - DNA, 201 bp, Homo sapiens
actgaccagtagcagaaacagagatccacattctaatctcacgtctttctactttggttaaaggcaataattcctatttcactcactgatgagtctttccstaacgagaatgtgactaaaaccagttgagtttgcgaaagggatgtagaaagagacaattaggtaaaggtgaaaaatgagactgacgaagtgacgttggtc

SEQ ID NO: 11714 - DNA, 201 bp, Homo sapiens
gttggctccagaagtctttacaaagttagcttggcattggctgggtttcaaagaataaatagaaggggataaaccaagaagaaatgtggatatatatgggkcacgattgaataatttccagaaagaaatcagatagtacaaggagtgtccagagaatgatgtatatggctgaaatggaagtgttatagaatggtagttagt

SEQ ID NO: 11715 - DNA, 201 bp, Homo sapiens
ctcccttcatgactactgttaaagataaagactgcctttggttgacaccataacccacaagaaatgattgcattcctcctggatggggagcaggtgacatygcagatgttacacttcccacatggctaagccactgatcgagattaaaaattcaaaagacaccaaagagccacgttattgtcccctcacagggagctctag

SEQ ID NO: 11716 - DNA, 201 bp, Homo sapiens
caccacttttcagagttattgaaggaattcacccatcagatatgttttgattttattcagtgattgttcaaactagatccgtttctctaccttattttcartgggcagtggttctctagttcatcaaaaagtttttcctctggaatttttgagaagcaatagaaatccagagcatttaaaggtgatgattaattagtatat

SEQ ID NO: 11717 - DNA, 201 bp, Homo sapiens
tacttttgagaggtgacaacgtgctagcagccctcgctcgctcttggcgcctcctcggcctcagcgtctgctctggctgcgctggaagagcccttcagtcygccgcggcgctgtgggggcccctctctggggctggccaaggcctgccctctgctggcggggaggtgtggagagacaggcagaggtgggagtcggggctgc

SEQ ID NO: 11718 - DNA, 201 bp, Homo sapiens
cttggcgcctcctcggcctcagcgtctgctctggctgcgctggaagagcccttcagtccgccgcggcgctgtgggggcccctctctggggctggccaaggsctgccctctgctggcggggaggtgtggagagacaggcagaggtgggagtcggggctgcactgggcgctcgctggcaggcaagggttcgggctccgtggcc

SEQ ID NO: 11719 - DNA, 201 bp, Homo sapiens
agctaaaggtttgtaaacacccaatcagcactctgtgtctagctaaaggtttgtaaacgcaccaatcagcactctgtgtctagctaaaggtttgtaaacgyaccaatcagtgctctgcatctagctaatcaggtaggggacttggagaccttttctgtctagctaaaggattgtaaatgcaccaatcagcactctgtgtct

SEQ ID NO: 11720 - DNA, 201 bp, Homo sapiens
tgtaaacacccaatcagcactctgtgtctagctaaaggtttgtaaacgcaccaatcagcactctgtgtctagctaaaggtttgtaaacgtaccaatcagtrctctgcatctagctaatcaggtaggggacttggagaccttttctgtctagctaaaggattgtaaatgcaccaatcagcactctgtgtctagctaaaggtt

SEQ ID NO: 11721 - DNA, 201 bp, Homo sapiens
cacccaatcagcactctgtgtctagctaaaggtttgtaaacgcaccaatcagcactctgtgtctagctaaaggtttgtaaacgtaccaatcagtgctctgyatctagctaatcaggtaggggacttggagaccttttctgtctagctaaaggattgtaaatgcaccaatcagcactctgtgtctagctaaaggtttgtaaa

SEQ ID NO: 11722 - DNA, 201 bp, Homo sapiens
acccaatcagcactctgtgtctagctaaaggtttgtaaacgcaccaatcagcactctgtgtctagctaaaggtttgtaaacgtaccaatcagtgctctgcrtctagctaatcaggtaggggacttggagaccttttctgtctagctaaaggattgtaaatgcaccaatcagcactctgtgtctagctaaaggtttgtaaat

SEQ ID NO: 11723 - DNA, 201 bp, Homo sapiens
ataaggatgggctttagagccaaaatttaagccatgctttgtcttatctgcataattttatgttcccagtcaggtaaaaccttacccatttatctttattkcctatcaaatgcagacttccctatgagctgttgcttggtaagttccaacccaatatgatgtcaccactgggtggacctctatggcacctgtctcactctg

SEQ ID NO: 11724 - DNA, 201 bp, Homo sapiens
atttttacaggtggctaaggaaagagcatttgcagccatggaatcaggtgttgttattttgggtgtgaccttgaatagaggctgctaacttttggcttctstttccgataataaatctccctcctccccacccccaccatcagccccaaggaaagatgaatgactcaggtgcttcagagacttcccaagaagtggtttcag

SEQ ID NO: 11725 - DNA, 201 bp, Homo sapiens
gagcatttgcagccatggaatcaggtgttgttattttgggtgtgaccttgaatagaggctgctaacttttggcttctgtttccgataataaatctccctcytccccacccccaccatcagccccaaggaaagatgaatgactcaggtgcttcagagacttcccaagaagtggtttcagtatatgcagcaagtggacattta

SEQ ID NO: 11726 - DNA, 201 bp, Homo sapiens
attagtggcagaaatgagaccagattccagtctcttgctttcccgaataccttattctggaattcaattataagtacaaggcatcccactcttggcttcckttctgaataaatgcttgcaccaaatccccagtggcttcttgagaaagctggctacaaatcttcaaagcctcagttgaagaattcttattaagcctactag

SEQ ID NO: 11727 - DNA, 201 bp, Homo sapiens
gaaacaacaagtacactgtggaaactttagctggtattgaaaggagaaaaaacaaaccgaaaaaacaaaaaggcaaatttaagactccggttgggtgtcasagatggtacactaaaattgcaaatgaatgccactctgtaatcatgaagatggtgatcttaatcccacttaaagggacactagcctcttacccaacagttt

SEQ ID NO: 11728 - DNA, 201 bp, Homo sapiens
agatagcatcagaacataagaaaattgattggatgtgacagtgtgagagagaggagatgaagagcgtgggataatgcccaggttgctagctgggcctgctragtggatgagaatactaaggaaggtaaattcagaaggaacagttaagagaggaagtggaggaggaaaacaatgagtttggttgtagtcagagtatgtctg

SEQ ID NO: 11729 - DNA, 201 bp, Homo sapiens
ctctctctccctccagccttttttttttttttttttgagatggagtcttgctctgtcgcccagggtggagtgcagtggtgcgatcttggctcactgcaacytctgcctccaggtgattctcctgcctcagcctcccaagtagctgggactacagccaccacgcccggctaatttttgtatttttagtagagacagggtttc

SEQ ID NO: 11730 - DNA, 201 bp, Homo sapiens
ttagcattgcacttgatttgtgaagtagtgttgactgctagattcccatcattaacattaagttttattgccttaaatctctgtcttatgttcactataartgttttaagtcaacataatgctagcaagaggtgctgggttaacagactacagttggcatatgattctcatttggggcagggaattgtgcagggttattag

SEQ ID NO: 11731 - DNA, 201 bp, Homo sapiens
aaattccatgtgacccaaatactaccaaatcctaaaagatttaactaactggctcactaaccaatgcacacacatacttacttatttcacccagtatgtgytgactaccttttgcccaccaggagctaggcaggttcacagtgcctagctcccaggcacaaagataaatcagaaaccattctgtctaagtcaacctttcat

SEQ ID NO: 11732 - DNA, 201 bp, Homo sapiens
ttagtggtagtatgatacgggaaaagagtaatgtcaaaatgcatggtaatttatgtgatatgccgaggactgcaagaagtcaagaaagaaacataacaagytaacagctgtcaccaacaaatagcaattaatttcagcattcattcccttgctcatgcttcatgaaagtatataggtaaacaggattcgtatcatgttcta

SEQ ID NO: 11733 - DNA, 201 bp, Homo sapiens
tgccgggtccaactctcagcacatggtaagctcacagcaagtactgtattgttatgatttccactaatacagccattatgtgctatttaatttgtagttcrcgtatgtgtccccatgacggttggggccctgttttactaagctttataatcccagtatctcctgtagtagatgatcactaatattgacagttaactgaac

SEQ ID NO: 11734 - DNA, 201 bp, Homo sapiens
gtggagtgcagtggtgcgatcttggctcactgcaacttctgcctccaggtgattctcctgcctcagcctcccaagtagctgggactacagccaccacgccyggctaatttttgtatttttagtagagacagggtttcgccacattggtcaggctggtctcaaactcctgacctcaggtgatccgcccgcctcagcctccca

SEQ ID NO: 11735 - DNA, 201 bp, Homo sapiens
tcttttgtcccctaaatcaagctgtctcttaatgatgacacaggactttgtttttaaaggattaatggggaaaaaagagggggatcactgcaaaggtaacraattagaatatttttacctaaaccgatgaataggagtggaatgaaatttatttctgaaatccaggagatgacagagaaatgaaattggtgttatccacaa

SEQ ID NO: 11736 - DNA, 201 bp, Homo sapiens
ttacgctaaaaatgttgtttaaatttagttcaaaatgttctgttctatgtgaaaaaaatactatcattttatttaatgcaacctatcactgaaatgactayctcaagctgtttctctctatctcgtggagggaaggagtggaattgggggtagggtgcagggtggaaagaaaggagaggtaatactgttacccagagccaa

SEQ ID NO: 11737 - DNA, 201 bp, Homo sapiens
aagcaaagaaattgtgtaaacaaattaattaattgtctgaaagtgaaagcatgtttgtaattttgcccttgtcaaagaaaaattggagttcattatgctcrctgactgatttaaaagcttcttcccgcgtagcatcaccgggagaatgagtgtgttgtgagtgcaaagcatggatcggttgcagcatcaattaaaatagaa

SEQ ID NO: 11738 - DNA, 201 bp, Homo sapiens
accttgtgaacatcctccaatattgctacccgtttcctatcctatacccccaccctcacaacacagaaggtaggtaccagtttattcccaggtggaatctyctcagccaataatgactcctatatggagatggccctgcaattgaaatgctttagcatgcccctattcatttggtctgatgctatatgcaattctaatatt

SEQ ID NO: 11739 - DNA, 201 bp, Homo sapiens
gttaattttatgctgcttcagcacaaagaaaatttacctaaactgccattgctatagattaggtgtatgacacaccgcccccctttcaccgtttcaccccygaacatctgcttcttagagctaagtgattgtactcaacaaatagtgtggagaccagagcttggcgcctttgcagcctccattttacacttggccccctgg

SEQ ID NO: 11740 - DNA, 201 bp, Homo sapiens
agctgtgggccaggctgtgtcctatttgtgtctgcattcccagctctttgcacagcacatggcacagagcttaacctcaaaaatctctattgaacaagaastatggccacaagcacatggggagttttgagtttgtagggttccaagacatggtggagcttaaagggtatcctgtccaaggagtgcaaactgaggcccaag

SEQ ID NO: 11741 - DNA, 201 bp, Homo sapiens
tttaaaaaacaataaaaaaccaatataacaatagaaaataatacaaataaaaatacatataacagctatttgcatagcatgtacattgtgttaaatattayaagtaatttagagattagagtataggaggatgtacatagtttatatgcacataatataagacaccattttatataaggaacttaagcatctacaaatttt

SEQ ID NO: 11742 - DNA, 201 bp, Homo sapiens
taaagtggggcagttcttactaaactgacttagcacacttcttgctaaaaccagattttacaaggaagtgcacagatgagcctaggagaaggtagaggggyctgactaaagttttgatcaagtaaaaaagtctttatcaatcttggtatttcccgttaagcacaatgcttggaacataatagttgctcaacaaatgttggc

SEQ ID NO: 11743 - DNA, 201 bp, Homo sapiens
gaaagaagacacccattttcctcatagtaaaccaaaaatgatctaaaatattccatgtttgttaaaaagcaagatctttatggttactgttaggcactgcrgtatgcctccctggattgtcaataccaatgccatatagatagaacaaatagtttgaaaagacatgaggacaaaacagtctccctgtctcccaaataatag

SEQ ID NO: 11744 - DNA, 201 bp, Homo sapiens
ttaagttaatgaatgaaagatgtgaatgctcatgctaggagaaggggaaaagcattggtatttcccttaaagagaccataccagggtattttatttcctgyaagtggtttaattttgtacattgcttctctgctcacagaatgttctctgtctgtcataataaaggagagccttttcattgaaatagacctctgaatctgt

SEQ ID NO: 11745 - DNA, 201 bp, Homo sapiens
tgttccatgtgttctcattgttcaactcccacttatgagaacatgcagtgtttagtttctgttcctgtgttagtttgctgagaatgatggtttccagcttyatccatgtccctgcaaaggacatgaactcatccttttttatgcctgcatagtattccatgttgtatatgtgccacattttctttatcactggtcattaga

SEQ ID NO: 11746 - DNA, 201 bp, Homo sapiens
ggaatggctggtcctgtagttctttttaaggccaaattttcactgaccttgagatgatttaatgttacacggggattcgggaaccaagctgtagtaattaytggttttttggctttccctcctgtagcacatacataaatgggaataaactgggtgagttcctgaactctttccgcaaattaagaaagtcagaactttgga

SEQ ID NO: 11747 - DNA, 201 bp, Homo sapiens
caaccactttataaaaaatgtaaacaacaggtaatttcacattttaatttatttttatctaaacaatatattcacatagtttatttttagtgtatatatgyatatatatttatttcttatttatttcttatttatatatttatttatagagatgaggtcttactttatttcccaggttggtctcaaactcctgggctcaag

SEQ ID NO: 11748 - DNA, 201 bp, Homo sapiens
tacaagtgtgatttgaacctagactgactccagagcctgtatttgtgactgtgatgaaacatgcttcagagcagtcagaacggagggacagacgggccaamatggaagtgcatttgatgaggctgtgggaggaggctgagaccttcccagggaggacccctgcaggcattggcctccgctgcaatagtccctttcccatag

SEQ ID NO: 11749 - DNA, 201 bp, Homo sapiens
agttttgataatccttcatttccagtcactgctatggtctggctgaccttctgaatgtacccagtattggctggctttagatctatgatatgagctatttytttactcattaaagtgtttaaatttctgtgcttagtttctcagatgacttttttttctgtgtggaatctggttgatatttttggagaataatttaaatca

SEQ ID NO: 11750 - DNA, 201 bp, Homo sapiens
gagtagctaggattataggtatgcaccactacacccggctaatgttctatttttagtagacatggggtttctccatgttggtcaggctggtctcgaactcytgagctcaggtgatccgcctgcctcggcctcccaaagtgctgggattacaggcatgagccaccgagcccagctgcctggtgtacttttaattattcttga

SEQ ID NO: 11751 - DNA, 201 bp, Homo sapiens
catcaatatctggaacaacaccattcttcatgatattggttttgagagccacgtgggcagagaaataaattctagaaaaaaagaaatggtaatctgacatscagacttggattataaatatggtcaaaggtgtacttaaaaacaagatattttgcttcttggttagctttactgagaatccagggatcaagtaaaatcatt

SEQ ID NO: 11752 - DNA, 201 bp, Homo sapiens
cacaaatgtacagcccccccccccctcaacgaatgggagcgcttccccacacctcaccaatagagactgtggtcacacttttagaaatttgtccatctggkatgtgaaaatggaatttcagtgtagttttattttctttttcttatgatgagtgagattgtacatctgtttatatgtttaggaactttttagaaatcattt

SEQ ID NO: 11753 - DNA, 201 bp, Homo sapiens
agattgcgccattgcactccagcctgggcaacaagagcgaaactcatctcaaaaaaaaagatacttgccattggattcagagcccacctagataatccagratgatctcatctagacagcctttactaattccatcttgcaaagactcttttttcaaataatgacacattcatacattccatatcttttggggagacacta

SEQ ID NO: 11754 - DNA, 201 bp, Homo sapiens
catgtaaaagctgtgattgtcgaaaatgcatggattttagagtcagacctggattctatttttccataagtctcttattgtgtgaattctcttgtaattarttgtaagaatttgaatatacttctattataaaaatatttactgagcacctattctgtccatttaggtagcctggtttatgttgcagtgacaaaagcctca

SEQ ID NO: 11755 - DNA, 201 bp, Homo sapiens
attagctggatgtggtggcgcacacctgtaactccagctactcaggaggctgaggcatgataattgcttgaacctggaaggtggaagttgtagtgagccgrgattgtgccactgcactccagcctgggtgacagaatgaaactctgtctcaaaaaaaaaaaaaaaaaaaagttatgtctgaactgaccagaagacagagtt

SEQ ID NO: 11756 - DNA, 201 bp, Homo sapiens
ggacatcgaaatcatcctggccaacatggtgaaaccccatctctactaaaaatacaaaaattagctgagtgtggtggcaggcacctgtaatcccagctacytgggaggctgaggcaggagaatcatttgaacccagaggtggaggttgcagtgagccgagatcacgccactgcactccagcctgggtgacagagtgagact

SEQ ID NO: 11757 - DNA, 201 bp, Homo sapiens
ggaatacacagtaaaaataaagtaaatataattcccaatgacattgctatatataataatttgacaaatccattaaactaatacttactgagtgcttactrtgtgtcacacagtattgggcaatggagatacagtgataagagaagttttgtaatttcacagtgcctaatttttttaggccaggaaaaagactataaacaa

SEQ ID NO: 11758 - DNA, 201 bp, Homo sapiens
agatggtatatataaaatgaatgacacataataaatattggtttcctttttttgcagggtagaaactcaggtgcttatctcatttatgctgtccccccccyccccccagctatcttattccttatctgatgaattatctcaagtgtatcaaactagttgacatggtcaccacatcctttactcattctcttttgctaatta

SEQ ID NO: 11759 - DNA, 201 bp, Homo sapiens
tacagaatataataaattactatccttgttaattcttttatcaaagatatgtactaggcttctgcttccacatgggccatttgaaaaacagtgcttcataygatccctgaactttttggcaattataaagagagatcacaaatgagtaaggttgaaaattaaactataactggaatgaaatgtcctataggactaaaccta

SEQ ID NO: 11760 - DNA, 201 bp, Homo sapiens
ctcctgtctcagcctcttgagtagttgggactacaggcacacaccattatgcccagttaacttttttctttctatagaaatggaggtctcactatgttgcycagggtggtcttgaattcctctttctagttttctctgacactctcactccctgccaatcttttctcctcaaagaagccagaatggtattttttaaaaaat

SEQ ID NO: 11761 - DNA, 201 bp, Homo sapiens
tgcataaaatattttaggggaaaaatattaattaataacaggtaagactgggatacactatttgtttttgaatcatcatagcatcctggaaaggggtcctrttattattattaccattttagagatgaggaaacgaagtctgagtggttaagtaacacactccagtgttgcacagctagtaggtggcagaaccaacatttg

SEQ ID NO: 11762 - DNA, 201 bp, Homo sapiens
aaagtctagaagtctcaaaacaaggtgtcagcagagccatgctcccccctgcaatctgcaggggaataatttcctcttcctagtgtctggtggtttgcccmgcaatctttggccttttttggcttgtagttgcttaactccaacctctttcttcctcatcacatggtgttctccctgtgtgcccctttcttcatatggcta

SEQ ID NO: 11763 - DNA, 201 bp, Homo sapiens
atttgttgaataaatgcacagtgcataaatttagcttttactacaaatgtactacactcttcttatttttctttctttctttcttttttttttttttttgktgtttttgagacggagtctcattctgtcacccaggctggagtgcagtggcgcgatcttggctcacggcaagctccgcctcctgggttcacgccattctcc

SEQ ID NO: 11764 - DNA, 201 bp, Homo sapiens
tctggatatccttgtcttgatctgtaaaatgaggatagtaatccctgctaatccaaatgcacactactgtagagaccttcttgtaaatgtagcatagaacrcacattattgctttgggtagcaaggtaaacatcttgctgtacatctttattccattaaggaagatgtacggaaaagcactctgtgggtttggagataaga

SEQ ID NO: 11765 - DNA, 201 bp, Homo sapiens
attcaacagcaagtactatctgtaagaactttgatttcattgcatttaagcttcttttcctagtggactgtttttagttgaatacttcttgaggataagtkttgtgtcttctatacttatatctgcagcttagcacagttcctgccctatggtacatgttccttatatgtacatggaaattagccaaatgtcaggatgcca

SEQ ID NO: 11766 - DNA, 201 bp, Homo sapiens
gttctggtttaaaccccttgtggcattttctactgcatggatagtggtaaatggggttgatagtgacatagaaatgaacttagaagtaagtttatagactrttggggaccatctgttaatgtaaatgtttaaggtaaaatgcattaaggcttaagagctgacgagacgttttatttgcctcctgcttttgggattatgcct

SEQ ID NO: 11767 - DNA, 201 bp, Homo sapiens
aggaaagtgactgggatcccctgcctgcactgactttaacaataaagatactggaataatgagatcccatggaatttagcaaaatacgagtagaaacaagyggtaaagacagcccagactgtagttcaaagtctaagaacatctaagctgcgggttcaggtataaaattagggccctgtggcttatctcaagacagtaact

SEQ ID NO: 11768 - DNA, 201 bp, Homo sapiens
ctagtaacaagtttcctgggcaatactgctttgttatcagacttcaccatgtagatctcacatccttctcttttctgatcttgctcttatcatttcaaagytacatgtagagtgaggatgcaggtttcatagggtttttgtttttatctgagacagagtcttgctttgtcacccaggctggaatgcagtagtgtgagcatg

SEQ ID NO: 11769 - DNA, 201 bp, Homo sapiens
aagcatggcttttcctgtttcccatagattatagaatatgagtgcttttacatttttattgttctaggaaacctgcaaaatggcctgtattacattcgacmcaagaattaagagagagttttaaaatttctgattggaatgggattctgtttccgatcttgttgttaacatctagttattacactgtgatcagaaaatgtg

SEQ ID NO: 11770 - DNA, 201 bp, Homo sapiens
ctctgtggctgtgcatggacacagactcttctgcccttctcttgcctgttccttgattcctcatgtttctgtctggtgcctacctgagatccaggtattcytctttacctcgtcgtcttgctattttttctagggacttttcttctcccaaagttatgttgaaacaggcaaaacacctagaaatgggtcatgtgggtgagt

SEQ ID NO: 11771 - DNA, 201 bp, Homo sapiens
ataggaatttatctctcatgattttgttaaccagaaaatagaatattatgcccaatgaagatttataggaaatgatacgtttggtgactagaaatgatacrtttggtgactagtagttcatttttacaagtatgcaatgaatccaagtctcttaactgaaatttaatttcagctaatttaattatcagacctggtttttaa

SEQ ID NO: 11772 - DNA, 201 bp, Homo sapiens
caatgtaaatgctatgtaaatgcctgttatactatgttttaaaatttgtatattttgttgtattatttatatttttgttttttgaatctacggtttatatraatatcattctctctccctctgcatctatctgtatctacatatgtatatttgtttttttcttagaacataacctagattcctctacagtgtaaatccctt

SEQ ID NO: 11773 - DNA, 201 bp, Homo sapiens
attcttttacatgaatgaattttaaaatatataattttgaaataggcaattcattattaactctagtcaccatgctgtgtaatagatcagaatctacttcycctgtctgaaactttgtagtcttcaaccaacatctcctcattccccattgacctttcctttctcagcctctgataaccaccactctactctctatttctg

SEQ ID NO: 11774 - DNA, 201 bp, Homo sapiens
tgcctgaatgtctagatctgctggaggaattgcaacatgctcaacttcagtagtttagtagaaagggcttctctatccctggctcagatgactctgcctcmtttgagatccctctaatattagtaatcaccattctcatcatcatcatagtagtggtagtaatagtcgtgatatagctatcatttctgcagtagttactat

SEQ ID NO: 11775 - DNA, 201 bp, Homo sapiens
actgcaacttctgcctcccgggttcaagcaattctcctgcctcagcctcctgagcacctgcgattacaggtgtgcaccaccatgcctggctaatttttgtrtttttagtagagaaggggtttcaccatgttggccaggctggtctggaactcctgacctcaagtgatcagcccatcttggcctcccaaagtgctgggatta

SEQ ID NO: 11776 - DNA, 201 bp, Homo sapiens
ctgaaaggtgtttgtttgtttgtttttttcctttggtctgacaatttatttttggaggagaagggagctgggagggcctaatatatatgcccaggccaagrgaattttggtgagacattccctttcttcccagcagagaatgatttatttatttgatatgtcagttaggatgctttcagctgcaaagaacagaactttcaa

SEQ ID NO: 11777 - DNA, 201 bp, Homo sapiens
ttatctgataccactcaggctggcaagttgagaccccattatagcctaacaagtgtgagggtctaggttcctcagttgttcttcactggactgggtagatrtgggaccacactctttctgtgatgtttggctggagtatggaaattgctttgtgaaagttttttgtcttcctggttctttgactagagatagcaggccttc

SEQ ID NO: 11778 - DNA, 201 bp, Homo sapiens
gtccaactggtgcccctcatgatgggaagagacagaacactgcgaattagcacagtgaaagttaggagctgtgaagaccctagggggcagaggaggtacargcattaatattatggtgctgagaagttaatatctttctttttaaaaaatagctcggcatagaagctgtcagtagggctttctccccggtcagatttatga

SEQ ID NO: 11779 - DNA, 201 bp, Homo sapiens
gtactcttactcaggtgctattcctaggaaaacaaacttaaaaacaaaatcgttcattcttggtggtctggaagactgtatttattctgaaggctgaaacwtctcaagggtgacaggaggataatttctaagctaacagtcctttgctgaacatgaggcaagatcataaacttcctcaaagcagtctccaagtcacacata

SEQ ID NO: 11780 - DNA, 201 bp, Homo sapiens
tctgtttttattctcgggcccacagatattccatggagccaaagggaagtcagaagataacaatgaaacccagggtcttctaagagcagaatgaagctagyggtactcttaggaacagttctatagatgtgggttgtagcttgttgcccatgggaatcacacttgcttttaagttccatcaatattaagaagggatgattt

SEQ ID NO: 11781 - DNA, 201 bp, Homo sapiens
ttaaaaattcagatttacttctggcaaattcattcaggaattcaaactcagataattaaattaatttcttaatattcaaataaagaccagatacacattgrtatcatctctcttgtatattcagagtaccagataaatgggatttttcactagggggacaggattgctacactacaccattgccatttgcattcacaacac

SEQ ID NO: 11782 - DNA, 201 bp, Homo sapiens
ggtgagccaccatggttgctaggcaatagagcgggttgatagagcacggtattaaactgaacccacattggtgttttacttaacatctatttgcttagcayctttgtcatctgtggtgtcatagaagggaaaggaggaggagacaggcagagtctggttatctgcagagactcaaacaagtaggagaaataatcatcccaa

SEQ ID NO: 11783 - DNA, 201 bp, Homo sapiens
gaaaattataagatagtgtatgtctaggtcatgatctttagtatcatcaataaaaccactaaggatgcctcactatagctgtgagatgggttcggaccatkatatccagtttaatactatttgggagcagaagtaactagatatatttatcctatgatattttacacttattggacacctgttgaatctctgttggcttga

SEQ ID NO: 11784 - DNA, 201 bp, Homo sapiens
gttgtgttttaaagttcagctggaagatacccttattcctaagaaatccactaaagaaaactgttcttccaggagttccatttcattctctgggaagggtycatcccttgttcctgttccctttcctctgaattctataggacatatcacagcaccttcttgctgcctccttgtttgtgtctttcattaaactgtaagctc

SEQ ID NO: 11785 - DNA, 201 bp, Homo sapiens
catttcctctgcctgcaacagcccttccctgctattcacagtactcactccctcacttcacccaggtttccgcttatattgcaccttccagaaaggacctycttgaccgtctgtaaaatacaacactctatcgccttttcctgttttgttacctctcatagcacttatcactgcctgacattatagctcacatttatttgt

SEQ ID NO: 11786 - DNA, 201 bp, Homo sapiens
cttttccaaagttatgcaccacgtttgatgcagagacaaaactagaatcaaggtttcctggctgccagggtagggctctttctactccatcatgctgcctsgtgggctgtgggcccttttccaagggtattgcagctgctgctgtgggggctgcctggggtgccttcttagttctctttcttcagaggggagtgaggtctt

SEQ ID NO: 11787 - DNA, 201 bp, Homo sapiens
aaaaaaattagccaggcaaagtggtgcatgcctgtggtgccagctacttgggaagctgaggtgggaggatcgcttgaacccaggagataaaggctgcagtragctgaaatcacaccactgtactctagcctgggcaacagagtgagacccatctcagaaaaaaaaagaaaaaaaccaatcatgggataataagtttaaagg

SEQ ID NO: 11788 - DNA, 201 bp, Homo sapiens
aatgccttcttcagttcagtatctcatgaaagaaatgcaaggtgaagagaaagcttaaatgaaaaaaataaagtgaaatctgtaagcctggttctcatttytaagggtttattatactggagatttcatgaaaatagtattgagaatgactactctgtgatttttgctagcttttagtccctataggcagaaaagcatttc

SEQ ID NO: 11789 - DNA, 201 bp, Homo sapiens
ttcattcattcatattaactgttacttcatgctccatactttttttttttttttgtagagacagggtttcactgtgttgcccaggctagtcttgaactccygggctcaagcaattgactcagcttccctaagtgattggagctaaaattatctcccaccacacccagctactccagtatattttcatccacagttgtgcca

SEQ ID NO: 11790 - DNA, 201 bp, Homo sapiens
ttatgcttttcatctgtccaagctcttcagctgagctttcctcactgatgacagcactatctggagtgaaggaggtgcagatcctgagatggactgcacamcccttggggctggatggacagactactcttcgagtgagataagggatgcaagtgtaaagggcgagtatgttgcctcactcaatcacatgttcaccaccct

SEQ ID NO: 11791 - DNA, 201 bp, Homo sapiens
gctttcctattcaagtgagtttttcttatgtccagctagaatcccctttgggttaatataagtctttagtgtacgaatttgaatctttgcctgaggtgctrcactgttggttctcttaaaaatttgtggcattatttaattcagtaaaatttgtgtggattgatttgtatcctttgaatagttagtattatataaatatct

SEQ ID NO: 11792 - DNA, 201 bp, Homo sapiens
ttttctgctgacaaaagaaagggaaaggaaaaaaatcagataataattccctttacaggcctaatttgaacttaattctctctctctctctctctctctcwcacacacacacacacagacacacacacacacacacacgacaactgtgagctgtaaatccatggtcatctagttactagcgcagtaagagcagttgtctga

SEQ ID NO: 11793 - DNA, 201 bp, Homo sapiens
acacatggacgggctttagggctcagttgctaaagagatagaagtaaaatattatagaaaatgcttatagtacatgttaagtgagaaaggtaaggtaaaartggtttatgacctataactgtgtgaaaactaaccaaagagacacgtatcatttaaaaagatttaatgttgtgcctgtaatcccagcactttgggaggcca

SEQ ID NO: 11794 - DNA, 201 bp, Homo sapiens
gcagaggaggtacaggcattaatattatggtgctgagaagttaatatctttctttttaaaaaatagctcggcatagaagctgtcagtagggctttctcccyggtcagatttatgacttctgaatgacattgttttactttgccatttggaggataaacaaagctggagagaacaaaagttttattttcctatcagtgacaa

SEQ ID NO: 11795 - DNA, 201 bp, Homo sapiens
agagcatatatgatgatgtcatctcaaggggagcccaggatttcaggtcacctatgtataaagtgagaaataaaggctggctaggagtcagccatgggaargggatagaataagttgaacattcatggtaaagagaatactatattcaagatcctaaagcataatatgtttggaaaacagaaaatacagtatggccagaag

SEQ ID NO: 11796 - DNA, 201 bp, Homo sapiens
agagccttggttttgtgagcccataaatgccaggaagcctccaagatttctagctttgtgaagtttacagaccattcatttccgcagtctcctgttgtcayctctaggggaattgcagtgtgtccatccacccttgaggcatggcaaggtgaacatcccttggactgaagactgaatgcttggttttgttcccatacttaa

SEQ ID NO: 11797 - DNA, 201 bp, Homo sapiens
tagattcaacttaatgaaaacaaaaattcagctcatcaaaatatatacctaagaaaattaaagggtaaattttaaaatttttgttccccagacatagactsggagaaaatattttcaggatatatatctaaaaaaggacctgtattcacaacatatgaggatctcctgcaaatcaaaaataaacacaaacaataaaaatag

SEQ ID NO: 11798 - DNA, 201 bp, Homo sapiens
tcagttgttttatagacaagtttctagtttgagggagctatttagaaatgtatgtagccttatgtagaaattccaataaagctttcaaaaaataaagctgrtatttatattggttgaaatggcaagataatgagtctaaaagattttcccttctgatgttattttttttgttgttcagaatgacacttgaaagatgcctaa

SEQ ID NO: 11799 - DNA, 201 bp, Homo sapiens
atatcttgtatcttcatataaaagcagttacggcagccctctgcactgtattttcatagggttctgtttttatcttacttaactgtaaggtccttgagggyaaaaacagtcaagtctttctcattcatcctttgcaaacccagcaccctgattcccaacagagtagaactcagcacatatttgatgaattagattgaattt

SEQ ID NO: 11800 - DNA, 201 bp, Homo sapiens
aaagctgggattgctttttggctagtataatatttccagaatccctgaggcttgcttttaaatcagcataagctggttttgtgtctcacttttgtgttgtrcaattacagaaagcagcaaatacttatcttggcatgtcctgtcatgacatgagccaaaagctgtcatcctcatagattccctgtctaagggaatagttgc

SEQ ID NO: 11801 - DNA, 201 bp, Homo sapiens
gagccaccatgcctggcctcaatgttgtgttttaaagttcagctggaagatacccttattcctaagaaatccactaaagaaaactgttcttccaggagttscatttcattctctgggaagggtccatcccttgttcctgttccctttcctctgaattctataggacatatcacagcaccttcttgctgcctccttgtttgt

SEQ ID NO: 11802 - DNA, 201 bp, Homo sapiens
cgctctactgcttccagcctgtcatgtcaagcagcattgcctttattattgaaatgaagacgatacttagatcattgatctcaatggcatttggcaccatragaactaccagtctgttgtatcatataaaatgatactgcctggtatgcaaatcagccagtgtgtcaacaaaaatgctggcatcagatagaatgtccaaat

SEQ ID NO: 11803 - DNA, 201 bp, Homo sapiens
aactagcaaatgaggcatggggcaaataactcattctcatgcacatgtttctaaaacagttcttactaatgtttgagataaattaaaataaacaccaacargaacatgaaaagagactaagaacaatgttaatgcggcaacttaaacaaatttggttttccaaatgaccttccatctttcacaacttttaacagcatgcaa

SEQ ID NO: 11804 - DNA, 201 bp, Homo sapiens
aaggtggtggcagggaatggaaaagggaagattatttagtcgataaacacttaatggccactgcctgctgtgtggacagatctggatagagttaaaaagayaataaagcaagtgtaggatgcctgtcttcatggtacttatatcatgggaagaaggcatgaacaaaccaattttacacataattattcaatcacaatcatg

SEQ ID NO: 11805 - DNA, 201 bp, Homo sapiens
ctctcaggatgagaagagaaaatcctgaactgacttgatattatgtaattattatataattaaaagtgtgcttaatacatcctttatggattaaatcagaktaatcacaatggttctccaatatctcaggcaaaattcctgggtctagctactcccctcatccttgtcatgcaaagaaccttccccagacttcagtgggag

SEQ ID NO: 11806 - DNA, 201 bp, Homo sapiens
tcgaactcctgacctcaagtgatctgcctgctttggcctcccaaagtgctgggtttacaggcgtgagcaactgtgcccggctagatctctaaaatcatagygtgagtaaggtgaacagaaaaatagtaatgatgataatggtcatggctaacatttactgaatgcttgttatctaccagtctgtgctgggagcctattgca

SEQ ID NO: 11807 - DNA, 201 bp, Homo sapiens
agcttaatggggatggcattgaatctataaattactttgggcagtatggccattttcacgatattgattcttcctatccatgagcatggaatgtacttccrtttgtttgtatcctcttttatttcattgagcagtggtttgtagttctccttgaagaggtacttcacatcccttgtaagttggattcctaggtactttatt

SEQ ID NO: 11808 - DNA, 201 bp, Homo sapiens
aactctttgggaggccgaggcgggcagatcatgaggtcaggagaccgagaccatcctgaccaacatggagaaaccgtatctctactaaaatacaaaaaagyagccaggtgtggtggcatgcacttgtagtatcagctactcaggaggctgaggcagaggaatcacttaaaccctgcccagaggcagaggttgcagtgagcc

SEQ ID NO: 11809 - DNA, 201 bp, Homo sapiens
tccattttctcaggaggtctaactcattacagttccatttaacccaatcaaaaccaatgctcccctttccctcacatctttaccgcattcttttaaagaarcatacgcacaactctttgagcaagaaatatcaggcaaccgctgccatcttagctaaaaaatcttttatgtttgagaacttacctggaagagtcctctgga

SEQ ID NO: 11810 - DNA, 201 bp, Homo sapiens
attgtaactggtgtgagatggtatctcattgtggttttgatttgcatttctctgttggccagtgatggtgagcattttttcatgtgttttttggctgcatmaatgtcttcttttgagaagtgtctgttcatgtcctttgcccactttttgatgggattgtttgtttttttcttgtaaatttgtttgagttcattgtagatt

SEQ ID NO: 11811 - DNA, 201 bp, Homo sapiens
gctaaattatttttcttaggtaaacataggaggcaagagattaaaagggtgggagaaacattaattaggctatgctcttatcaagtagtgtgaccttagcraatttacctaatctttttgaacctcagtgtcctcatttataaaatggaggcataactttttatgaagattaagataatgtgtgaacaatctgtgcagtag

SEQ ID NO: 11812 - DNA, 201 bp, Homo sapiens
accctgtcaaaactctcaggagttcgagaccagcctggcaaacatggtgaaaccccgtctctactaaaaatacaaaaattagccgggcatggtggcagaascctgtaatcctagctactcgggaggctgaggcaggagaatcatttgaaccggggtggcagaggttgcagtgagctgagatggagccactgcactccagcc

SEQ ID NO: 11813 - DNA, 201 bp, Homo sapiens
tccaggatacatgtgcaggatgtgaaggtttatttcgtaggtaaatgcgttccatggtggtttgcagtacctatcaacccatcacctaagtattaagcccygcatgcattaactatttatcctgatgctctctctccttctactccccagcaggccccagtgagttttgttcccctctctgtgtccatgtgttctcattgt

SEQ ID NO: 11814 - DNA, 201 bp, Homo sapiens
agtactaccgtgtagggtgacatagacctactggtgaggttaattcaggataaagaaataaagagatacaatatgtaagaaggacaggcactccatttacstatagttaaaaatgacaaacaacaaaatagctaaataccatttttttaattcaacaccaaagacagacacagattccattctagagcaagatttgaagat

SEQ ID NO: 11815 - DNA, 201 bp, Homo sapiens
ctagaatcaaggatcagagaagcatcaacacatgcatcaacctttctccaattttccttccctttcccaactccctcagccttaccctctcctctcaggamctgcattattgcatctcttcttttggatttggtaattctttccttagaaagaggaacagggctaaggataggcaacaggggcccagctgtccatgtctcc

SEQ ID NO: 11816 - DNA, 201 bp, Homo sapiens
ccaaaatagggataataatagttcctacatcatagaggttttgtaaggattaaatgacttcacgtgtaccatacttggcatagcgcgttgcccagagcaastgtattatgagtgtttgctgttgctgctgtgttgtaaggtgtgtgtgctggaagaactgtgtagcagcctttccactggctttccaaaatcacaaaagga

SEQ ID NO: 11817 - DNA, 201 bp, Homo sapiens
cctactattcattttttcattcatttgtttatttcattcaacccacactgagagactattttgtgccaggtatgagcctatgtgcaaagtatgtgcaagtrttcacagaattgtgtgtaagacaattgaatgagttttgggcaggagaagatactagatgcatatctcaattctatttctaaagatgtattaaaagaaaat

SEQ ID NO: 11818 - DNA, 201 bp, Homo sapiens
gtatctagggttatgtagagtcacaaagtaaatataatacatttttttctgaagctaattttaattgttaatatggagtaaaagtttaaattgaaaccaarttgatatattatgcagaagaatgcaaataagcataaatctttaagaaaaaaacataagaattcaaagacatttcatttttattgtgaatcttctctattt

SEQ ID NO: 11819 - DNA, 201 bp, Homo sapiens
gtatacatgtgccgtgctggtgcgctgcacccactaactcgtcatctagcattaggtatatctcccaatgctatccctcccccccgccccaccccacgacmgtccccagagtgtgatgttccccttcctgtgtccatgtgttctcattgttcaattcccacctatgagtgagaatatgcggtgtttggttttttgttcttg

SEQ ID NO: 11820 - DNA, 201 bp, Homo sapiens
tcctaagatagaactccaactctttgccctctagcacatagccatctgctcggccacatccacacagttctctcactctttcaaaatgtcagcaccagttycagaaggagggactggcccttgtgatggccataatgtaaagtgttcacacgaccaggtagcatttccattcttagaaagctacgcttcttagaaagctac

SEQ ID NO: 11821 - DNA, 201 bp, Homo sapiens
taccaggttggaaatcattctgttatcagctacctgccaacctgacatattcttcctatcactttccccacctcttttgctgattgcagaggggctctttrgagcactttgaaaagccacctgattaaagccttcattaggctagaagcagaagtgcttcacaggccaggcaagaaatactttgtaattgcttctgacggg

SEQ ID NO: 11822 - DNA, 201 bp, Homo sapiens
taatttgttgtactttatattttcagctatccttgagaatggtttctgcttcttacattctcaatgatagacaagtctgacacatggagtttactttaaasggttaggcaatcccatgggttgtggcccatagggtgataacaatagaatttccttttgtctgaccttaaaaaaggatatcagataaatactgcttccttg

SEQ ID NO: 11823 - DNA, 201 bp, Homo sapiens
aataagtcatcaatagttaatgataaggaatcagtctgctgtgccatattggtagatgaaatgctgctactcctcctattcctgggcttttctgccccccmcccccttccttccctccttcctctgtccctccaactcttcttcacatctcccaactcccccaattcacttcttttccactgcatgccatgttaccctatg

SEQ ID NO: 11824 - DNA, 201 bp, Homo sapiens
aggcactcatgtgaaagatcagcactcacatttaggaattggatacagctaacagcaggggaattgataggctcatgaaaagagcatgggtagaggatgayatagaaaattaagcacagttagggaagacttaccagccaggttacaagaagcaaacacctatcccaccgattcagaataccttgcctcactcctgcatga

SEQ ID NO: 11825 - DNA, 201 bp, Homo sapiens
tgattttttaaaaattaaatgcccattaagaaaattatccacattcatgttcccttggatgctttcaaatattttattttcctttgcttttggcagttacratctatcagtgttatttgtaaaatgtcttatatttgtatagggtatgttctccctttcctcttttcttcttttctttttaaactaagatagatgtgttat

SEQ ID NO: 11826 - DNA, 201 bp, Homo sapiens
taggttcagtcaactcatttaagttcgcttttccaggagtcactggggaccaggaatgagtcctggtgcatggtaatcccatgcagagttcccagccatcyctctgtcagcccagcacctgtgtcttcccacatccactgtcaatgccttccctctgagatttgctcagagtgcgcctgtcttcgcaatgtccccatctct

SEQ ID NO: 11827 - DNA, 201 bp, Homo sapiens
gtatattaaaatcacagtgatgtatcattttataccaactaaaatagttaaaatttaaaagacggacaacaccaaatattggtgagcattagaactactgraattgtcatactttgcacatgggaatgtaagatgataaaaccactttggaaaaattgcagtttttaatatagttaaacataaatctaaactaagacttcg

SEQ ID NO: 11828 - DNA, 201 bp, Homo sapiens
tcagagtcagtctctctctctctctctctctcataaaggggttgagccttgcacaggttaaacatgaccctttatttagtttatttcttcaacgattggtwgctcagtctcctttaaatctttttgactggtccccagtctagtttctcattaacctacatctgataaggttcagtgtgatggaaaataagaagaaagtaa

SEQ ID NO: 11829 - DNA, 201 bp, Homo sapiens
gttggctctatgctgacccaaaatgaagtcttttaagagattagagtactacactgtctacatttaaccaggtgtcatataacaattaatgaaaattcaaygttttatacttagaatttttaagtaataacagatgatggatcaagattaaaactgtattgacagcctaagcaaagaaataaaatctaacaaaagaagctt

SEQ ID NO: 11830 - DNA, 201 bp, Homo sapiens
aaaaaaaaaattatgatagtgctagtcaatactgagttgactgtcaaaaataagcacactttacattagccagttacttctgggacactgttgaagagtaygtcacatgtacccacaaattagtcaaacatctttaggcatcacatgatatctaaattagtctttttctccttctccatcccctggttgtccatgaaatat

SEQ ID NO: 11831 - DNA, 201 bp, Homo sapiens
caattatttctctatggcttcataaagaaaatgtcaatccaaggctgaggatttatttatgaaaatctaaagacagccggttttcctgatggttcatgccrtgggggaacgggtctctttcccaatatataagaggacaaatcttgggatgggttttttttttttttggtcttttatgacattctttaatgatttctcctg

SEQ ID NO: 11832 - DNA, 201 bp, Homo sapiens
aggcatgagggtcgtgggcagtgacacacacacacccttagaaatgaataccagttctttaagagaaagcagaaaagtcatattaccatttctgaattccytgagaaataagaagaataaaatggacaataatattagctatgggcatgaaaagtacaaaaagaacccataatcaggttcatttatatatgcatgcatatt

SEQ ID NO: 11833 - DNA, 201 bp, Homo sapiens
gggcagcggttataactgatgttagaattttcctgtatagcttctagctgttagaaaataaaccattgtttttcaatgaaaaacagtctctaagaagataygtattctttgttgttgttgttgttgagccagtgtaagctactcttgtctcaacacctaaagggagctcttaacatttgtagagatttcattgagttatat

SEQ ID NO: 11834 - DNA, 201 bp, Homo sapiens
aggtgtctgctggtctagtacagtaagtgtgaatctttggcaaatctgcacagatcattttgctcaatagtttcaaactctgagcaccagaatagaggctyaggtttagagcacatactacaagatcatcttgagaatctcaaaaaggtatttttttaaatttcatagtaaaattatcacataggccagagatgacactgc

SEQ ID NO: 11835 - DNA, 201 bp, Homo sapiens
tatgtattctccaatttaatgaacaacgttagctttgtctttcacacatctgcttatcttctctagcttcatgtggttgaaagcagaagatatgacatacrtagcatggaaaatgtgatgtgggtgaaaggaggtttctttctttttattctcagaaatgtctttttcacaatgaaaccagcaatatttattgtttttcct

SEQ ID NO: 11836 - DNA, 201 bp, Homo sapiens
tttaatcttgccaacgtggaggtctttggcctctaagtgcacaggaatatggtgagtgacactgggacttataactggagaagatggcagaattcatcttygttgcctgcagctttccaatcctgagcccttttccactttcatcgtgtttccatctccatcattcctttcattcagggttttcatgatcttattctatca

SEQ ID NO: 11837 - DNA, 201 bp, Homo sapiens
gtgctggtctctcatgccaggtccccttctcttatttgcaaactgtctctgtttgatattaaaatttgtaatggggaaacactcactggtttctaaaaccstatgtagatttaagtagttgatgattctgtgaaaaaaccaaataccttctagagaaaacatacaggttgggcagagcccaggtattgatgtccttgatga

SEQ ID NO: 11838 - DNA, 201 bp, Homo sapiens
tgcgggctttgggataatgtgtttgttgttgctttttttcttctttaaaaaaaatactcattttattttaccctgtcttgcttgctgtctcttgttgctawctctcatgctatcacttaatttcttctctggattttcttttgggttgtcctctttcttccttactcattttcctccctcttccccatctccgttccgttt

SEQ ID NO: 11839 - DNA, 201 bp, Homo sapiens
taaataatatataacttataaataaatatataaagttatgattttatagtttattaaatccagagtttttcttttgttgtagccctgcctcttaggcttgrcaattggcttagaagttatcctcaagagagaatctttctttttcttttcttttctttttttttttttttttttgagatggagtctcactctgtcacccag

SEQ ID NO: 11840 - DNA, 201 bp, Homo sapiens
tggaatgggtaaattatttctacttgatagactaggaaagtgagtcacaaaaaggctcgcccagagctactggttattagttgtgtgtttttctctcctaytccacactcgagaaaaccccgaagaatagggggtggttaatggtaaaaagaaatctagaagaagagttctggaaatgaaagacagctaggttttgagttt

SEQ ID NO: 11841 - DNA, 201 bp, Homo sapiens
gaatctataaccttccccaactatttccttcctgacttaaaatgtagattgttacatacacgaggatgaggggcagacaaagaactgctgtccagactgayccccatttcacggtggcaaagtgttctccttccaaaaactggaactttgaaaacagattgataatattctatcagtgtcatatttggggaaactggatat

SEQ ID NO: 11842 - DNA, 201 bp, Homo sapiens
gctgggattacaggtgcccgccaccacacctggctaatttttgtattttttgtagagaccgggttttgccatgttggccaggatggtcttgaactcttgasctcaagtgatccgcccacctcagcatcccaaagtgttgggcttacaggcgtgagccactgtgcctggccaacagaacatattttaatgtctgaaaaaaaa

SEQ ID NO: 11843 - DNA, 201 bp, Homo sapiens
ggtttgttcagcttttagagtagccctgtataagaatacttatatttagaaggttgtttgcgcttcagtcaaactagcaaatgaggcatggggcaaataaytcattctcatgcacatgtttctaaaacagttcttactaatgtttgagataaattaaaataaacaccaacaagaacatgaaaagagactaagaacaatgtt

SEQ ID NO: 11844 - DNA, 201 bp, Homo sapiens
ctttgtaggattttgcagattaagccttagcactcattttgtgaggacagtgaatcctaattcctcttcttcattctttctgtgacctttttgattttgcytctttagtaatctcctcactgcccttgtaatgcaaaaaataagaataaaaatggtctgtttgggtgctgtgagtcttggcaattaaaacttcacatgaaa

SEQ ID NO: 11845 - DNA, 201 bp, Homo sapiens
ttctcctgtccttctgattcctaaaactcaaaaccagaatgaagtaaggctacaaaatgtcatttatggggatgggtgaggcttaagtctcctggaaccaycttgggtcactcagctctacggaagacccccccaagacggtctagacccagagtcattctcagtcacacagtagttaagaattcttcatcctacggtatg

SEQ ID NO: 11846 - DNA, 201 bp, Homo sapiens
acatattagaaactgatagaaaacttctgatgtatcagtaagatgataattacccttgtaacatttctggaagcatgtatgtatgtatgtatgtatgtatstatttaaacgaatgcttgtatatctagcatctctttcaattgactcaatacccaaggaattttatctccattttacaaataagagagattatgacttatt

SEQ ID NO: 11847 - DNA, 201 bp, Homo sapiens
ccttcacccaccagcgcagtactgccatttcttctttcccctggaattctctatgtttagtgagcgagtttaagaatggaggatgctcagggatcttcttytcttatatagagactgggataatttgagtgttccatgttctgacacaggtggcatggatgaaggggtgtcactgaagaagctttggcaaaagctgattta

SEQ ID NO: 11848 - DNA, 201 bp, Homo sapiens
gtagtaccagctacttgggaggctgaggcaggagaattgcttgaacccaggatgcagaggttgcagtgagccgagatcatgccactgcactccagcctggygacagagcaagattccatttaaaaaaaaaaaaaaaaaagaaaaaaaaagaaaaaaaggctggaaattctcttatttgcaacaacatggatgaacccggag

SEQ ID NO: 11849 - DNA, 201 bp, Homo sapiens
tagacatggtcccagctctagtagagcctgtgatctggtggagaaacaggcactaaatcaatagctacaagagtgatgaatgttacaaaagaagagattcmagatgctacaggtacatagagcaggaggatttaacctaatctaggggatttggggagttttcatttaactctgctgttgtctaactgaatgaccctgagc

SEQ ID NO: 11850 - DNA, 201 bp, Homo sapiens
caaggcagcttttggacccaattatgcatgcctctgaaacacatgttctgcaccacaccattttttctgttatgtttgagagataaaaagttgtccgtctrtctacctctccaggctaatgtctcaccacattcaatcaaacttctccttccccaggccaggattcatgcagtccctacctgtaatgtgctttttcatatt

SEQ ID NO: 11851 - DNA, 201 bp, Homo sapiens
caggatcttgctaggttgcccaggctggtctcaaactactgacctcaaatgatcttcctgcctcagcctcccaaagtgctatgattataggcctgagccaycttttcattatctttcttcagatctcaaattatttgtcactcactggaagtgtacagctaatctgaagtggccttccacagttcccatctcgctcattac

SEQ ID NO: 11852 - DNA, 201 bp, Homo sapiens
agaaaattaaagggtaaattttaaaatttttgttccccagacatagactgggagaaaatattttcaggatatatatctaaaaaaggacctgtattcacaayatatgaggatctcctgcaaatcaaaaataaacacaaacaataaaaataggcactttataaaaaagatatgtgaatggtcaatagtcccatgcaaagatat

SEQ ID NO: 11853 - DNA, 201 bp, Homo sapiens
caaggaaccttaccaagtagatgacatttctcacttgttcctctcacttgttcctctcacttcctgttgtagtatcatcttctatttattctccttatcaycagcagatcaaaacaatgagggcattgatctatcataagaaggctgccttcaggccctattcttttttttttttttttttgagatggagtctcactctgt

SEQ ID NO: 11854 - DNA, 201 bp, Homo sapiens
cctgactagaacttccaatactatgttgaataagagtggtgaggaaaggcatcgttgtcttgtgccagttttcagggggaatgtttccagcttttgccctkcagtatgatattgactgtgggtttgtcatatatgactcttactattttgagatatgtttcttcaatagctagtttattgagaattttaaacatgaaggga

SEQ ID NO: 11855 - DNA, 201 bp, Homo sapiens
taaaaattcagatttacttctggcaaattcattcaggaattcaaactcagataattaaattaatttcttaatattcaaataaagaccagatacacattggyatcatctctcttgtatattcagagtaccagataaatgggatttttcactagggggacaggattgctacactacaccattgccatttgcattcacaacacg

SEQ ID NO: 11856 - DNA, 201 bp, Homo sapiens
aagatgtatttattcaaattcccactatgtgttttactagctgtatgtctttcagcagctcacttaacctaactgcaattctaattagtcatgtaatagtyatccctgtcccaaaagacggttgtgagaatcacgtctaattaataactgtaactaaaaagtgtgtgtgtatatatatatatgtatatatatatatgtgtg

SEQ ID NO: 11857 - DNA, 201 bp, Homo sapiens
gtgcatataaaagtatgtttataccatactgtgctttgttatatgtgaaatagcactatatcttttaaaaaaatactttgataaaaaatactttactgctmacaaaaatgctagtgatcaacagtattcagcgaatgtttttgctggtagagggtcccgtcttgatgttgatggctgctgacagatcaggatgtgggtgct

SEQ ID NO: 11858 - DNA, 201 bp, Homo sapiens
aggagataagtgaggagtctaggtcaacaattcaggtaagagatggtgatggagttaagtggcagtgaggatagaaaggggtaggcaggcagaagggaagrgtttgtattgagcaattgggaggttgtgggtgccatttgatgaggccaagaaaccagatcacaaagcaaatgtggaggctgctgggaggttgatgaatcc

SEQ ID NO: 11859 - DNA, 201 bp, Homo sapiens
ggaaattgcacagccaccccaacattcagtaaccactagcctgatcagtggttatcaaaactgaggcagaccctacaccagcaaaaagattacatctcacwgaaggctgtcaacttagatgactgttagcattttttttaacaataaagtgattttaattaaggtttgtacattgtgtttttagacataatgctattacac

SEQ ID NO: 11860 - DNA, 201 bp, Homo sapiens
ggtagtgtgatgcctccagctttgttcttttggcttaggattgacttggcgatgcaggctcttttttggttccatatgaactttaaagtagttttttccarttctgtgaagaaagtcattggtagctttatggggatggtattgaatctgtaaattaccttgggcagtatggccattttcacgatattgattcttcctacc

SEQ ID NO: 11861 - DNA, 201 bp, Homo sapiens
cttgtgaaatggtcgcctctcatgccaatcttggaagcgtaacattttcttgaccactttagttctaatgacttcacgtttatcctgaactagaaatatgstatcttcttggttgtttattctctttcttcttccctctttatatctctccatccttctttcttccttcttttttcttccctctatttcttccttctttcc

SEQ ID NO: 11862 - DNA, 201 bp, Homo sapiens
gttagcatatgtatatataaattagataatgttaatttacaaattaaggagagctataacttctatgacctatatgtgtctttctatttagtgacatgatmtgtctctccttttgcttaaattttattttatataatttcatatgtctcatattttgttaggtttatctctaaaagttttttcttctctgtacctaattat

SEQ ID NO: 11863 - DNA, 201 bp, Homo sapiens
gaccaaagatttcctctaagcatggcttttcctgtttcccatagattatagaatatgagtgcttttacatttttattgttctaggaaacctgcaaaatggsctgtattacattcgacccaagaattaagagagagttttaaaatttctgattggaatgggattctgtttccgatcttgttgttaacatctagttattacac

SEQ ID NO: 11864 - DNA, 201 bp, Homo sapiens
aaaggctttcatacctctgccctgcataggtcttgttcagagaagtgggtgcactgtggcagaaacaattctctactaacccatttggaacaataaagaartaaatcctaatccaccaaccttgaccagacagctgaaggttgtgctcacttggtactgaccttgtaaagatggattgcaattttggggagtcgattttat

SEQ ID NO: 11865 - DNA, 201 bp, Homo sapiens
gtacaagggccaaccatacagcctcatagtttcaagggtgctttgggagtcagatggacttgagtttaaatcttgcctctgccacataaaagctttgtgarcttggacaagtcatttacttctctcagcctcagttttctcatctgtaaaatgagataattatggcatcttatagaattgttgcgataatttcagatagtc

SEQ ID NO: 11866 - DNA, 201 bp, Homo sapiens
ttttttcagcaggtttctgtttttccacttaaaattgcttccaaatttctgagtttacttctaataatgggtatgctctccttgctatttttatctctagrtaattgttgactgcttgtagttttttcttgttgggcatgaatgactggcttcatcttccaaaagtgttacaaaacaccagttatttctttgagctttaga

SEQ ID NO: 11867 - DNA, 201 bp, Homo sapiens
ttaatggaacccataactgttttgcctactggtttccaactgaggattaatataacagtttccactcaacaattgtattgcttttttatcccccttatttycttttctttcttcatatgagaatattgagaataagagagattaggaaatttacactgcttctgagggacaaggcagcttttggacccaattatgcatgcc

SEQ ID NO: 11868 - DNA, 201 bp, Homo sapiens
atatattttgtgtgtgtactttttgtagagacaggatcttgctaggttgcccaggctggtctcaaactactgacctcaaatgatcttcctgcctcagcctyccaaagtgctatgattataggcctgagccatcttttcattatctttcttcagatctcaaattatttgtcactcactggaagtgtacagctaatctgaagt

SEQ ID NO: 11869 - DNA, 201 bp, Homo sapiens
taattgatgaagcaaggtacggaatgaggcataaaatggagagatcagagttagagcaattgataattatttttctttcagacaggttaaaaatatgaatstttggatgtaaccgagaggaaaattgagggagcttatgcctgatgcctctacattttctctaaagtaggagatgcgggaaggggtcagtagagagttgtg

SEQ ID NO: 11870 - DNA, 201 bp, Homo sapiens
ttctctaaaaatattgaaaagttaaagtttccttatccactttctcctcaaccagagctgcttctcccaaaatcccaagggaatcattattttgagtttgmtgtagatacttcaaacgtttaaaatatgtatttacatgcatatatatatatacatctagaaaaatactagcatatgttattttatgtagtttattcagtt

SEQ ID NO: 11871 - DNA, 201 bp, Homo sapiens
gataagattttgccaggtcaagaaaggaaccggtcaggtagaacattagtttacgtattagcacttacttcataaaggcatggaatagactgcggaaaatsaaggttgctggactttagggtggaactggtgagagaagagacaggagactgagtaaatgcagaaagggtggccatgtagcctatggcagatattttgaat

SEQ ID NO: 11872 - DNA, 201 bp, Homo sapiens
atttaaaaaaaataaaggagattggcagattttaaaaaggcttttaaagatatataagtgcttattttctctctgaggaaataaagagcaaaagaaaactwaaaagttaataattttgcataagtataatttggaatgattcagtgtattttttcattatgacttcaaatcatttaatgtatcaaaaacatagtcataaac

SEQ ID NO: 11873 - DNA, 201 bp, Homo sapiens
tgaaggcaaagtattggggggcactgagaattagagagacctaatttagaatgatggggccgggggggacaatgatagctaaaattcgttgagcactcacygtctgcaggccctgctgcaagggcttcacaagtatcacctcatttaattttcacaatgggtcttggagaagagctaatgttattattgttgccttgttac

SEQ ID NO: 11874 - DNA, 201 bp, Homo sapiens
tcctcaagagagaatctttctttttcttttcttttctttttttttttttttttttgagatggagtctcactctgtcacccaggctggagtgcagtggtgcratatcagctcactgcaacctccatctccggagttcaagtgattctcccactgcaggatcccgagtagctgggattacaggcataccgcaccatacctgct

SEQ ID NO: 11875 - DNA, 201 bp, Homo sapiens
aggtctagaacaagggctgaatgaccagttttcaaggcctgtttttttgtaaggccaactgtggggccaactgtgttactagctaaggtatatttcaagakaactacaaaccctttttacagtcagatcagaaatagaatacaggacatgaggacaaaggaagaaaagagagctttcttggagcatatggaattaaaatta

SEQ ID NO: 11876 - DNA, 201 bp, Homo sapiens
aactgataaattttatttgaaatgttggcaactgatttagagggaggaaatgtggagggaagagatgtatatatttctcttctctttctgtttcatcactyatcccatcttaccccaacaaataacccagcccaacagagaggatactggggtgacaagtacatctggaacttgaggctggacccttcaatatgagtggct

SEQ ID NO: 11877 - DNA, 201 bp, Homo sapiens
aaaaaaccaatataacaatagaaaataatacaaataaaaatacatataacagctatttgcatagcatgtacattgtgttaaatattataagtaatttagarattagagtataggaggatgtacatagtttatatgcacataatataagacaccattttatataaggaacttaagcatctacaaattttggtattcacaagg

SEQ ID NO: 11878 - DNA, 201 bp, Homo sapiens
gaaaactaaaaatagaattaccatatgattcagcaatcctgcttctgggtttcagtccaaaataattgaaggcagtacgccaaagagatatctgcattccsatgttcattgcagcattaatcacaatagctaaaaattagaagaaacctgggtgttcatcctcagatgaatggataaagaaaatgtggtatatgtacacga

SEQ ID NO: 11879 - DNA, 201 bp, Homo sapiens
aggtggaaagcgacaagtatcaaaggaatgagtgacccctacgtgccaagcactatgttgaagtgcttacatgtgttgtctcatatgatcccccagcaggkggatttttagcatttcatcctcaatgacattcaaatgttaagtaatctgctctaggtcaaaagttactaagtgatagaacaaagatttaaactcgtttct

SEQ ID NO: 11880 - DNA, 201 bp, Homo sapiens
gtttccagtttttctgttctgttttttccccatctttgccaagatggccgaataggaacagctccggtctacagctcccagcgtgagcgacgcagaagacbggtgatttctgcatttccatctgaggtaccgggttcatctcactagggagtgccagacagtgggcgcaggccagtgtgtgcgcgcaccgtgcgcgagccg

SEQ ID NO: 11881 - DNA, 201 bp, Homo sapiens
ttactgcaattgtatttaaataccagcttaattagctgtactcatcctccttcccaatcctctttgaagtaggaaagtcccattgcttccgtttagctaaygctatgctcataccctagtttttaagctttgtagaaagtacagatatgactgccccatgtgatctctaagaagtctagatatttgatccacagaagcatt

SEQ ID NO: 11882 - DNA, 201 bp, Homo sapiens
ggcagaagttatcctttattcagtttcatctctttatgtcttaccacctctttgtgaactagccacttgccttgagggtttacaaattcaagatttctcarcacgattagccctaatagtatgctttccttccaaggtttccagattatccaatacagtattatttctatcccaatcatgtttaaggattattattttaca

SEQ ID NO: 11883 - DNA, 201 bp, Homo sapiens
aagtgcatgacaccatcttgtgtttcatccaagtgacacatctaggctaacccagcaagtccagtgtatgagttgtgggaattacattcttttgtagttayaatttcatgggtccttgtttttattattatttccattggatcatgacagccctaagagctgctctcgcagcatctctgtatggttttgttcttgtgtttt

SEQ ID NO: 11884 - DNA, 201 bp, Homo sapiens
aaaccccatttctactaaaaatacaaaaattagccgggtgtggtggtgtgcacctgtagtcccagctactcgggaggctgaggcaggagaatcgcttgaayccaggaggcggaggttgcagtgtgctgagattgtgccactgcactccagcctggcgactgagcgagactccatctcaaaaacaaaaacaaaaacaaaagc

SEQ ID NO: 11885 - DNA, 201 bp, Homo sapiens
gtggaagtcagtgtggcgattcttcagggatctagaactagaaataccatttgacccagccatcccattactgggtatatacccaaaggactataaatcaygctgctataaagacacacgcacacatatgtttattgcggcactattcacaatagcaaagacttggaaccaacccaaatgtccaacaatgatagactggat

SEQ ID NO: 11886 - DNA, 201 bp, Homo sapiens
attatgaataagtcatcaatagttaatgataaggaatcagtctgctgtgccatattggtagatgaaatgctgctactcctcctattcctgggcttttctgycccccacccccttccttccctccttcctctgtccctccaactcttcttcacatctcccaactcccccaattcacttcttttccactgcatgccatgttac

SEQ ID NO: 11887 - DNA, 201 bp, Homo sapiens
attttaattcttatttcagtataatttccatttaaatttaaaaactcaagcagtgtaaaatagttttcatcaaacacaatttttgttctaataaaactatmtttcacctaaagcactgaaaatttagcattgagtttcagtgtgctgttaagtataaaaatatactagattgtaaaaacttcatatcacgatataaattat

SEQ ID NO: 11888 - DNA, 201 bp, Homo sapiens
accccactgttaacattagacagatcaatgagacagaaagtcaacaaggatacccaggaattgaactcagctctgcaccaagcggacctaatagacatctmcagaactctccaccccaaatcaacagactatacatttttttcagcaccacaccacacctattccaaaattgaccacatacttggaagtaaagctctcctc

SEQ ID NO: 11889 - DNA, 201 bp, Homo sapiens
attcctgatcactagccaaactatatactacagtttggttcatccaatttaaatagctggcctgtaactaagaaaagaaaaatatattttgtgaagaatakgtatgaggtagagaaattagtggtagtatgatacgggaaaagagtaatgtcaaaatgcatggtaatttatgtgatatgccgaggactgcaagaagtcaag

SEQ ID NO: 11890 - DNA, 201 bp, Homo sapiens
ttacaggtgtgaaccaccgcgcccggcctccccacattggactttctaaggaatattacctagccacagatctacagggtgtgtttgtttcttaaagcctrtgaaaacccaccccttctttttggtttgtttcttttatacgacccttaaatgtctttctccagagccctgccacccaccttcttcctgcgcactctacct

SEQ ID NO: 11891 - DNA, 201 bp, Homo sapiens
ctgtgaagggtctgagactgcagcctacttgcaagctaacaagttaatctgccacaggtagatattatatatatgtatatggtgtatacagatatatatgkgtgtatagatatatctgtatatgtgcatacacacgtacccacactgctgtcagggtacataatgagagaagatacaaactctagatcaaacacaaagatc

SEQ ID NO: 11892 - DNA, 201 bp, Homo sapiens
atacatatatgaagttcataaataaataatatataacttataaataaatatataaagttatgattttatagtttattaaatccagagtttttcttttgttrtagccctgcctcttaggcttggcaattggcttagaagttatcctcaagagagaatctttctttttcttttcttttctttttttttttttttttttgagat

SEQ ID NO: 11893 - DNA, 201 bp, Homo sapiens
tggggggaggggggagggatagcattaggagatatatctaatgttaaatgatgagttaatgggtgcagcacaccaacatgccacatgtatacatatgtaasaaacctgcacgttatgcacatgtaccctaaaacttaaagtatataaaagaaaaaaagaattagtggctcttgcagttgttcaggcaagagatgaaggagg

SEQ ID NO: 11894 - DNA, 201 bp, Homo sapiens
ctcccatttgcattggctgcagactctctaagtattactttcccttccttgtggttcataccctaatcattgaatattgatgttctatttatttctatgcrctcactttgtttttgaccaagttatatagttatttggttttcaggtaatgctttcttacagttactcaagaatgtatgctagaaaatgttgcccataact

SEQ ID NO: 11895 - DNA, 201 bp, Homo sapiens
aagtgagctatctgaaattgctggactagagtgtgggctaaaagatgtagaaaagaaagtggtttaatggcttgtggagaaccttggatgctttgctgaakaattagaatttaattgaaaggccatagggagctatggagaaatttttaaagagaggggtggacttgacctgtattttcagatgcaaagtaaagagagcaa

SEQ ID NO: 11896 - DNA, 201 bp, Homo sapiens
ttctgctatccatctgtgccaatctgaactgaatcagagtatcatttccttttttttgcatgtgctggtgtctcctgtgttggccttttagagtctgacayggtatttgggaccctccatgagattggaaggagttccattaagtgatagataaagatgtagccagtagaggccaaaggtactcaaatactttttatttaa

SEQ ID NO: 11897 - DNA, 201 bp, Homo sapiens
aagaatagtagtttaggcaaataaagatactttcttcctacatatcaagaagttccaagcgaggcagcccagagctggtaacagcccaacaatgccgctakggaatatagtccatattttgctccaccacacatagcatgttggctgcgatcctcaggtttgttaccttatggttacaatatggttcccacacatccaggc

SEQ ID NO: 11898 - DNA, 201 bp, Homo sapiens
agaattgcttgaacctgggaggcggagattgcagtgagcagagatcacgccactgcattccagccagggcggcaatgcaagactctgtggccaaaaaaaawaaaataaaaaaaaaaaaaatgggtgggagggagggtgtttactccctgccctggagatttgtataaacaggaaaagaagactgttttcttgtttagtctt

SEQ ID NO: 11899 - DNA, 201 bp, Homo sapiens
ttataatgttgaagttatcagacttttcttttatggcatccttatttcgacacttaattagaagggaggacttcatattctagagtggtaaagtaattctycatggttttctcttagcactaccatgttttgctttatattattcattttcataatttttaatgtattcctgtagaggacgtgaggtattgatacaaattt

SEQ ID NO: 11900 - DNA, 201 bp, Homo sapiens
ctatttgagtttcacttaaaagcattctgacatagctcacctcccctctttctcttatattgctacccataaggactagagaaaagatggataacataatsctgagtctatgagttgctagaaattcctcattataattgtgtgtcttctggcaaaaataaataaataactttctcttttaaagccacttataggagacaa

SEQ ID NO: 11901 - DNA, 201 bp, Homo sapiens
ggctgatttgggaaagttcaacagccccacttagttgctctgtgacatcctgacttcctacaggttacttctcatattgttgggtgtttgtttgtttgttwgtttgtttgtttgacagaggtctcactctgtcaccaggctggagtgcagtggcatgatctcggctcactgcaacctcctcctcccaggttcaagggattc

SEQ ID NO: 11902 - DNA, 201 bp, Homo sapiens
taagtttcatggttgtttcttctgatgtaaaagtaactgtagttatagatcctccagcacatgtcacactgaaaacctaatcacaaagtcaaaatatgtgyataaatattagcttgattatgtgtcacatgtaccccaaattacacatatatataccttcctcaaagatttttttttttgtggggggacagtctcactctg

SEQ ID NO: 11903 - DNA, 201 bp, Homo sapiens
cacatttccacacttaggtatgtcaaggaagccatcctgttgggagattacatttatctcaggtaaaaatgccaaatgacacaagacttagagtccccaakcatcttgacattcatgaatctgatatttttgaatcattgttctatgtttttcctccaaggccaaagaaccctattgctaatatcttctttcgtcattcct

SEQ ID NO: 11904 - DNA, 201 bp, Homo sapiens
aggttgcccaggctggtctcaaactactgacctcaaatgatcttcctgcctcagcctcccaaagtgctatgattataggcctgagccatcttttcattatytttcttcagatctcaaattatttgtcactcactggaagtgtacagctaatctgaagtggccttccacagttcccatctcgctcattacctggataatttc

SEQ ID NO: 11905 - DNA, 201 bp, Homo sapiens
ctttcaaggatgctacattagaaaactctctttatatttgagtttgtcaaattccacagaaacttgtctttataggggttggaagagaaaacattgctatrgtacttataaaacattgctatagtacttattgatgaccaaaataccttcatatcggttattacatttgagcctcactccatcctgtgaaggacagggttt

SEQ ID NO: 11906 - DNA, 201 bp, Homo sapiens
tcaagatgtggagggaaaagcatgagctttggggtcactcatgcagacttgggtaggtaactccctgctttttgtttactagttgagtgattacctcctgmgtctacatgccattcagaggtaataccatcatctttgtagttggggatggcttagaatcaagtgacatgtgcaaggtcatctaatctagtagttggtgca

SEQ ID NO: 11907 - DNA, 201 bp, Homo sapiens
cctcctgagcacctgcgattacaggtgtgcaccaccatgcctggctaatttttgtatttttagtagagaaggggtttcaccatgttggccaggctggtctsgaactcctgacctcaagtgatcagcccatcttggcctcccaaagtgctgggattacaggtgtgaaccaccgcgcccggcctccccacattggactttcta

SEQ ID NO: 11908 - DNA, 201 bp, Homo sapiens
gggcgtggtggcgggcacctgtagtcccagctacttgagaggctgaggcaggagaacggtgtgaacccgggaggggcagcttgcagtgagccgagatcgcrccactgcactccagcctgggcgacagagtgagactccgtctcaaaaaaaaaaaaaaaaaaaaaaaaaaaaagaaaaggtggtcccctgagcttcggcatt

SEQ ID NO: 11909 - DNA, 201 bp, Homo sapiens
ctggacttcaataccattttggttcaacatgtgttttcttacactgataacaagaatgggggctcctaaaagcatagatgttctttatgacatcaacctcraaaatgtaaaggatatattcaaaatataactcctctaaagtaagtaaccatttatccaaaaatttagagggtatattcaaaatataactccccaaaaata

SEQ ID NO: 11910 - DNA, 201 bp, Homo sapiens
cattgcttttgtcttctaaggttttatatctaaatagaaaggctggggaaatggtccactgacaggtcaaaagcaagatttctagtgtcatattattgggracacacacgaagccagaaaatccatcatttcataacttttgtagcacttcacactattctaccaccacatagatgtttgcttccatatttgtctgaacat

SEQ ID NO: 11911 - DNA, 201 bp, Homo sapiens
tagccagttttcccagcaccatttattaaacagggaatcctttccccattgcttgtttttctcaggtttgtcaaaaatcagatagttgtagatatgcggcrttatttctgagggctctgttctgttccattgatctataactctgttttggtaccagtaccatgctgttttggttaccttaggcttgtagtatagtttgaa

SEQ ID NO: 11912 - DNA, 201 bp, Homo sapiens
tagtctattgtattttttaactgaaccttttttgtttttcacacacatgcatgcacacacacatagacaaatatatatatgcttatgtatatgtatatgtrcatacacaatgaatgtatatgtatatgtacatacacatatgtatgtatatgtatatgtacatacacatatgtatgtatatattatttgtatatctaaagt

SEQ ID NO: 11913 - DNA, 201 bp, Homo sapiens
tactccttccctgagcttgttccttcctttcaccaaaacacacatattccatctttcaactctcctgctctacacgtgtatgcttgagtttagggccctgraataagcaatcctgggtcaacatctgctctgcaaacatcaaaaagtgtgagcaggggcagcctagccttggtattgatgtgtttcccatccacagccaca

SEQ ID NO: 11914 - DNA, 201 bp, Homo sapiens
aattgatttggttgttcatctgattcaacccatgtcagagtttgaaagtaattatgatagtggggctgataggcaggcaattacatttttgttctcttgcyttctggctccttctccctctctttcccttcccacacctccacctgcaaggttgttcttgtcaggaaggcaatgtaagcaggagacgagagagtaatcttt

SEQ ID NO: 11915 - DNA, 201 bp, Homo sapiens
aggattgaaactctctcaaagccacaatgtatgtctgtgttgctttgcactcttacattgcccatcctttacaacagcccttctcctgtccttctgattcytaaaactcaaaaccagaatgaagtaaggctacaaaatgtcatttatggggatgggtgaggcttaagtctcctggaaccatcttgggtcactcagctctac

SEQ ID NO: 11916 - DNA, 201 bp, Homo sapiens
actggtatatcaatctctaattggggaaatgatttggctgcagcacaaaggagcccctctctgtctaacattaggtttgccccttgagctttctgcaggcrgagattgatggtggtggcgtgatggtcaaggaatgtgtcctcagatgaggctgagcagaattatttctttgtaaattttctttttcccctttcttcctcc

SEQ ID NO: 11917 - DNA, 201 bp, Homo sapiens
cagtacccagtatatcctgaatttttaaggcagcctctccaagaacattctgaggtgttctggtgtctttagtaatcttatctcctaattttggttcttgsctggaatgaagaaaattactggtctgtgaatctttggctcttgtcattgtaagacttagggaacaatgctgcaatttttgcagcctctgtaatgaccaga

SEQ ID NO: 11918 - DNA, 201 bp, Homo sapiens
cacatggacacaggaaggggaacatcacacaccggggcctgttgtggggtggggggaggggggagggatagcattaggagatatatctaatgttaaatgaygagttaatgggtgcagcacaccaacatgccacatgtatacatatgtaacaaacctgcacgttatgcacatgtaccctaaaacttaaagtatataaaagaa

SEQ ID NO: 11919 - DNA, 201 bp, Homo sapiens
tgcattagtttgctgaggataatggcttccagctccctccatgtccctgaaaaggacatgatcttattgcttttaatggctgcatagtattccatggtatmtatataccacattgtctttgtccagtctatcattgatgggcatttaggttgattctgtgtctttgctgttgtgaatagtgctccaatgaacatatgtgtg

SEQ ID NO: 11920 - DNA, 201 bp, Homo sapiens
tcctagcagaaaaattatttttcagccttctcagaagtactaaaagtcctttgccaacatcagcccagtgcaagttaacctgttatgagatttgttttgtrctttggaaatgcttgtcagacaagctttcaacattgagatgtgtgatttaaattagtttgcataagaaaatgtaatgccagggacaaatttctctcttta

SEQ ID NO: 11921 - DNA, 201 bp, Homo sapiens
ttctgccatcctttcaaaggggtagaagtctgaggaatacccttcctcagataacagcaactatgaccagcctggcccacaccatttcaatttcatggctsttgtctcattttgttctgttatccctctgaggtgtgtagcccgagtgtcatttcagtgttgaggaagttggggcccagggaagttaaatgatgtgtgacg

SEQ ID NO: 11922 - DNA, 201 bp, Homo sapiens
aaggtcaggagatcaagaccatcctgcccaacatggtgaaaccccgtctctactaaaaatgcaaaaattacctgggtgaggtggcgcatgcctgtaatccyagctactcaggaggctgaggcacgagaatcacttgaacccagcaggtggaggttgcagtgagccgagatcgcaccactgcactccagtctggtgactgag

SEQ ID NO: 11923 - DNA, 201 bp, Homo sapiens
gcacctgtagtcccagctactcgggaggctgaggcaggagaatggtgtgaactcaggaggtggagcttgcagtgagctgagatcttgccactgcactccakcctgcgtgacagagcgagactctgtctcaaaaagaaaaaaaaaaaaaaaggttaggtgattgtggtggtgcatgactgtagtcccaactttgggaggctg

SEQ ID NO: 11924 - DNA, 201 bp, Homo sapiens
tacccaccacctacataataaaaaaagccacaagccccagccttgggggaattgtattgatttataaagagagaggctatcacttgctgttctcattaacytggaaatagacaccacattttatctgctgctctgtttcctgctgtagatctgtgtagtaaatccattaatctgtctgtccattcatccatccatccatcc

SEQ ID NO: 11925 - DNA, 201 bp, Homo sapiens
tggggtgccatcacccatgcccatgtagaatgttcatagataaatgttgcatgggttctgactgttccaccaaccagctgttcctccagccttctccctcycttcaggtttccctattctctttgatacaataatattgacattaggccaattaatagccctactgtggcctccaagtgctcaagtagaaagaaagagttg

SEQ ID NO: 11926 - DNA, 201 bp, Homo sapiens
gctgagcagtgacttcttcctggctctactgtgggcctcctgatggatggacatgggccctgtggtaaagagatggttctagaaatgcacagaaactatcrattccaagttgacaaatgagaaacaaatccaatctcaccagccaatcgggactcatcattttgccaaaacaatgcccatagattgcctaccactattatt

SEQ ID NO: 11927 - DNA, 201 bp, Homo sapiens
tttccccagcacttaagagagcagggctgtgtactgttcaaaaagcactttgtcatttctcgaagtactcttagctttgtgtggctgtctggacacaagcrtcagcatctccaggagaaggaggaaatcgagtgaagtgagagcatggaggggccagtatgccacttcctagggaaaggcaaaggcatttcttctcaggaa

SEQ ID NO: 11928 - DNA, 201 bp, Homo sapiens
cgatccttctgcctcagcctcccaagtagcttgaactacaggaacccatcacagtacccagtatatcctgaatttttaaggcagcctctccaagaacattytgaggtgttctggtgtctttagtaatcttatctcctaattttggttcttgcctggaatgaagaaaattactggtctgtgaatctttggctcttgtcattg

SEQ ID NO: 11929 - DNA, 201 bp, Homo sapiens
tcatgatattggttttgagagccacgtgggcagagaaataaattctagaaaaaaagaaatggtaatctgacatgcagacttggattataaatatggtcaarggtgtacttaaaaacaagatattttgcttcttggttagctttactgagaatccagggatcaagtaaaatcattgccattggtactgacggttgagagtca

SEQ ID NO: 11930 - DNA, 201 bp, Homo sapiens
agctgcatgctgggagaaccactgctctcttccaagctgtcagacagggtcatttaagtctgcagaggttactgctgtctttttgtttgtctgtgccctgyccccagaggtggagcctacagaggcaggcaggcctccttgagctgtggttggctccacccagttggagcttcctggctgctttgtttacctaagcaagcc

SEQ ID NO: 11931 - DNA, 201 bp, Homo sapiens
tggggctaataatacctcatgcatatggctgccaacgggagttagtgaaataatgtacatgaaatatttaacactaaacttggtgcctaatgtatcttcartaaatgataactattgtcatagtcatcattgcttttatacttttcggcttccagtgatttccagtgactacagccctaaggccattgggggatatctttt

SEQ ID NO: 11932 - DNA, 201 bp, Homo sapiens
tcaagacctccaagtgccctttacctccaggtcacctgtgttcctgcagcaagacacacctctgtccccaccatgaggcagaatgaggcttgggacagatragacttccagaacccagctccagcactgtggccactgtctgattaatcagttcttcttctgcactgataattaaatactcactgttaaattttatattac

SEQ ID NO: 11933 - DNA, 201 bp, Homo sapiens
gtttatgggtacatgtgaaggtttgttacctatgtaaacatatcatgcggttttgttgtacatatcatttgatcatctaggtattaagcccagtatcaaawaattatcttttctgctccctccatcctctcaccctccctgctcaagtagactccttgtgttcctaagtcatcatttagctccaacttgttgagaacatgc

SEQ ID NO: 11934 - DNA, 201 bp, Homo sapiens
atgttatagctctgttagatggcgtggtccctccagggctaacagcatctataatacgtatgtttccttattctcctccttacctatcagtatgtctgctstatgctcaggagtattccacagtggctcagtggcatgaataataggaaataatgtctaaatggactataagacataagctggctttttcaatggccctta

SEQ ID NO: 11935 - DNA, 201 bp, Homo sapiens
tgagttattttaaaaaataagaatccttcagtctctgttgcccattttctcctctatgaataatttctgcagacaggtgaccagttcaaccatctctctcrgttacaaatgcctgtggttggtccacttccttcagccttggagtaaaataaaggcttcttttgcaagatcacgaaataattcagcaaatactgtgggact

SEQ ID NO: 11936 - DNA, 201 bp, Homo sapiens
tcttaaattgctaaatggtaacgaaaatgagagaaaatagtacagttagctgtttgctttcgagtttgtggaaagtgattttctaatcaatgttactcttsatttcttaagcataacaagattaaaatgagtgtgaatataaaagatcatgataaaagataaaggatgatgacctgagatcttctttattttttattacta

SEQ ID NO: 11937 - DNA, 201 bp, Homo sapiens
tgaaataatattttgattatattgggctacacaaaatacattattacaattaatttaacatttctttgtacagtttttaaatgtgaatccttggaaattcrtaattgcatatgtggttcacattatgtttctcttggacagtgctgagctagtacattctgaaatatgtagcaattatttctctatggcttcataaagaaa

SEQ ID NO: 11938 - DNA, 201 bp, Homo sapiens
tgaggcagagggggcatttcccccgccacacacacacacacacacacacacacacacacacacacacagaggagaaggtgatggaggcagatactggagtraagcagccacaagccaaggaatgctgacagctgccagaacagtcaagaaacagattctcttttagggtcttcagagagaatgtggccctgctgatgtctt

SEQ ID NO: 11939 - DNA, 201 bp, Homo sapiens
agacatgatgggtctgctgcagtgtggtactaaatttggggttacaagaaatttttggcttattagtttcctagggcttctgtaattaagtaccacacackgagtgccttaaaacaactgaaatgtattatctcatagttacaaagtctagaagtctcaaaacaaggtgtcagcagagccatgctcccccctgcaatctgc

SEQ ID NO: 11940 - DNA, 201 bp, Homo sapiens
atgtcatagcccatatatgcatgtgtcttttgttcttattggaagagtggaaatgccatccaaaagtaacttactgctttttgtttcacttcttgatgcaygcacattctaccaacgctttttaacttcagcctaccgatgcatcaggtagaaccaaaaacaagaggtctcttgccctgtgcaagccaagcctttctgatt

SEQ ID NO: 11941 - DNA, 201 bp, Homo sapiens
ccctggtcattctttgaacacttcagatttccacagattctatccctttaacatttctgaacgttatgattttgcttcctccccacactggcagctctgcytcaatgaaaccgtgttgcttttttggttgatcaattgtgcccaacttcctgatcatacttgtcctgagagcctgtgttaagctcatgccggctctcccac

SEQ ID NO: 11942 - DNA, 201 bp, Homo sapiens
ctgggcgtggtggcgggcacctgtagtcccagctacttgagaggctgaggcaggagaacggtgtgaacccgggaggggcagcttgcagtgagccgagatcscaccactgcactccagcctgggcgacagagtgagactccgtctcaaaaaaaaaaaaaaaaaaaaaaaaaaaaagaaaaggtggtcccctgagcttcggca

SEQ ID NO: 11943 - DNA, 201 bp, Homo sapiens
cagtggtgtatatttcagatatttaattaagtcttcctttctgtccaactctctgccaaaacatatttttcatttttatacctgcaatgctcaaacataarttgatgccaaatgcatgctgtttgattacattccatccagatttacttccaagcaggacgaggcctgtagcatttatttcaagtagctttacaaagagcc

SEQ ID NO: 11944 - DNA, 201 bp, Homo sapiens
gaatttgatcctgtcattatgatgttagctcgttattttgttcattagttgatgcagtttcttcctagtctcgatggtctttacattttggcatgattttrcagcggctggtatcagttgttcctttccatgtttagcacttccttcaggagctcttttagggcaggcctggtggtgacaaaatctctcagcatttgcttg

SEQ ID NO: 11945 - DNA, 201 bp, Homo sapiens
acgattgactttcctaattcaattggctatttgacttccctaatagttaagttagatttgagccagggatttgaactacaaaaaccgtgttttttctagtytaccaccttatatagagagatatgacagaggggagagatgagaggtgtgtgggtgggtgggtgagggtggaggaggtggtactggatattactgaaaaac

SEQ ID NO: 11946 - DNA, 201 bp, Homo sapiens
aaaccaataggctcactttccaaaagaaaatctgaagcatttaagattatttaataaggaagaatttcctctggtgtcctgaatgaggaatctttggggcragaagggtcctgtcctatttattatccttaagaaattccttgctatttttagttctcaacatcagctacttctcattactaagtaaaagccagattactt

SEQ ID NO: 11947 - DNA, 201 bp, Homo sapiens
tgctttcatttggtaaactttgcaaagcagaagctttatcttaaaagttgttgtggttttgtattaagctcttttgaagtaactgatatgacttattttgmtttaagacttaaagtgcaatttttaataagctggtaccatttattaattacttactaatgatcccagcacagtgctttctgtatattatgtctcttcgtc

SEQ ID NO: 11948 - DNA, 201 bp, Homo sapiens
gttttaaattagcataggtaacatagagattattactcagttgaccactttgcacttgatctgagggacattgcagagtcatcacagattcttgagttatraggtcagtatttaatgaaaggatacgtcgaaggcttttccttaactttcaaggacctgtggggatagtttctactcaatgcttctttttattcgctttcc

SEQ ID NO: 11949 - DNA, 201 bp, Homo sapiens
ctggccactgtggtgaaaccctgtctctactaaaaatacaaaaattagccgggtgtggtggcgcatgcctgtaatcccaacgattcaggaggccatggcaraagaatcgcttgaaacccaggaggcggaggttgcagtgagccaagattgcgccattgcactccagcctgggcaacaagagcgaaactcatctcaaaaaaa

SEQ ID NO: 11950 - DNA, 201 bp, Homo sapiens
aagatctggaagtcacctctctgtaaatctgagaagttattttcattgttgttggatgataatgcttaagccagtgttggaggctgcacaagtaaattacrtggttttagaagcacctcctccttccatctgtgctgtttggttgtattctttattggatctgggatgatatgacttctttgcctggggctgttgctgcca

SEQ ID NO: 11951 - DNA, 201 bp, Homo sapiens
ttaaagccctaattttaaaaaatgctattctggccatcacatttacaatgtgaataatatttgagtcatgacgtaactataagttacttctaatgattgaytgtcacttgagttgtaaatcacagcatttagcagtgctagttgtccttacttttggtaaccccttagtccctggatcttgatcattttggggtctttact

SEQ ID NO: 11952 - DNA, 201 bp, Homo sapiens
tgttcattgcagcattactgtaccgcattatgaaatgggttccttcaccccttttctgagcaccctccatgtctacagaagaagttatgaggaacaaaggyatatgcagggctcgttttgtaatgctgacaacagcaatcctcacatccagacttccatgtccatgtacagggttctctactttcgttctaagtcaaactg

SEQ ID NO: 11953 - DNA, 201 bp, Homo sapiens
tatcttctctttttgctgagagcagtggttctcaaccaggacagttttgggggtgctactgtcatctagtgggtagaggccagggatgttgccaatcatcyagcaatgcaaggagagcctgcaacaaggaattatctagtcctaaatgttaatagcactcaggttgagaaactctattttaaagagaagaataatcatgat

SEQ ID NO: 11954 - DNA, 201 bp, Homo sapiens
ttcagcgaaagcaagtcacatgtctgagcttagtgtccagggctgggctcagtgatgttaaattgccaagggtatggagatggggagagtgaagaatttgrgacattaatacaatcaaacccaatcaaaccactacacaacattatgggagaaatcgctgaattttctttcttttttttttttttttttgagacagagtct

SEQ ID NO: 11955 - DNA, 201 bp, Homo sapiens
attatctttgtgtgatttatctttttctatcatcttattttcatcctgtctgtatcactctattagaattgaattctttgtagatagcatatagttgggtsatgtttttaatctattttgctattttctgtcttttacatatttagactctttatatttaatatcatcatttatatgtaagggtgtaagtctactatttca

SEQ ID NO: 11956 - DNA, 201 bp, Homo sapiens
ttctgtttccaataattggtattcaagttatctggaagaccttctgttttggaactagcagcaaagccagtttgttctacctagaaaaagcagtctcactrtatcatagaccattattttctatagcagccttgacccttagagttataattggctatttcatctcacaaacatcttcaaaatgaagttacctgcatgata

SEQ ID NO: 11957 - DNA, 201 bp, Homo sapiens
cactcctcagtgatggggtagctgctctttgaaagacaagcaactgtgatggggacctgtcagtcttccttacatgcagctggttctctaaatattccaaygattcctatcattttctgtaggagtacctgcaaaactggaaggctaggctgatggctttttctccattaagcagtaaacacgttaagcaagcttgagcca

SEQ ID NO: 11958 - DNA, 201 bp, Homo sapiens
agcactatcaatgtcagtcaagataacagttcatttatttcatagattactttgattaaaatcactattaaagctatttgaattatattataattttctgrtgatgtcataataaagaagtttttgaacgtgcccattttatttttaacgcttcaatgtgtattactggagaagaaattgaagtaacatatttttactgtt

SEQ ID NO: 11959 - DNA, 201 bp, Homo sapiens
tgaaaagtcttatacttgatctgtaactacaagatgttagatgttcttcatgcagatgacaggcaaaggttacttttacagttctatgaaagtaaaaagcytttaaaacatttgaatgggaattggtaaaagaagcagttcttaattatgtcaattgtctgtaagagctcaggtgattatggtaaacacacctgataacaa

SEQ ID NO: 11960 - DNA, 201 bp, Homo sapiens
agaagacaacatcacacctgaaataagagagattagaaggagccagtgataacagacctggaagaagggaattcaggacagagggagcagaaggctctaaygtggaaacaagaaggccagagtacccagagcagaatgagaaggggattcctaatcaggaaggaatcatatgtggttgttcactgagagcaatcattgaca

SEQ ID NO: 11961 - DNA, 201 bp, Homo sapiens
gagccgctgacttagagaaagtttccaacatattttgtttaaatgttcatcatgtttttgtaatttagacagtatacatcggtataagaaagatttttttyttgtccacatctcttcctcaattattgagactttaaaggattaaaaacaagtctatgtacttgacatgatgctgaaatttctcaggccttgggttttcat

SEQ ID NO: 11962 - DNA, 201 bp, Homo sapiens
ggaatgtagagaaggatgaggaaaccttctctgaaaaaaatgatatttgagcagaagagtgtgaaataagtgacagctaagaggaagaaaaaatgcattasagcttgcaaaaaattctgaacattagaaaaagtcagccatttctgggagagagttatctgggagcagcaactgtctcacaggattttgtccaaagtataa

SEQ ID NO: 11963 - DNA, 201 bp, Homo sapiens
tgcagtgagccacgatccacgattgtgccactgcactctagcctgggcaacagagtgagaccttgtctcaaaaaaaaagggggacttaggtagaaggtttyttctaacccttcccctttcctgtaaacattcttctcaatcccacgctgtctcctgtgccctgcctcctgcccatggtggcagacttcttcagtctgcatg

SEQ ID NO: 11964 - DNA, 201 bp, Homo sapiens
tttttacttttcttcaagtgggcttatcaaagtattttttttaaataaaataaaggcaagtctttctgtaagaaaaaaagtcagaaaaacattttcttctyattataggaccaaaagtgcccttagagatcaagtagcccagtgatccccagactttgcttgttggtcgcgataccctgggcagcatttgaaagccaggcc

SEQ ID NO: 11965 - DNA, 201 bp, Homo sapiens
tttttcttttgttgtagccctgcctcttaggcttggcaattggcttagaagttatcctcaagagagaatctttctttttcttttcttttcttttttttttwttttttttgagatggagtctcactctgtcacccaggctggagtgcagtggtgcgatatcagctcactgcaacctccatctccggagttcaagtgattctc

SEQ ID NO: 11966 - DNA, 201 bp, Homo sapiens
gcaggagtgaagtgatgtaatctcagcttcctgcaacctccaccccttgggttaaactgattctcctgcctcagcctcccgagtagctgggattataggcrcccaccaccacacctggctaatttttgtatttttagtagagatggggtttcaccatcttggccaggctggtcttgaactcctgacctcatgatccacccg

SEQ ID NO: 11967 - DNA, 201 bp, Homo sapiens
ttgctgtcccttggatggatttttgttgctttcatcttctttgatgcccttgggggcttgattgtggtataaggtaggttcagtcaactcatttaagttcscttttccaggagtcactggggaccaggaatgagtcctggtgcatggtaatcccatgcagagttcccagccatccctctgtcagcccagcacctgtgtctt

SEQ ID NO: 11968 - DNA, 201 bp, Homo sapiens
gtatctggatgatgctggcctcatagaatgagttagggaggagtccctcctcttcaattttttgaatagtttcagtagaaatgtgtactagctcttctttstacctctggtagaattcagctgtgaatctatctggtcctgggcttttttagttggtaggctattctctactgcctcaatttcagaacgtggtctattcag

SEQ ID NO: 11969 - DNA, 201 bp, Homo sapiens
atgtatcagtaagtcaaggaaaaaattaaatttgtcaataggtccctattctccagtgctgtcttttcaaagttactttgcaaggtattcagttttagtgmtaacgtatcaatcttttttttttggtgggcgggggatgggggcagggtctcactctgttgcccaggctggagtgcagtggcgccatctcgccttaccaca

SEQ ID NO: 11970 - DNA, 201 bp, Homo sapiens
attacctctcgcattttacaaatgagaacactgaggttcagggagattaggtaattgtcagaggttacaaagctcctcagtggtagagctctggaataagratccagttttatctgactctagtctagctcttaactgaatcccagaataccagaaccttggggcagggacaccccttgaaatgtactacaggggaatcta

SEQ ID NO: 11971 - DNA, 201 bp, Homo sapiens
aggaaaacccaacccaaactgccttaagccaaaggaaattttagagggtcccataaggagaaagtctaggggttgctctgggtctaggaataccttgatasaagatctcatgtaatattgccgggttttctgttctcttctttgaacttagttctcctcctcttgcctcatgatcacaaaattgatgcagcagctccaacc

SEQ ID NO: 11972 - DNA, 201 bp, Homo sapiens
ctctctgtctcttatttccttccattgtactctagtcctctagtcttagccaacaggttgtggctgctgcaatccccgaggctcttctacgctacctctgkgtccatgctttgctgtgtgccctatagactgttcctctgtatctgcctttgcaacagctgtctgctcatccttcataacagctcaaggggttaccaccta

SEQ ID NO: 11973 - DNA, 201 bp, Homo sapiens
atgtccttatctctgaaaacatagggacactgaaaagaatctgaacaagtaggccttgccgtgttacccccagtttattaacattagattgtactcttttrtcctccaattatacttccatgcacgactgtccactctttatcaaacctaagcataaaaatacccagatttccctgtgtcttcgggccttcatttctgaag

SEQ ID NO: 11974 - DNA, 201 bp, Homo sapiens
gctgatagatactgttgtctgtttcataggtgactttataggtcttgcatatgttctttcatttaatcttcacaccatatgatgcagtagaaatacatatstcccttatacagatggggacactgaggtttagagtttaatatcaccagcccaaggtcacattactagtaagtgattaaactggattttaaagcccatgac

SEQ ID NO: 11975 - DNA, 201 bp, Homo sapiens
atctttttggtcttggccgtgatggaagtctgaaaaacagcatttggcaagggaatgacccaaacagaataattttctatagacaaaatgtgtttaagttratgaatgaaagatgtgaatgctcatgctaggagaaggggaaaagcattggtatttcccttaaagagaccataccagggtattttatttcctgtaagtggt

SEQ ID NO: 11976 - DNA, 201 bp, Homo sapiens
tgagcggcagaggaaaaccatagaacaaactaagtaaaagaaattgagaaaatgtattctttggaaaatcagatattacgagatccttcagttaaatttaygtctctatttgctagaagagatatttatcagttccaaagcaacaagcctttcccttttggttttattagctacatggtaattgatatgaatttaaaagat

SEQ ID NO: 11977 - DNA, 201 bp, Homo sapiens
gacacttccatctttgaaatacccagaagtctgtttctccaatgccttgactctgcctaaagcagtctaccattaatctctgaggaatctcttcaaacagstttctgccaatgtatcactgaagccttttgagaaataagtgctgttccagcttagtcatatctcaaggcagcgtggcatgggaggtggagactacgagta

SEQ ID NO: 11978 - DNA, 201 bp, Homo sapiens
gggattggaatgggggtagataacattaataattttttttgaccaaataagcacccagtgataatgatccaatttaaccatccatgaaatatatgtttgcsgtacattggaggaaggttatgtgggggaggcagagtctgacggggttacctccggggagatttgatgcctggacagtagagccacagccccctcccccat

SEQ ID NO: 11979 - DNA, 201 bp, Homo sapiens
aatgatttcttctcctttgggtagatacccagtagtgggactgttgaatcgaatggtaattctatctttagttctttgagaaatctccatactattttccrtagaggttgtattaatttacattcctacagtgtataagcattccctttcctccataccttgttgttttttttgactttttaataataaaatatgtttttc

SEQ ID NO: 11980 - DNA, 201 bp, Homo sapiens
cacaaacctaaataggaagcagcatgatctaatggaaagcatatagtctttggaggttaacattggcttgtattttggatctgctttcaactggaaatatyagaaggatttagtcccttctgagccttagttttatcatttgaaaaatgggctagtaaaactttatttcacagggcttttgtgagggataaataagaaata

SEQ ID NO: 11981 - DNA, 201 bp, Homo sapiens
atgtgctaggcagagcccagtgttaggaaaggctaggcctcaggaaaggcatagtgtctgtcttcaaggtatggagtctgtctatgctagtcctcaggaarggcatggtgtatctgtcttcaaaacactgaaactctgcatttcccaaaggaggatggctaaaggatgagattcacataatgacattgtgaatgcagtgtg

SEQ ID NO: 11982 - DNA, 201 bp, Homo sapiens
tcatctttgtattgctactctctagtagagtgagtttactggttaaagcattttcattaaatgtttgttaagtgaataaatgttgatatatatatatatayacacacacacacatacatatatacatatatatctttatatattctcaccttcccccatccattatttctttggctaaggccacctggattttctctgttt

SEQ ID NO: 11983 - DNA, 201 bp, Homo sapiens
ctctgtgttttggtgttgtcattaatgctaagttacatttccttagggtatctgcattaagcaaatgtaagatgtttgagtttcaaagatgaacaagtgayttgtaagtgtaaagtggtatggctgtttttaataaataggtaataccacccttttggcgggtagtagagaaaagaagatgagtttttagaaaaagactca

SEQ ID NO: 11984 - DNA, 201 bp, Homo sapiens
agtggatctcagtctagaggtgagaagagggctaatcataataattgggactgagtgtgttagaattacacatctttcccctgctctgataaaaaatatcstgccatagagagtcactgatactaatcagagcatgtcatatctttcagatatttggggacagagaaaaaaaggtgatgaattacagtactagagatacta

SEQ ID NO: 11985 - DNA, 201 bp, Homo sapiens
aagagtggaaatgccatccaaaagtaacttactgctttttgtttcacttcttgatgcacgcacattctaccaacgctttttaacttcagcctaccgatgcrtcaggtagaaccaaaaacaagaggtctcttgccctgtgcaagccaagcctttctgattagcaatcctagagaggacaggtggctcacgcctgtaatccca

SEQ ID NO: 11986 - DNA, 201 bp, Homo sapiens
tttggtttttggtctttgtaagtgagagagagtaacactcttccttgactgtattagtcagggttctccagggaaacaaaaccaagaggagatatatatgmacatgatgattgttatgaggaactggctcacgtgattagggaagctgagaagtcttatgatctgccgtctgcaaactggagaggaagccagtggtatagt

SEQ ID NO: 11987 - DNA, 201 bp, Homo sapiens
aggctacctcattggaagttgagaggattaaatgagatgatatatttaaagtgcttaaattcttggctcataataagcattcagtaaatgtgagctattayttctctttctcctcctcatttttaattttttaaatactacctctattactattgtgaataatgtcattataaaggtgcaactagatcatgtttatgaagg

SEQ ID NO: 11988 - DNA, 201 bp, Homo sapiens
agggagagaatacattgaacctattcagcttggcggtcacgaccaagtgaggtgccattggatatgtggttacttgtgggtgagctcaagtagaagcctcrggctgggctcctctcctggggtggaacccttctgctgggctcctttcctcctggctccctgtactcactgctgctctctggtttaccagcatagaggcac

SEQ ID NO: 11989 - DNA, 201 bp, Homo sapiens
atggtggtccaaaagactgtggtgaggggatggcctcccaagaggcagggattgagccctacactgaccagaaatcactgcattacagaataatggagaargcaagacaatgaaactgagtttctctgaaagcttggcatcttggatatttcaaagattaaagttgtatttaatgggaatcacgtggttcaattaactggt

SEQ ID NO: 11990 - DNA, 201 bp, Homo sapiens
ctccccgccagagataaccaatgggagaattttgatatctatcattccagcttaatttctaagcatctgcaatccagggtgtgttattttgtttttaaagragttcattcactcatttaacaagtactaattgagcgcccgctcgatgccaggcactggaatcacattttggaagctgtcacactagcctgatttttcaca

SEQ ID NO: 11991 - DNA, 201 bp, Homo sapiens
tgtaggtgaaggaattgctttctggtaggaattacttgtttagaagtcattggctcagctaaggattttgtgggttgtcgcagtgcacagctgaggacttygtcctatttatgtgctgtctgttcagtatgaagtggcagccattgatccatctgtagtacaccatttgcctggggctatttatctggttgtggagatgta

SEQ ID NO: 11992 - DNA, 201 bp, Homo sapiens
gctaacctcagctcccatcccacttgctgaaaccttggctagaaccccaccctgctaatccatgatgcttcactatcccaggtgccgtcttatctctgctygtgcttgcccatttatcagggacatttctcccatttgtagccatatcttgaagtttaatttgagcctcacacactctgtgacactttgcctggccacctc

SEQ ID NO: 11993 - DNA, 201 bp, Homo sapiens
ggtcagcctttgtgttctattctgctcttcacccaattgcatgaagcctatgcacagtcaatctgttttattcaacctacaaatttaactgttaatctcayccaaaaaaacgccctcacagaaacaactagaataatgtttgttcaagtatctgggtacctgatagcccaatcaactttgcacctaaaattaatcatttta

SEQ ID NO: 11994 - DNA, 201 bp, Homo sapiens
attgaacaccctcttggtgcaatgtgccatgcttagttgttggggattacaaaggtagaatattctacctcaaagggcatagaagtgaatttttttttttwaaaaaaaactacaatacaaggaatagagtggtcatttgcaaaataaaatttttattgaattgctgaagcagtaaactctcagctgggagggtcagggaag

SEQ ID NO: 11995 - DNA, 201 bp, Homo sapiens
atggtctagttgggaagcttgtcaggcaaagaagtatatagcacatatcagagttgctctaatagcaggtagaatgtttgtaaagcagcttaaaagggagyatgttaccatacctgggtgtgggcgcgtgcctgtgcacttgaagtgagagttagggattggaggaaactttgcagagcaaattcttgggcaggacatgga

SEQ ID NO: 11996 - DNA, 201 bp, Homo sapiens
gtttacgctggagaatggtagtgacatcttcaaaggaagcttcttgagtgacctatgttatagctctgttagatggcgtggtccctccagggctaacagcrtctataatacgtatgtttccttattctcctccttacctatcagtatgtctgctctatgctcaggagtattccacagtggctcagtggcatgaataatagg

SEQ ID NO: 11997 - DNA, 201 bp, Homo sapiens
gaagctgggtaaagtcatttagtttattttgaagcctcagtatccttatttgtaaaatgtagacaggttattccctgtatactcacaaacttgtgctaagrctcaaatattctcatgtttgtgaaattagtttgaaagtgatgcagttgggaacgattactggataggttggaaggttgtccaactggtgcccctcatgat

SEQ ID NO: 11998 - DNA, 201 bp, Homo sapiens
ctgattaaataccttctttgtgtagatccttatataacatagagacagatataatccttctaaatggtctcgtaattttgtataaacccgagcagataatwgtattgggggatataggatttagagaaatttattctgataactatgagaagaaatttataggtcagtgtggcattatattaatcctttttcatcttatca

SEQ ID NO: 11999 - DNA, 201 bp, Homo sapiens
ccaaaagcttcctggtatcaaaatccaattgttgaaagcagagagaacatgaataagttcatatggaaggattttatggactaagactaaaagtagtccayattaattcagttcacattccactaaccacatggacacccctaacttcattggtgactaagaaatgtagtctagactattcccaggaataagaggaaatgg

SEQ ID NO: 12000 - DNA, 201 bp, Homo sapiens
tggccaacatggcgaaaccctgtctctaccaaaaatacaaaaattagccgggtgtggtggtacacgcctgtaatcccagctgtccagaaggctgaggcagsggaatctcttgaacccaggaggcggaggttgcagtgagctgagattgcatcactgcactccagcctaggcaacagagtgagaatctgtctcaaaaaatta

SEQ ID NO: 12001 - DNA, 201 bp, Homo sapiens
acaaagtagacattttcctctcccctgcttttcctgccacagccacacttcagcttctcaaggggaggggactgggtcattgtcatgaggtgatcatggastttgaaagatcttcaagctctacagccgtggtcttgtcagtttgggtgatttctgaaaggcatcttctctgatttagatttttcaacggagagacctggt

SEQ ID NO: 12002 - DNA, 201 bp, Homo sapiens
actccaaatcccatttgtaaaaactagcaaaagtgtgtaaattatgcattaaataagttgtaaggcatatgaattatatatgttcacaatgtaaaaaaaaraaaaaaaaaaaacaggtgtctgctggtctagtacagtaagtgtgaatctttggcaaatctgcacagatcattttgctcaatagtttcaaactctgagcac

SEQ ID NO: 12003 - DNA, 201 bp, Homo sapiens
acaaccagaaaggacagtgcaaatggccctcaaagcttgagcttagcaactgctcccctgttcttagtcttgccactgtgtggaatttaggacttatataygcagatagtttgttacttgcaaaccattagaccaagcttgtcctacccacagcacacagggcgcatgcagcccaggacagctttgagtgtggcccaacac

SEQ ID NO: 12004 - DNA, 201 bp, Homo sapiens
cgccactgcactccagcctgggtgacagagtgagactccatctccaaaaaaaaaaaaaaaagattggaagttctggaatacattggagaagatgaaaaggrgattggattagacttgcctaacaagcccatcatggtagccagagtcagacacaccaacagaaataaagatttcgctaaaaggcctagtagtatttttttt

SEQ ID NO: 12005 - DNA, 201 bp, Homo sapiens
ctgatgctccatcttgcaatctggagttattagcatcaaagaacaaaagcaaacagcaccagggctctggggctcagtcctctatgaaggtagatgaatgracccttatgtcggggataaagctaacaccacccggccttttatggagacaactcttcctgtgtttgaagagctcagacactgagagccagaaagagccct

SEQ ID NO: 12006 - DNA, 201 bp, Homo sapiens
gtatgtactaaagagggtatttttgaaaattacatgagataaaacagcctagaatgctatctgatgcaatagtcatccagtaaattttaatatcattctaytttgaaccaggttgtttatattaaatttaacagaattaagcaacatacagtagcgatttattctgtgggctctggagtctgcctgtaagggtttgagctc

SEQ ID NO: 12007 - DNA, 201 bp, Homo sapiens
gcatgttctcactcataggtaggaattgaacaatgaaaacacatggacacaggaaggggaacatcacacaccggggcctgttgtggggtggggggaggggrgagggatagcattaggagatatatctaatgttaaatgatgagttaatgggtgcagcacaccaacatgccacatgtatacatatgtaacaaacctgcacgt

SEQ ID NO: 12008 - DNA, 201 bp, Homo sapiens
tggctggatatgaaattctgggttgaaaattcttttctttaagaatgttgaatattggcccccactctcttctggcttgtagagtttctgccgagagatcwgctgttagtctgatgggcttccctttgtgggtaacccgacctttctctctggctgcccttaacattttttccatcatttcaactttggtgaatctgacaa

SEQ ID NO: 12009 - DNA, 201 bp, Homo sapiens
tcccattaacttcctgcatcaaaatgaacatttttcccctttgccctagttgatgaaattaacaacataattttttctcttttaagtcacatctttaaggrtatgaggataaggcagagggtcaggagagttagtagtggtcttgaactcctgacctcaggtggtccgcctaccttggcctcccaaagtgctaggattaca

SEQ ID NO: 12010 - DNA, 201 bp, Homo sapiens
ccaaacagtaccaaagagtttgtgaaagaaataattgtcccaaaggaaaaacaatgagcttatgaaaattcctttaagcaagagggaatttgagtgtgtcygtggaagctttatttttaggtcaattttagcgtctacagcattgcgtattctaccactaatcatctttttccttagcggaagtatcctgaaatttgatga

SEQ ID NO: 12011 - DNA, 201 bp, Homo sapiens
actgttggaacaaagcaaaatatttaagttcctgtcatcgtcccactgtggcttttgatcatttctttcagtagccagtttagtttaattatttatagaargacattcatagtgctagaggaaatgtcctataaagcatttatcaaagaatgagtctttgtaatctgagacatccccagagcaaaagcaaagtatctgggc

SEQ ID NO: 12012 - DNA, 201 bp, Homo sapiens
ggcagatcacttgagatcaggagttcaagaccatcctggccaacatggcaaaaccttctctctactaaaaaatacaaaaattagctgggtgtggtggcacrtggctgtaattccagctactcgggaagctgaggcacaagaagcagaggttgcagtaagccaagagcaggccactgcactccagccagggagacagaagga

SEQ ID NO: 12013 - DNA, 201 bp, Homo sapiens
aggaaaaaaaaaaaccctggaaggagagcttaggatatgactaaattgatgcaatctcatgataaaacttgtatggatgaggagttgcttcttatggattygcaataaaagagcagtttcttgagatggaatccactcttggtaaagatgctgtggacaatgttgaaacgacaacaaaggacttagaatattacataactt

SEQ ID NO: 12014 - DNA, 201 bp, Homo sapiens
ctcttaggcttggcaattggcttagaagttatcctcaagagagaatctttctttttcttttcttttctttttttttttttttttttgagatggagtctcastctgtcacccaggctggagtgcagtggtgcgatatcagctcactgcaacctccatctccggagttcaagtgattctcccactgcaggatcccgagtagct

SEQ ID NO: 12015 - DNA, 201 bp, Homo sapiens
acagggtcctgaggcgacatacatcctcctcagcttatgaagatgatgggaataagagattaaagtaaagacaagcataggaaatcacaagggtattgatkggggaagtgataagcgtccatgaaatcttcacaatttatgttcagagattgcagtaaagacaagtgtaagaaattataaaagtattaatttggggaacta

SEQ ID NO: 12016 - DNA, 201 bp, Homo sapiens
cttatttacatccaaatgaattcccaggagagttttccactgatgccgactggttaacagaagtacaggcgagcaggaatccctcgctacctggcctttcrttccctggttccatctggatctctgggaaaattttccatctttatttgccataaagtatgatttatttatttcaacgagtggctaagagccctggaatgc

SEQ ID NO: 12017 - DNA, 201 bp, Homo sapiens
actttaagttttagggtacatgtgcacaatgtgcaggttagttacctatgtatacatgtgccgtgctggtgcgctgcacccactaactcgtcatctagcaktaggtatatctcccaatgctatccctcccccccgccccaccccacgacagtccccagagtgtgatgttccccttcctgtgtccatgtgttctcattgttc

SEQ ID NO: 12018 - DNA, 201 bp, Homo sapiens
agtgcctagcacatagacagccctcagtcaatgtcagctggtgattttattaccttcatatatgagaggataagagtattataaaaatcaaccccaaaccyttcctcttgtcacacagaaggaaggcagacagacacagaagggacgcagctgcaggtgtttctgactccttgccttgctgcctccccatttctgagggtc

SEQ ID NO: 12019 - DNA, 201 bp, Homo sapiens
acgcaagtgcctgctgaaactcaagccttctcatcccccttggataatagaagtggggcgtcagtctgcctctgtctccgtgtctgtatgggaaacatggrggtcatggcatatatgacaagtgcacatgtgctgttccattcccacaaggagagaaacatggggagtagcctataattctgtgtctaccagactcctctt

SEQ ID NO: 12020 - DNA, 201 bp, Homo sapiens
ttttttcccttcaaaatacatataaagaatttaaaaatacatataatttttgacttcaggaatgtatgtttgtttacaagtaattttattgcaaaatatcragaatgttctgacctctatgtgaatggatgtacatatatctccccaaagtggtctatgtcaatgtcagataaaaagtcattcatgtatttcagatgagat

SEQ ID NO: 12021 - DNA, 201 bp, Homo sapiens
gtgtgtgtgtgtgtgtgtgtgtgtagacacagcaccatttttggtgaggatggcacaggggctctcaaaagaaggagttctcagaatcatagcaccaaaamgttgtgagtttgcaataatcagagtcatggtgagcatcatggaaatttagaactaaaagagatgttacagattatctccagtctgagtccctgccacaca

SEQ ID NO: 12022 - DNA, 201 bp, Homo sapiens
cctacattatgacacactaataagtggtctaccttgacccagagatacgaattttggcctcatttgtagaatagcacctggattcaggaataactccttgmagtgtcccccttaaatctctatgtggcattcaatgttcacttactcatagaccaaggagataaggacatttatcttctcaggtaaggtccctctgttgaa

SEQ ID NO: 12023 - DNA, 201 bp, Homo sapiens
cagcctccccagtagctgggattacaggctcatgccaccacacccaggctaatttttctatttttagtagagacgaggtttcaccatgttggacaggctgstctcaaactcctgacctcaagtgatttgcccgccttggtcaattaaagtgttgggattacaggcgtgagccacagcacctggccgccacaaacttttata

SEQ ID NO: 12024 - DNA, 201 bp, Homo sapiens
gtctgtaatgctttgttctcattcctgcatactgaaactcttcctgcaggtttttctctctggcagccatccccagttttagctgtggaaactcaagtagrcctctaacaaaatgttctgtggtggtgagaaagctaaggaaaaccagctgctaaaattacagcaagtctctggttgctgttgcttggtttctttccctgt

SEQ ID NO: 12025 - DNA, 201 bp, Homo sapiens
ataaaatctgatgctccaaaaattgaaaacataacttaccattcatctctgaatgtatccatgcattttttttttcattcaagttacatttttaaatgatktgcaagttctatagactgggtaacagtgtacataacacttaacaactaactaaaatcagtgaaacacatatcaatataaacaaagagctatggaaattaa

SEQ ID NO: 12026 - DNA, 201 bp, Homo sapiens
ctcaaacaaagaaatattatttggaagatgtgatttgatgttagtatttaatcaaatgtacttatttcacctacttgctgaataagcacccttctttactrccatcactggttttcatattgaggtatgtggatttatcctttatcattgctcacctttgaagatggtggcataattaaagaattacaaggggatttcaga

SEQ ID NO: 12027 - DNA, 201 bp, Homo sapiens
ttctgttctgttttttccccatctttgccaagatggccgaataggaacagctccggtctacagctcccagcgtgagcgacgcagaagacgggtgatttctscatttccatctgaggtaccgggttcatctcactagggagtgccagacagtgggcgcaggccagtgtgtgcgcgcaccgtgcgcgagccgaagcagggcga

SEQ ID NO: 12028 - DNA, 201 bp, Homo sapiens
ctcagagcctttgctcttgttgacctgagtgtcccatcccagataccgttgtatggcccttccactcaatcctttcccacctccctccaaatgttaccttrttaatgaagacttccctagctcattctattttatctgcctttcttccttatcccacctccctgcagttccttctcccttaccctgccttactttttccca

SEQ ID NO: 12029 - DNA, 201 bp, Homo sapiens
aacatagacagaggaaatggttccaggcagaatcaatggaattgaaaaaaatcatggtacttctgtggaacaggtagttggatgactgtaatgcacagggraaaaggtagacacaagttgacactggagaagtaggaggggatagagcaagaagaacttgacagaccgaggagtctggattgcttccaggacaataatcta

SEQ ID NO: 12030 - DNA, 201 bp, Homo sapiens
ggataaattccttgaaacatacactctcccaagactaaaccaggaagaaattgagtctctgaatagacgaataagaggagctgaaattgtggcaataatcratagcttgccaaccaaaaagagtccaggaccagatggattcacagccgaattctaccagaggtacaaggaggaactggtaccattccttctgaaactatt

SEQ ID NO: 12031 - DNA, 201 bp, Homo sapiens
tcattttacactgtgatcacaatttagagatgctattgaatgggctgccagtgtttgctttgtaatgttaggggcactcttttttctagtcttaaggcatrggttacagcacataacagaaaccatgcaggaaagacaaaaagaagaaagagagggagggaaggaaggaaggaagaaaaaagaaggaaagaaggaaggaag

SEQ ID NO: 12032 - DNA, 201 bp, Homo sapiens
tgcgtgtgcctgagcatttattgtacaacagatactgtgctaaggcttttataagctttgtattgcttaatgttcatggcagccttgggaagaaggtactrttagagtaggaatgctactataatcttccaactgggttgacattaattccttaacctgctctttttgacttttcttcttcaacccattgataatctaatt

SEQ ID NO: 12033 - DNA, 201 bp, Homo sapiens
gtttatctcatcctccttgacttctccacatctctaagtaggaagttatttattgctgctgaagttgtaaccctggtgatttcgctatcaacttacaaatmacttcctttccatatgactacagcatgtaagaatgctgaggttttcttttctccaaataaggcagaatgcttcaagaatattttatcgtcctatatggat

SEQ ID NO: 12034 - DNA, 201 bp, Homo sapiens
tgtatgccgagtaggaaatgttcatctttattccgaaggcaatggagggatccttcattgaaagccttctgagcaagggtgtaacatggtcagatttaagkcttattaagattgttctaggatcatctaggggatacagtgaagagaactttactgaattcaggcaaggcaaagagaaagctattgcagtcaacctagcat

SEQ ID NO: 12035 - DNA, 201 bp, Homo sapiens
cttgagagtttcagtaaggaaagtgaggctcacttctttctggaacattaaacttaagcaggaaggtgccacatgaagtattatatcataatggaagcaaygtaaaaagaagagtgagtcacttcatcaacttcacaatgcaaaggtgctaccataagtcataattctaatacaaagatttatataaataatgattctggg

SEQ ID NO: 12036 - DNA, 201 bp, Homo sapiens
agtataagtggataatgatttttttaaatcataagagcgccatgttgcaattgttattatcaccccacctcactgtgtgtgtgtgtgtgtgtgtgtgtgtrtgtgtgtgtgaagttaaatgatctttaatagtggtttgttaccaaaaaatccatgtaagctcaagtcacctaaataaaaactactgtataagaaggaggc

SEQ ID NO: 12037 - DNA, 201 bp, Homo sapiens
gtaaaggttacagaacacaatatagactacattatcattaaactacttgatagtcttatgactatttttatggtaatgaaacgtaatccaatgcaacttcrtatatgtaagtaaaacttcttaattcttgtcttgtaaaactgaatcttcatcctttgactgatcaactgaccagcttaaaccttggagaatcttaaactt

SEQ ID NO: 12038 - DNA, 201 bp, Homo sapiens
tcctttggaggaggagaggcgctctgcgttttagagtttccagtttttctgttctgttttttccccatctttgccaagatggccgaataggaacagctccrgtctacagctcccagcgtgagcgacgcagaagacgggtgatttctgcatttccatctgaggtaccgggttcatctcactagggagtgccagacagtgggc

SEQ ID NO: 12039 - DNA, 201 bp, Homo sapiens
gggtcactcacttgagaccaggagttcgagaccagcctggccaacatggtgaaaccccatctctactaaaaatacaaaaattggtcgggagtggtggcatrtgcctgtaatcccggctactcaggaggctgaggcaggagaattgcttgaaccctggagttggaggttgaagagagctgagatcgcaccactgcactccag

SEQ ID NO: 12040 - DNA, 201 bp, Homo sapiens
tgtcttccaaaagcttcctggtatcaaaatccaattgttgaaagcagagagaacatgaataagttcatatggaaggattttatggactaagactaaaagtrgtccacattaattcagttcacattccactaaccacatggacacccctaacttcattggtgactaagaaatgtagtctagactattcccaggaataagagg

SEQ ID NO: 12041 - DNA, 201 bp, Homo sapiens
atctgaaaacaagacaggctttattacctactttagagtcatttcacaatggaaggtagcatagcttgaggaaagtgtttcctccacagtgatcagggtgytttggccaaatttgttgtatttttcagtagtaaggctatagcatagtgattcagtgcatgcacttggagctagattagctgggtttaaaactttgttcat

SEQ ID NO: 12042 - DNA, 201 bp, Homo sapiens
ggccattacataatggtaaagggatcaattcaacaagaagagctaactatcctaaatatatatgcacccaatacaggagcacccagattcataaagcaagwcctgagtgacctacaaagagacttagactcccacacattaataatgggagattttaacaccccactgttaacattagacagatcaatgagacagaaagtc

SEQ ID NO: 12043 - DNA, 201 bp, Homo sapiens
atatggttttaacattattactttattggcacgaactttcctccattcttgtaatgacttgacagtctctttgtttgtggcaggagctgctttttttttckattatttggggccgtcttactctttccctgttttataggaaaagcttttagttttttgtttcctaacattggggtgtggactattactcacaagctggct

SEQ ID NO: 12044 - DNA, 201 bp, Homo sapiens
ggagggaaagtatgtgcttgtgtgttggggagtatatctttggtcttcatatgataggtaggagggagcatctgaaaaaaaaattatgtgtagacctcacrgatgcttatgggttgaaactggctttagtgactggtctacttcctcagttttacagattataaagtaataataataatagcaatatttgaacttaactct

SEQ ID NO: 12045 - DNA, 201 bp, Homo sapiens
aattttatttacaccaacacatatattttgaagagatgaatgaccaattctgggaatagttagaagtaaagaatttgaattttctgcagcactgctgcacrttaggtaaattcctctctttgggcctcacttgcaacaccaataaagagaggaagttatactagatgatctataagccccttccagccctaacatgctatt

SEQ ID NO: 12046 - DNA, 201 bp, Homo sapiens
cctcatgcatatggctgccaacgggagttagtgaaataatgtacatgaaatatttaacactaaacttggtgcctaatgtatcttcagtaaatgataactaytgtcatagtcatcattgcttttatacttttcggcttccagtgatttccagtgactacagccctaaggccattgggggatatcttttttataactgaattt

SEQ ID NO: 12047 - DNA, 201 bp, Homo sapiens
atttactggagctcctccccaaacccctaaactatgtgacattcttgctttaaaaaaaaatggattatacagcacgtgtcaccactgcattctcttttttrtgttgttcatgtgtgtctgtgaaatgtgccttctaataaaaatttgaggatcttatacttttccagaatcattttgttgaagtcatgttttggagtacat

SEQ ID NO: 12048 - DNA, 201 bp, Homo sapiens
tcttctgaaagattcataagtaattctctcctccagaaacttgggaaataaatgactagtgctcttatgagaagagtgaagagatgtgtcttgcttaacarcactaaatattctcccacttgctcactccctgtgttttttctttagattagaatagcgactgagaaacaataaccacagcagcaaaccatttcaggcaat

SEQ ID NO: 12049 - DNA, 201 bp, Homo sapiens
atatacaatgattttcaaagagggtgatttttcacccctcttctctccctgccccacatacaaaggagactttgcctatgtctggaaacatttttggttgycacaattgaaaaggaatgtatggaggtgttgctgttatccagtgagcagaggccacagatgctgctatacattttataatgcacatgaactctggaatat

SEQ ID NO: 12050 - DNA, 201 bp, Homo sapiens
tgtgaggacagtgaatcctaattcctcttcttcattctttctgtgacctttttgattttgcctctttagtaatctcctcactgcccttgtaatgcaaaaamtaagaataaaaatggtctgtttgggtgctgtgagtcttggcaattaaaacttcacatgaaatttgtctcctgagagaaaatattattctcccttttaata

SEQ ID NO: 12051 - DNA, 201 bp, Homo sapiens
gtgctaatctagttgttgctggagagcatccaaacctaaggcagaactcttgctccttggattgttaggcattagattggcagggtcttggactctggtamattctgcaggcctaagggagactggtcatccagccaggtgtagggtaaaggaattattgggaaatatacagtaagggaggcctgtgaggtcagtaccttg

SEQ ID NO: 12052 - DNA, 201 bp, Homo sapiens
tgtactgcagcctggggacagagtgagactccatctccaaaaaaaaaaaaaaaaagccatgctgcttaaaagatgtaattttcagaaaaattgtgctacarctaggatgtgatatttaattatttgagacatgttctataatcacaatcaccactgattagtagtcaaccatgttgaagttatagtacctgtgaggaaata

SEQ ID NO: 12053 - DNA, 201 bp, Homo sapiens
aggttttttactgactgcatattgaaatgaatatctaagagctaaatattttttcctaaagttcatcatgtggcaaatgtgtcacaccctccagggaaaayataccacaacatctggagacactgctatagggtagtggttcttaaactttagtgggcatgagaaacactggcagagcttctaccagaaacactggtagat

SEQ ID NO: 12054 - DNA, 201 bp, Homo sapiens
gttctgaaaaccctaacctagatataccttcagccaaaagagagacatgctaccatggttatcatccaaagccactctgtagaatatagcccaaacatcaytgtgtattaaaacatttctctttactgttttcacataaatagattaatttatacagatttgtatttatttacatatttgtgtatatgctgcactaaatcc

SEQ ID NO: 12055 - DNA, 201 bp, Homo sapiens
tcatctttctctgcattgagcctttgcgtactaatttatagctattttctcacaggatagtctatttccattatatctatattttctagtggtcctttgcrtttgcctcttttccagactgtatagggcatggtgccaggcacagtttatttgttttattctatatgctgatagtatcatcttttccatctttagatgttt

SEQ ID NO: 12056 - DNA, 201 bp, Homo sapiens
ttgtgtctccaaagaacattttgctaagtgccagagctgtatataacactaaagtagatgctgacatatgaggattgtgagagatgaatggtgatatttgrcttttgcttcccaagtataggtcgtgtccgaggtatagataattgttgttggtttatgataattcgacttgcggagttaggtcagtcagcatagatgcat

SEQ ID NO: 12057 - DNA, 201 bp, Homo sapiens
tattaagtttaggatcccgtggagaggcctatcatccgagagaccatcctatcatcaaaaggtgaatatcaggtcaaagcaaaagaaaccacattaatttktttctgttgtcagctcacaaagctattttaagcctttggacaataagaaatatactttttttcccctccaataaatatacattatccattaaagtagagt

SEQ ID NO: 12058 - DNA, 201 bp, Homo sapiens
gaatctgaccactgtgaatatctcaaggataccataagagctgatggacctccaaacgttagcatcactggactgagagaaagctcgttttatatctctayaggtactgtcataccaatgaagcaatgttcccaaactactatgtttgtgttagtcattttccgcttatcttgtccccaatcataaaaattaagcgatgta

SEQ ID NO: 12059 - DNA, 201 bp, Homo sapiens
tatcaaactagttgacatggtcaccacatcctttactcattctcttttgctaattactttcctttccaggtgatctctatatggctggtctggcccaaggsatgtacagcaacctcccaaagctcgtggcctctcgagatggctttcagggctgtctagcatcagtggacttgaatggacgcctgccagacctcatcaatg

SEQ ID NO: 12060 - DNA, 201 bp, Homo sapiens
cccgtctctactcaaaatacaaaacattagccaggcgtggtggtgggcacctgtagtcccagctacttggaaggctgaggcaggagaatggcatgaacccrggaggcgcagcttgcagtgagccaagatcgcgccactgcactccagcctgggtgacagagtgagactccgtctcaaaataaataaatacataaaataaaa

SEQ ID NO: 12061 - DNA, 201 bp, Homo sapiens
tgtctacatacacatacttaagacacacatagagagagagtgtgtgagagagaatcaactcatcataattgtaaaggtgaagaaaattgattccttaagaytaaaacacaccatattaaacttggagtttatattttgaaaataagattcaggaagtcttctaaagcattcgaagattgattagaaagataaatttcggca

SEQ ID NO: 12062 - DNA, 201 bp, Homo sapiens
tgccatgtccgtgatgtagttgcttatctaattttgtaatcttttatcaattccctctacagcttgaaggccaggctgagggtatggtacagaatactaartggtttcaaatcaagtccaatctctgttgcaatttttattgtgataacaagatatattattaataacaataaaagacaataataatgtattattatattg

SEQ ID NO: 12063 - DNA, 201 bp, Homo sapiens
taagagctacaatatcattggatgaagaagaaaaatttctgaacagaagcatagctcccaaccatatgttttccataccagcatctatacaggcaccaaamatcatggatgttcttatagccttgtgcctcacggcgtgaattgctcattgatcatttgaactcgtaacaatggaaacatcagttttaccaggcctcctgg

SEQ ID NO: 12064 - DNA, 201 bp, Homo sapiens
atggtaaataataaaacattctataaaccacacatcccatctaggactaatcattatattttccaatttaacattcattccttccagatatgttcttactygttctttaaaactatcataaatggaaagctaccatttaagcacaaataaaactcttaagaaagctaagaaaatctgaactcattaaatatttctaactag

SEQ ID NO: 12065 - DNA, 201 bp, Homo sapiens
ccagaatgaagtaaggctacaaaatgtcatttatggggatgggtgaggcttaagtctcctggaaccatcttgggtcactcagctctacggaagaccccccyaagacggtctagacccagagtcattctcagtcacacagtagttaagaattcttcatcctacggtatgccctctctagaaaaataatcgtaatgatgggag

SEQ ID NO: 12066 - DNA, 201 bp, Homo sapiens
ccttgtggtaagagttgaggttcccagccactatcatcacctattactcacttacaagaatttatctttactcagtcctttacttgatcatctcgaaaacygttacaaccacagcaattataatcatagcagcaacaataaagactagcaattattgaacacttaatgtgaacacatgtgaaatgtgtgtctacatggtgc

SEQ ID NO: 12067 - DNA, 201 bp, Homo sapiens
ccaaacagcagtctttacaagcccatgggtgggatagtaagaccagcttgtcactgtttgtgactctgcttctgtacctcccagtctgtgtgacatcttcycccatggggagccgtttctactttgtctttaattgctcctcaccgaggcgacttgtcagccaaggctgctttctgtcacttgatgccacatctcttccta

SEQ ID NO: 12068 - DNA, 201 bp, Homo sapiens
atttttagtgctcaatatatttaaaccagagcttctcatccaatataccacactcagggcttttggatagaccctctggccatgaacaatcttgtcttctyctctcagtctcgacaaatatattatttgctttttgacctatcatttgaaaaatattgggaaatgtcactttaaggaatatgcactagctctttactatga

SEQ ID NO: 12069 - DNA, 201 bp, Homo sapiens
ctgccatttcctctgcctgcaacagcccttccctgctattcacagtactcactccctcacttcacccaggtttccgcttatattgcaccttccagaaaggwccttcttgaccgtctgtaaaatacaacactctatcgccttttcctgttttgttacctctcatagcacttatcactgcctgacattatagctcacatttat

SEQ ID NO: 12070 - DNA, 201 bp, Homo sapiens
caattaaagtgttgggattacaggcgtgagccacagcacctggccgccacaaacttttatatgaccggatctcactgtcatgaggacagcaccaagccacragagatccaccttcatgacccaaacacctcccaccaggccccacctccagctttggggattacagttcaacaagagattcaggcagagacaaatattcca

SEQ ID NO: 12071 - DNA, 201 bp, Homo sapiens
cagtgtgataataaacgtaaaagtactttgaatattgcaaaacactgtatgaatgtcaggaattaggcaggcaacaactatttcttgggggtttgttctgyatgtagccctgcactatgtgtagatagaggcctctgtacattacagaagactggcagaggcattggggattcatcatggctggaattctggttctcagat

SEQ ID NO: 12072 - DNA, 201 bp, Homo sapiens
atggtcaatacaactactcttgaggattaggatggttttctcagtaaccgatggcttccctttaatgatataaaccttctcagggtctttcctaagcacarttctagattcatatttgggccagaagtccacactcaatctccccattccagtccatttcctatgactttgtgtcattggcaatgtccgctacgaaggatg

SEQ ID NO: 12073 - DNA, 201 bp, Homo sapiens
actaaaaacacaaaaattagccgggcggatgagggttcctataatcccagctacttgggaggctgaaacacgagaatcgcttgaacccaggaggcggaggrtgcaatcagccaagatcgcgtcactgcattccagtcctgggcaacagagtgtgaccctgtctcaaaaaaaaaaaaaaaaaaaatcttatgataacatgaa

SEQ ID NO: 12074 - DNA, 201 bp, Homo sapiens
gtatacctaccactcagcacagctcttggtacctaaggagatggtgattggagacctggaaatgaagaccaaagagatgctgagatggttgtagtttccartaggaagattagcaaccaggcaagtggcagatcagagcccaaatgtgagtggctcaactgctggaccctgtaagctgttgtggttctcaaatgatgtcct

SEQ ID NO: 12075 - DNA, 201 bp, Homo sapiens
tatatcacagctgccttaccgtatcagaacaaagagaaattctttttttttacagctctgtcatatttcattgaatgaacatgccttatttacttaactgytcctttactgtttgcagttacaaataatactgcaggtaacctcaaatatgtttcattttttacgcatgtttgagagtatgtgttgaatacaatctcagaa

SEQ ID NO: 12076 - DNA, 201 bp, Homo sapiens
ttttttaattttcaatgcataagtctttaagtgtactgtttgatataccttataaattatgctatttaggtcaattatagtcttacttttgactacttcayctatcattgaataagcaagatgatttaaagtgtcttatttctgttttttggctgaatgtttcttcagataactcttaagttttctgttttttgaatgtta

SEQ ID NO: 12077 - DNA, 201 bp, Homo sapiens
actgaggactttgtaggtgatggagccttttcacgtttttgaggtttgtggagttctttggaagttttcaggaccatttcataggaggggcttctaggagrccagagtcaaagtgcggagaccaagagtagctttctatctgaccttctgccctttgtgttgatgggggcacaggtagtgcaggagaaatctatttaggtg

SEQ ID NO: 12078 - DNA, 201 bp, Homo sapiens
tgtgtatttcaactggaagatgaaattcttcctttcccaggtcatttttgggagggttatcaagccactttcctctttaaaatgcaaattgaacaacatgrctttttttcccttttctctcttttccaaattcctggtcaccctacagacacttttggcttctgcaaatttgggggcccaccctcttcccccttcagtatc

SEQ ID NO: 12079 - DNA, 201 bp, Homo sapiens
cttcctggttccatttattctcttcctcctccaaagtaaccactacctgaagttgatggggagattttctgtatacatatttcttattcttgttacatacraatagagctgtagtatcaaataattagtgatcactatatagctatgtgtatgtatgtgtatatatatataaattagtgggggtcaattttatcagcccct

SEQ ID NO: 12080 - DNA, 201 bp, Homo sapiens
ttgagtcaatataatgtttaaggacatgagattctacagccaaatagaaggatttctattgctctttggttttgacatttaacttgaaaagtaacactaakaatgactaatctataatctaagattatataagtatatgtataattacatataattacatattttatattgtgtatatatgcatatacatggatggaactg

SEQ ID NO: 12081 - DNA, 201 bp, Homo sapiens
tgtctttccggacagatgtgaagcttacctctcttgctacatgcaaagtgaaaagggagcttggcccctcggcttgcatgggtggtttttgggtgaaggtrgaactaagtgctcagaagctgagtacctctggggcttgcatgaacttgatagtcatgcaagagcacattgcattgtgtgtgtgtgtgctgctaacactct

SEQ ID NO: 12082 - DNA, 201 bp, Homo sapiens
gtatgtatccctgctgaactccatgtctgtaaaatggggctaatgctacctatttcatttgcttattgtgtatgatataaaacagtgtttgcaaagtaccyggcacatggtaggctcttttcttatattgttccggctctcagcttgctttactcctggtattgctcctgtgtgtctctgtattaaagatcatggaggaat

SEQ ID NO: 12083 - DNA, 201 bp, Homo sapiens
ggtatctttcagatatagggtagaaattctctctgactaaatttattggtatctggtttatatacacatagctattctgtatgtatgtgtgtatatatatrtgtgtgtgtgtgtatatatatgtatgtatgtattttctattttgtgagtatattttatatgtatatattatgtatttggtttttattggaagagagtctt

SEQ ID NO: 12084 - DNA, 201 bp, Homo sapiens
agcgctttccaaaggtcatacctcccaacactgtggcatcggtgatcaagtttccagcacatggaattttgggagacatattcagagcatagcagcagaayatatttgcagcagaatatattccagggataagggaagaggacagggctctgcctaccgatgtgcttcaacaagggattacatgggggcaaagcttcattc

SEQ ID NO: 12085 - DNA, 201 bp, Homo sapiens
ctgtgcaaggctgttcagacccagtcaggtcaggccctgaatccttgtgatatggaatgagatatgataaattggaaattgtctttaataaattgccattygtgataattctagtgataattaatctgctgaggctgctataaaatatcatagactgagaggcttaaccaatgtatttccacatagttttggaggctggaa

SEQ ID NO: 12086 - DNA, 201 bp, Homo sapiens
aatctccccgccagagataaccaatgggagaattttgatatctatcattccagcttaatttctaagcatctgcaatccagggtgtgttattttgtttttaragaagttcattcactcatttaacaagtactaattgagcgcccgctcgatgccaggcactggaatcacattttggaagctgtcacactagcctgatttttc

SEQ ID NO: 12087 - DNA, 201 bp, Homo sapiens
tggtggacagtgactgtcatcagagaagtaaatgctatgtctgcaaaaaagaggtgagggcacagtgatgcgtagagacccctggctttaattatcccatsccttggtgttactggtcctctggagatctacttaacaggaagtagtgagctatgtccccacaaaagcatcccagaggccatttctgagcaggatggcctg

SEQ ID NO: 12088 - DNA, 201 bp, Homo sapiens
gttattaattaaacttactgtttaggaggatgatggagaaacccaggtcctggcaaaaacggtcacactactttaaagtttgggactaagaaggaaatgartaggatatcatgaaagtaggctctgtgattttcttagtttgtagggagatggtagaacttagtggttaagcacttgagctttgagctctgaaagatgtga

SEQ ID NO: 12089 - DNA, 201 bp, Homo sapiens
ttaaatggaactagttttcgagggtctgcttgtctccatgaaaagagaatgtatccttctgaaagtccttttgtttaaaaatatgatcaggctctgaaagmattttaggtcttgatactaactaacagaagacatgcatttattaaaaattgtatcacaaaggggtgaactggggcctgattgattgatgttgaaatttga

SEQ ID NO: 12090 - DNA, 201 bp, Homo sapiens
taatctctgaggaatctcttcaaacagctttctgccaatgtatcactgaagccttttgagaaataagtgctgttccagcttagtcatatctcaaggcagcrtggcatgggaggtggagactacgagtaattaaaaataactcccagctcaagcagggagagggctgtccctgcctcatctgtattcccatcacaggctccc

SEQ ID NO: 12091 - DNA, 201 bp, Homo sapiens
aaacaaaacaaaacaaaaccttccttcatgaattattattggccttgtatgcaagactgagttgatcccagtctcaatttacctgataccatctatttcarcaataacaataataacaacaataatgaatatttatttagagctttctctgttccaagcactgttctgaccactttatgtatatttacttggttgactcta

SEQ ID NO: 12092 - DNA, 201 bp, Homo sapiens
cctcaaactataagcttgatgaattttagagttcattgtaatgcttttggtttaggtgacaaaactgatgcctacaaagataaactgatttgctgaaggtmatggacctagtctttattggagttgtaattcaatcccaggtgtcctaaatctttaatccatgccattttattgatattatatattaagattttttttatt

SEQ ID NO: 12093 - DNA, 201 bp, Homo sapiens
tgcaacacaacagtcgtgcgatggcctttcctacatgccacacggatgcagccttctgataggagggcaaagtcggcacatccacacacacactggcataygctcttgcacacacagtctctgtcacatacacaggcgccaagggcttcattttgcttggtttcattccccttaacctctttccccactctacctccacca

SEQ ID NO: 12094 - DNA, 201 bp, Homo sapiens
ctaggcctgcctctaccccacacccacaggggaagacacctgctgacccctgagctggaggggtgctggttctggcctggagagaaggaggagatgggatmatgcacagcctcactggtggaggcgggatgttcagaaggagttacctccttcccccgtggagcaggaacatgtgcactgacaacatccccctacatctgt

SEQ ID NO: 12095 - DNA, 201 bp, Homo sapiens
gtagaaggcctcagcatctatacaagttagtaggataaaagctatcccatactcagaaaaaaatttcaaattagtatcatggttaagagcaacttgtctawcctgtggcccatagggcacatgtggcccaggatggctttgaatgtggcccaacacaaattcataaactccttaaaacatcgaggtttttgtattgttttg

SEQ ID NO: 12096 - DNA, 201 bp, Homo sapiens
agcaattcagcagaagtccaaaggtccagtgcagcagtacatgtgacaggtgatgttgcctgcatacacaaaattaaatggaactagttttcgagggtctkcttgtctccatgaaaagagaatgtatccttctgaaagtccttttgtttaaaaatatgatcaggctctgaaagaattttaggtcttgatactaactaacag

SEQ ID NO: 12097 - DNA, 201 bp, Homo sapiens
ttgcctgctagatttcaaaatgacttctcagagatggtgagttctgagctgggtggtgaaggatgtgtaggagtttgtcagataaggagatgaaacaggcrttccaggaaaagggaatagcaagttcagagacttggtatagtcctaaattatgtttgtcttcatttcagctagtgctatttcattgttgctggagataac

SEQ ID NO: 12098 - DNA, 201 bp, Homo sapiens
cgggaaccaagctgtagtaattattggttttttggctttccctcctgtagcacatacataaatgggaataaactgggtgagttcctgaactctttccgcarattaagaaagtcagaactttggaagaaaagtagggtacaagatacaaaatcttgctagtgattataactctaaacgttatagaacctatggccattttag

SEQ ID NO: 12099 - DNA, 201 bp, Homo sapiens
gttctccaatatctcaggcaaaattcctgggtctagctactcccctcatccttgtcatgcaaagaaccttccccagacttcagtgggagatctattgtttkatcatggggtttggcaggcacttcgttaaggtggtgtgatataattttctggacctaggttctggccctactgtgtatcagtctcttgagctatgggggg

SEQ ID NO: 12100 - DNA, 201 bp, Homo sapiens
attgacatgtatacatggcaaggtactatcttacaactgcaaacctaggctgctgaggaagtgcagcaggcatttggggtaggggtggggacaggattctrccacatggtctccatcacagctttaaaaaaaccagatctttttgtgttcattccagaagctgcacagtttctagagacttgtcttttcacaggaaatatc

SEQ ID NO: 12101 - DNA, 201 bp, Homo sapiens
caaaggattttgaagctcttgtgatagaaaccagggacaaagaccaaatatgtatttcttattatatcacaatatcacaggctgtcgctgtatccaaattycccccttcctgtaaggaaattaaaataaggccaaccctcatccagtatgaccttgtcgtaacttgattatacctgcaaacatcctatttccaagtaaggt

SEQ ID NO: 12102 - DNA, 201 bp, Homo sapiens
catcatcactggccatcagagaaatgcaaatcaaaaccacaatgagataccatctcacaccagttagaatggcgatcattaaaaagttaggaaacaacagrtgctagagaggatgtggagaaataggaacacttttacactgttggtgggactgtaaactagttcaaccattgtagaagtcagtgtggcgattcctcaggg

SEQ ID NO: 12103 - DNA, 201 bp, Homo sapiens
tagtgatggaaaaaaaatctgttccaattactgtataagtaaaatgcttcccttccacctccactaaagaaaaaaatggcactcactgctcaggatctgaratcgacagctgattctgcacatgcaaagccctgctgccatttgtcatttcaggaactgctttatttttgtcaaaatggaaggaaaaaaaaggagagagac

SEQ ID NO: 12104 - DNA, 201 bp, Homo sapiens
catgaacagcacctatgcccctggtacaggagtgcatttctccccaagcctacagtcttctgtgtgtcacagcaatgctgagtttcccacagaggtggcgytgatggactctttctcaactctttgctatggagtatcacctgggctaagaagttctgcttttgcatcaaatttcaatttttttctttttattggatttga

SEQ ID NO: 12105 - DNA, 201 bp, Homo sapiens
caacctccccctactccactggcccctgcagctacttagaatagctagctgttgattaaagggaccaagagtttgagcagttactgtatactttcaaaccycactgccatttggaagtgaagtcccaactgacatagccaaactgtaaggacaaaagcaactctaatacctgctttcctttgtttatagcaactgctcaaa

SEQ ID NO: 12106 - DNA, 201 bp, Homo sapiens
gtaaagattccaatggaccaatatggcttgtgacccatgcttcatttacctaaatgaggccacaaggctctgtgatcacgtggcagtcaaataacaaaacyctccaaaatcaggatttcttcttccattccttcaggttccctcccccatgggcatggttatctcatcctttacctcctggaaattatatattggaggttg

SEQ ID NO: 12107 - DNA, 201 bp, Homo sapiens
tgtctgtgttgctttgcactcttacattgcccatcctttacaacagcccttctcctgtccttctgattcctaaaactcaaaaccagaatgaagtaaggctrcaaaatgtcatttatggggatgggtgaggcttaagtctcctggaaccatcttgggtcactcagctctacggaagacccccccaagacggtctagacccag

SEQ ID NO: 12108 - DNA, 201 bp, Homo sapiens
acaaatgacaagatggaggcccagagagactacatggcttttccaaagttatgcaccacgtttgatgcagagacaaaactagaatcaaggtttcctggctkccagggtagggctctttctactccatcatgctgcctggtgggctgtgggcccttttccaagggtattgcagctgctgctgtgggggctgcctggggtgcc

SEQ ID NO: 12109 - DNA, 201 bp, Homo sapiens
tgaatactttaaaaagctggtggtgaatacgttacaggtggatcacacctgtaatcccagcactttgggaggctgaggcaggtggatcacttgaggtcgastttgagaccagtctggccaacatggtgaaaccccatctctactaaaataccaaaattagccaggtgtggtatccttcgcctataatcccagctactggag

SEQ ID NO: 12110 - DNA, 201 bp, Homo sapiens
cgcttctatccatatttggtttgctagacatgactccatcctacatgcaaaggaagctgggaaatgtagtcggctagtgcacccaggagaagaaaaactgrattagttgatatctagcacatgtaattctccatagtatctcatcatctttaaaattctttcctcactaggaaaaatccaacttttacatttggtttactt

SEQ ID NO: 12111 - DNA, 201 bp, Homo sapiens
tttttttttttttttttttttttgagacagaatctctctctgttgcccaggctggattgcagtggtgcgatctcagttcactgcaacctccgcctcttggrttcaagtgattctcttgcctcagtctcctgagtagctgggattacaggtgtgtgccacacaccacgtccagctaatttttgtatttttttagtagagacg

SEQ ID NO: 12112 - DNA, 201 bp, Homo sapiens
gtagcgaccaatttgttccaatttgcttacttctccagatctctctgtcagactttaagttccttgaatatagggtcctagtcttcttgcccatccttgtrtacatggtaggtgttccatcaatgtttcttgaatgaatgtataaaaagtgtattttaattgaaatcttaacaagtatgcattaaatgtatagttggtgct

SEQ ID NO: 12113 - DNA, 201 bp, Homo sapiens
gtaactctaagtgttttagtttttcagatggcaatttgtgactttctatagctttttcttgagatgaatttgtggaccagttgaatagtgatagaaatacrggacttgctaaaaattacaaagtgtttatggcagttctggcaaatatcctctagatcaccagataatgccaagtcagcaatattatcaataatgagttgc

SEQ ID NO: 12114 - DNA, 201 bp, Homo sapiens
aagcttctgcttatatcacatttgctagtgcccatatgcccaagcaagtctcacggcccacccagaaccccaagggtgaaaagatagattcaaactgttawgagaggagtaagagtctcactgccaagagacagattttgaaatgggattgtagctattttttttttttttccaatttaacacactggaaaagaagaaagg

SEQ ID NO: 12115 - DNA, 201 bp, Homo sapiens
agacttaagaaaggatgtgataggttctcctgaatgccattgccttctctctgtcttctaagcaacttctggttcaaagggagagcatgagctcctggggmtgtcagtgttcctactcagcctgtagatataacatccttacctattatacagaggacacgatatagaatccggagagaggaaaagcaaaggaggccagct

SEQ ID NO: 12116 - DNA, 201 bp, Homo sapiens
tccctattctctttgatacaataatattgacattaggccaattaatagccctactgtggcctccaagtgctcaagtagaaagaaagagttgcacatttctygctttaaatcaaaagctaaaaattaataagtttagtgagaaaggcatatctaaagttaagataggctgaaagctaggccttttaggcctagctgtaaagg

SEQ ID NO: 12117 - DNA, 201 bp, Homo sapiens
tgggttaggctttagaaatacaatgttgaacaagacaggtacatcgctgtttttatggagcttgctgcctagtggaatatttagccattaaataactgatyacaaacatggtgagttttataagaggcagagtgatgtattagttaagaacataaactctggggccagactgggtgagaaatctggccctcatgcagtgat

SEQ ID NO: 12118 - DNA, 201 bp, Homo sapiens
tcacctgaggtcaagagtttgagactagcctggtaaacgtggcaaaaccctatctctactaaagatacaaaaattagtcgggcatggtggcatgcacctgwaatcccaactactcaggaggctgaggcaggagaatcacttaaaccagggaggtggaggctgcagtgagccaagatcgtgccactgtacttggctctgtac

SEQ ID NO: 12119 - DNA, 201 bp, Homo sapiens
taggggatttggggagttttcatttaactctgctgttgtctaactgaatgaccctgagcaaatgttttaacctttctataattaatagcatttcttcttaytcgccaagctctccctgctccagccaaggctcctgggtctatgaactgtaacgtcaagagagaatactgtcaacaacagtaagcctgactgcagagagta

SEQ ID NO: 12120 - DNA, 201 bp, Homo sapiens
tatcgtttgtcatgcaagggctaattaaccttgaaaataagcattggcctaccttcccagtacctacaataaagcacactaggccaaatctctatgaggckgtagttttctatttaaaaaataataataataaggtataaaaagttactaacaaccatgcacttgttcccctcaacttaaaagttaaaaaaattagaaaag

SEQ ID NO: 12121 - DNA, 201 bp, Homo sapiens
tatttgtattgtttgtatatgaaaagatgagatgaatagttaagggtactgcacaaatactttgcttggtcctataggctctcaggtttttttgatatcawgtggcatttgtgtcaaattgagttgtgctgtaattttattaacaagcttcacatctcagaatattttacagagatgcacctaacacagttgacatgttgt

SEQ ID NO: 12122 - DNA, 201 bp, Homo sapiens
ccttgtgatggccataatgtaaagtgttcacacgaccaggtagcatttccattcttagaaagctacgcttcttagaaagctacgctacttgattctaagaratcagtcatacagacgtgtttttattcctttcagaggcaattcatttcatgaaaaaatgctgaaatgaaaacactttatagttaagcttggtgtagtcat

SEQ ID NO: 12123 - DNA, 201 bp, Homo sapiens
tctcatgatgcatggctagttaatggcagaactcatgttaaagcaagcagtccaaccctgcctgggctcttaaacagtggagtctgctgtctccttttaayaggatgaaggtgaagttctcagcttgatatttttgtttcattcagtgcaaagtgtcatcttctaccccagtgccaaaaattacttcaaagaaaacagctt

SEQ ID NO: 12124 - DNA, 201 bp, Homo sapiens
tttgtaccctttaacctatatctccccatctcctcttccactgcatctggtaaccaactttctactctgtgttactatgtatttgactgtttattagtgtygacttaggagtgagatcaaactctttcactctctctttctttcccgtttttttttttgtttgtttttgtttttttttaaacaagatctcacactgttgcc

SEQ ID NO: 12125 - DNA, 201 bp, Homo sapiens
gaaacataacaagctaacagctgtcaccaacaaatagcaattaatttcagcattcattcccttgctcatgcttcatgaaagtatataggtaaacaggattygtatcatgttctattttcttctctgggcctcaggcttccagccctctgagctactgtcttataacattctgaggatgtaagaaagaacttgatcctgttt

SEQ ID NO: 12126 - DNA, 201 bp, Homo sapiens
gagaaccatgagtataatgaaaagagcttggggtcttaaatcaacacaaccaagttgaattttgcttctgccatttgggtgatgcttacatcaacaccacrctataaactttttgagcctttgtttcctcttctctaatatggaatatcataatctcacagttctatctatgatgagggtcaaataagaaaatggcacaaa

SEQ ID NO: 12127 - DNA, 201 bp, Homo sapiens
ggaactgtcactcttcttcaaagagtaggacagtcaactggcctctagcctataaagaaatattcctttcagatagactctagtatataatatcattctgstattcatcaggaagtggctgaataatttattatacaacttgtctatagatcagagtagatgaataataaaatctttagtatgtaaaaaccttacaagaaa

SEQ ID NO: 12128 - DNA, 201 bp, Homo sapiens
tgttgaataaatgcacagtgcataaatttagcttttactacaaatgtactacactcttcttatttttctttctttctttcttttttttttttttttgttgkttttgagacggagtctcattctgtcacccaggctggagtgcagtggcgcgatcttggctcacggcaagctccgcctcctgggttcacgccattctcctgc

SEQ ID NO: 12129 - DNA, 201 bp, Homo sapiens
ttggtgaggatggcacaggggctctcaaaagaaggagttctcagaatcatagcaccaaaaagttgtgagtttgcaataatcagagtcatggtgagcatcayggaaatttagaactaaaagagatgttacagattatctccagtctgagtccctgccacacatgagaaactaaggccaagagatgttaaatggcttgaacac

SEQ ID NO: 12130 - DNA, 201 bp, Homo sapiens
agaaaaacaaatttcttggattttccctatgacttgggcttaagaagtctcttaacagttcctcagatgtagtacctgcggaagggaaggattaggttagwatatattcaaagtttgtataaaaaagagggtaaactagtcatttaaatgtaaacatataaacacttactttttactgtgttggctttgatattctttaat

SEQ ID NO: 12131 - DNA, 201 bp, Homo sapiens
atcttacaccttaagcgagtgtctcattcaatcttctcagccctgcctgaatgtgccaagcgtgcctgtgccttttcacctgccatttcctctgcctgcarcagcccttccctgctattcacagtactcactccctcacttcacccaggtttccgcttatattgcaccttccagaaaggaccttcttgaccgtctgtaaaa

SEQ ID NO: 12132 - DNA, 201 bp, Homo sapiens
attccgaatacacaggtctatcagttagtgtatcatgttatgtgtagatgtgtgttggggtgatcagatccaacaccaggtcgtgggggtgacaaaggccrgcaattcaaaggaatgagaaaaagacagtttgagagagaaagtgggaccagggggccatcgcgagtgtggaggctgtgaaggccccaagttctgggagcc

SEQ ID NO: 12133 - DNA, 201 bp, Homo sapiens
gaggctgaggtgggcaaatcacaaggtcaggagtttgagaccagcctggccaacatagtgaaacaccgtttctactaaaaacacaaaaaattagctgggcstggtggcgggtgcctgtaatcccagctacttgggaggctgaggcaggagaatcacttgaacctgggaggtggaggttgcagtgagccaagatcgtgctac

SEQ ID NO: 12134 - DNA, 201 bp, Homo sapiens
tgaaaccactgaagccatgatagtgaagaagacttcacagtccttgacagtctttgagctctccattgttgttctccaggcttgtatttctgaaatctacygtatgtactagttccagatcagtcttgcccaaataccatttttatcctgtcattcctctgctcgtgaaccttcaatgacctcttctcaatgtagtccaaa

SEQ ID NO: 12135 - DNA, 201 bp, Homo sapiens
ttctttaaaccaaagtttccattatagataataaaacaaccatcacaacaagaaactactaaatgattatttattcagatcccagaagaagtgctttacayggatactctacttcaaccctcacaactgctccataaagtaaatgctattagagtaaccgttttacagatgtgaaaaataagtcttagagcaatttcttag

SEQ ID NO: 12136 - DNA, 201 bp, Homo sapiens
ggacatgaacagacacttctcaaaagaagacatttatgcagccaaaaaacacatgaaaaagtgctcaccatcactggccatcagagaaatgcaaatcaaamccacaatgagataccatctcacaccagttagaatggcaatcattaaaaagtcaggaaacaacaggtgatggagaggatgtggagaaataggaacactttt

SEQ ID NO: 12137 - DNA, 201 bp, Homo sapiens
acagaggaaagaagagttgttctgaaaatggtatttcaataaaagttatagtgatgacgagcagtgtgatgatgtaggaagttccaaaactaggtagaggrtataatcaaaggtgggtacaatggaacaagcctggaggcaaggacgggccagtcaggaacaggtgggcttatagtgaaagaaagtggaggctttagaagt

SEQ ID NO: 12138 - DNA, 201 bp, Homo sapiens
attacaagtaattgacaagaattgtaccagtgattaggtgttgcccaaagatcttttaaaattccatgtgacccaaatactaccaaatcctaaaagatttmactaactggctcactaaccaatgcacacacatacttacttatttcacccagtatgtgttgactaccttttgcccaccaggagctaggcaggttcacagtg

SEQ ID NO: 12139 - DNA, 201 bp, Homo sapiens
ctttattgaggttcagagaggttgctacttatatggtagcaaaagtatttcccttccctacttaccctactatacaaaacaaacaaacaaacaaacaaacmaaaaaccagaaaacttgatgataaatgtcaatcaacactcagcctctgcatctgatgagcaacagaaattagcggggactgtggtgaattggaaaacctg

SEQ ID NO: 12140 - DNA, 201 bp, Homo sapiens
gtccatgtctccatccttggacccctaagacttttgccacacaaactcctttgaatctggagactgcaacggagctgcttccctcctcctgctgagccttyatggaaatcctcataggagatagtgtttcctttacccactctcggacccctgttcttcctggatctcctgaattcctggctatatcatttaggttcgctg

SEQ ID NO: 12141 - DNA, 201 bp, Homo sapiens
ttttcaggaagaaatttggaataatgcaaataagagatgaagtaaaatacccaaatatataaaaagaattcaaggaattcaagcatggtgtcctgtcccaragtctcactgttcagcatcactgttttggtattttcgtgaactctcaaaacccaaatatctccagagaggcaagtgttgaaacttcatgcttgttttttt

SEQ ID NO: 12142 - DNA, 201 bp, Homo sapiens
atataatttgtggaaaccaatgcaaaataaaactaagggcccccttgcccaaaaatccagaaaaaaaagtgttaaaagtgctagaatagaatttcttttcyctttcttcaatagtctatttgttatgttttttatttgctattgaatgacatttaagtaaataaaaatgtaaattagcatgaatattaccattcgtcctta

SEQ ID NO: 12143 - DNA, 201 bp, Homo sapiens
ccaagcactaggtctcaacaatggacttaaaatatttagtaaaccatgctgtaaacaactgtcatctaggctttgctagtccacttaaagactacaggcakagtacatttagcataattcttaagaaccctaggaattttgaagtggcaaataagtattgactttaagtcaccagctacattagcccttaactagagaatc

SEQ ID NO: 12144 - DNA, 201 bp, Homo sapiens
gattagagattcccattcccctggctgtggttgttttctttataggtggactcctaatgcagtttggacccataacatacagaggcacagaggaagaaggrgcgaaaccctcagctactggggacagggatacatttgaggcttatttcagtaggaaccaggtgtgaacatttagccaagcgtggctgtaaaaaagtggta

SEQ ID NO: 12145 - DNA, 201 bp, Homo sapiens
tgactgaaaacttaaattcaacaaatatttttatccacctagtttatactcaaagtgtgctagatgcaagggatagcacggtggtaacgatagacatggtyccagctctagtagagcctgtgatctggtggagaaacaggcactaaatcaatagctacaagagtgatgaatgttacaaaagaagagattcaagatgctaca

SEQ ID NO: 12146 - DNA, 201 bp, Homo sapiens
cttttaatgcgttgaatgttttttttttttttgaaaaataatagaatcccttcagaattcttaatatgatatggtgttctgtatattttcaagaggagagktatatagtgtttctcaaatttatttgcacatgaaatgcctgtgggacataatatctctgaaggccgatgttccttgaaagactgtgtgaaatattgaact

SEQ ID NO: 12147 - DNA, 201 bp, Homo sapiens
taagagacagaaccatgtctgcctagtaccttcacttggtcaaatacctcttttggtggaaacaacacaaattatgtaggttgtatatacaggatgaactyggtttaaagataagacatgaaattcagtggaaatattctttaaattctaaacagagaaatcaaaacaaaggtatattcatactgcatgtgggtataagtt

SEQ ID NO: 12148 - DNA, 201 bp, Homo sapiens
aaaaaaaacaaaaaacaaaaaaacaaaaaatccagtcaacagaaacttaaacacttgagggcaaacattgagcaatgttggggttttgttaccttgcactrattttgggtttaagaagggaaggaaatgatgttcgtaatccagtgttctggaaggaggagtgcttttggtagattaatttacaaagttttctgctgacaa

SEQ ID NO: 12149 - DNA, 201 bp, Homo sapiens
gggaataataaattcattcttaggcaagggggttcaaggatggtctaaaatgtctacaattttataaacactggcaattctataggatgtatacagaaggrttactatgtcataagtttcttgagcatcggagatattaataatagcatgactttcctgttgtcgggatgacaatgttcctgtgttgtgcagcggaattgt

SEQ ID NO: 12150 - DNA, 201 bp, Homo sapiens
tcaagcctcagcaatggcagatgcccctcccccagccaggctgccaccttgcagttcaatctcagactgttgcgctagcagtgagcaaggctctgtgggtrtgtgacccatcgagccaggcacaggagagaatctccttgtctgccagttgctaagaccttgggaaaagtgcagtatttgggcgggagtgtcccgtttttt

SEQ ID NO: 12151 - DNA, 201 bp, Homo sapiens
tacctgaaaggtaggtataaagagaattatggccaatgaaactccatatgagagccctcccctcctccccagagtatatcttgcttaaacaacacatttayggttaatgaccatctggtaaaggtgacagcctttagtcctcctaattcttaactgtctgaaaaaatgtgcccaacctgccacggcttgtgactgaattat

SEQ ID NO: 12152 - DNA, 201 bp, Homo sapiens
cgtgttcctgtttctccacaaccttgccagcatctgttgtgttttgataagtccgtataatttaattagaaacctaagtaggttttggaggacctactacstttacttaaacatcctgaattttatttatttgtttattttagaattggggtcttgctctgtcaccaagactggagtgcagtggctattcacagctgtaat

SEQ ID NO: 12153 - DNA, 201 bp, Homo sapiens
actaaaaatacaaaaagtagccaggtgtggtggcgggcacctgtattcccagctagtccggaggctgaggcaggagaattgcttgaacccgggaggcagasgttgcagtgagccgagatggcgccactgcaccccagcctgggagacatagtgagactccgtttcaaaaaaaaaaaagtaaagggcagacagaagctggag

SEQ ID NO: 12154 - DNA, 201 bp, Homo sapiens
tacctgctcgtgagcaataaatcttacttatgatttttcggtgttatctgtttttcttcttttgatagtgtacaacatttctccaggcatactgcctgggsctaagatgtgtcctgtatgttatcccacggagtgttttaccaagccactccctggatgataatagagctccaaatagagacaagacaatgtatactttct

SEQ ID NO: 12155 - DNA, 201 bp, Homo sapiens
tcggagatgagcctcaggggaggtacagattgaaattcgtaaggggataaaataaaactacagtcctgaacttctggttcctcatagaaaaaggcagtcasagtgcactgggtagtttatgaaggctgacttcagtttatgattatattccttaaaaaggccattcataaaccagacctttaaaaatgaagtcctttattt

SEQ ID NO: 12156 - DNA, 201 bp, Homo sapiens
cacctatagaggactaggagagaaaatatttttgaaagagaagactaaatgctagatgcactattaatgggaattggtcacgcccacaggactcttccctytagcataacataccgatatataaaaacatgcttgctgtgtgaccgaatgagccaatcctggcttaacatagacaaacaaaaaagaagttgccaatgcctt

SEQ ID NO: 12157 - DNA, 201 bp, Homo sapiens
tgaggcaccagaatcacttgaacccaggaggcggaggttgcagtgagctgagatggcaccactgcccaccagcctgagcacagagtgagattctgtctttwaaaaaagtattttgaaagagtaaaaggagaataataatgtcattggacacatttagaacctatgtatgccaagcattgggagtagaatgcaaggcaaaca

SEQ ID NO: 12158 - DNA, 201 bp, Homo sapiens
catcaattatcttagctggatgtaacggataacttgctgcagcgtctacataagcacttgccgctttaccttgtgcttttatgttatagagatgatttctytccttaaacctcatgaaccaatatcttctagctttaaacttttttctgcatcttcctcacctctcttagccttcatagaattggaaatagtttgggcctt

SEQ ID NO: 12159 - DNA, 201 bp, Homo sapiens
aacttttctgtgtctcagtttacttttctgaagtctttgccttttgattcaatcaacattttaaaaattacttaaatttgaaattatggagatctcctatragaaaataatttgtttctctgattctttactacttttaattatatttgcttcatcatgtgcttatgaagattaattgaattaatatcttaaaagcattta

SEQ ID NO: 12160 - DNA, 201 bp, Homo sapiens
gcagatcatgaggtcaggagaccgagaccatcctgaccaacatggagaaaccgtatctctactaaaatacaaaaaagcagccaggtgtggtggcatgcacytgtagtatcagctactcaggaggctgaggcagaggaatcacttaaaccctgcccagaggcagaggttgcagtgagccaagatcgccactgcactccagcc

SEQ ID NO: 12161 - DNA, 201 bp, Homo sapiens
gtcttgactctttatccaatttgccagtctgtgtcttttaattggagcatttagtccatttacatttaaagttaatattgttatgtgtgaatttgatcctrtcattatgatgttagctcgttattttgttcattagttgatgcagtttcttcctagtctcgatggtctttacattttggcatgattttgcagcggctggta

SEQ ID NO: 12162 - DNA, 201 bp, Homo sapiens
ctcagggatgcagatcactgggccttggtgcttttttctagagccgttagaaatccctcctttattgtcttaggcagacccaccggggtattggttatggycacatttcatttcccagttctggagggcaaggccagagttttagctggaaaaatcatttgtggtatcctgcccctgaccctgccaaatgggcggaggtgt

SEQ ID NO: 12163 - DNA, 201 bp, Homo sapiens
aggtgggtcatctgaggtcaggagttcaagcagcctggccagcatggtgaaaccctgtctctactaaaaatacaaaaaattagccaggcgtggtggcgggsacctgtagtcccagctactcgggaggctgaggcaggagaatggtgtgaactcaggaggtggagcttgcagtgagctgagatcttgccactgcactccagc

SEQ ID NO: 12164 - DNA, 201 bp, Homo sapiens
tagctcaagctacttaactctctaaggttaaatatcctcctctataaaaacctgatagtatgtactaaagagggtatttttgaaaattacatgagataaarcagcctagaatgctatctgatgcaatagtcatccagtaaattttaatatcattctactttgaaccaggttgtttatattaaatttaacagaattaagcaa

SEQ ID NO: 12165 - DNA, 201 bp, Homo sapiens
tgtctttctccagagccctgccacccaccttcttcctgcgcactctaccttttctctctgtgatatcttttctaatcctatgcttttcactactgttcaarggtggatgactccccagttgatacctctagccttgaactctctcagacaccttatattaccgggcttctggtcctctccacccacaggcacatcaggatt

SEQ ID NO: 12166 - DNA, 201 bp, Homo sapiens
gagtaaatgcatgatgaaaaatttacaagttagtatatccatctccacataaaagaattcaaaacttatttttggtaatgtcactcaacaaatatttaggrtcctcttgaatattaatcaggatgactaggcattcatgaagtgtgagacacagtgcttgccagagggttgcatgacttcacttgcagctttgggaacact

SEQ ID NO: 12167 - DNA, 201 bp, Homo sapiens
gtgtgctgcacccattaacgcgtcatttagcattaggtatatctcctaatgctatccctccccactcgccccaccccacaacagtccccagagtgtgatgytccccttcctgtgcccatgtgttctcattgttcaattcccacctatgagtgagaacatgaggtgtttggttttttgtccttgtgatagtttactgagaat

SEQ ID NO: 12168 - DNA, 201 bp, Homo sapiens
ttacaaagctcctcagtggtagagctctggaataagaatccagttttatctgactctagtctagctcttaactgaatcccagaataccagaaccttggggyagggacaccccttgaaatgtactacaggggaatctagggcaaacaatgagcaactccctttcatgcggacggtgataacctcaaggaatgtgtcccccaa

SEQ ID NO: 12169 - DNA, 201 bp, Homo sapiens
attgttttgagtttcttagaacgtgtacatgctgttccctttgtccccatcactagactgactcctacttgactttcaggacttctgactttttcttcctscaggaatcatcttctaccactcctctgcatggcaggttagatgcccctcttaaatgcagggttaacctctatcgtacatttcacaccttgtatttacttg

SEQ ID NO: 12170 - DNA, 201 bp, Homo sapiens
ctcttgaagttgacataagatctccatgcacagaaaatgaattcattagaatcaaagtgattgtataagaaactcaaattatccaggtgttgaaatgcatrtctactttcttttcagacaatggaatcatttataaaacatatagttatttaaaacacagacacacatacagagactatcatatgggattgtgagagattg

SEQ ID NO: 12171 - DNA, 201 bp, Homo sapiens
actacttgggatatgtttatgttgataatttctccccttttatttttctatcagtcagatttataataagaatcagctgttctttctaaaagactattgtrcctttatattactttctttaattttcaataatcctatgaattagcaattattatcctcatttttacaaatgaggaaactagagatccgaaaagtaaacag

SEQ ID NO: 12172 - DNA, 201 bp, Homo sapiens
aggagtgcttttggtagattaatttacaaagttttctgctgacaaaagaaagggaaaggaaaaaaatcagataataattccctttacaggcctaatttgamcttaattctctctctctctctctctctctcacacacacacacacacagacacacacacacacacacacgacaactgtgagctgtaaatccatggtcatct

SEQ ID NO: 12173 - DNA, 201 bp, Homo sapiens
gaaaccagggatctgaataagtactagggatccttgctcattttcccaatttggctacaaaagttaatgaaattggggccaacgcttaaaatgcagatatkgttatggatacattttatgatataaatagagatacacttgtttcatggaggggtaactagggacttagatttcatttggacctatgtgtgccgagcaatt

SEQ ID NO: 12174 - DNA, 201 bp, Homo sapiens
tctcctagagagggtggtgtggctccagaatgctggggcagacttcaacgcaaaaactgcacaaagagggcaggggtaggagaggccctgggaggtgttarccactgagcttgaaccttcgcatttttctctttcttaaaagaagttaccattaaccagtactttcaatttcttctcaacctacccaacgccttctacctt

SEQ ID NO: 12175 - DNA, 201 bp, Homo sapiens
cactgctgtcagggtacataatgagagaagatacaaactctagatcaaacacaaagatcattgattacttatggcaaatacagcaatcaaggtgatctctygcattagttctctgaatcctgatgcccatgggtgatgtggtaagggccagatggtagttgcacatatagtggagcctgttaagcaggagacaccccccgc

SEQ ID NO: 12176 - DNA, 201 bp, Homo sapiens
attccattaccctcccagctcttgtttctctacgtgagcatgttgtgtgaatgctgagtgaacttttagtttactatgcattcatagtgcattcattccartattcatttcttccttgggtcctggcctactccttccttttctctcatctattcattctaatctcatttgaacatcaggctcctcccactgtcgatactt

SEQ ID NO: 12177 - DNA, 201 bp, Homo sapiens
gttttacaaagttatatttctaccagcaatatatgtgtttgcttctcctcactcttgtaacacacatcatattatcaaactgtattttcattctcttaagmtagcttttcaaaatgttgctgtcacatatttatttcccatagatcttttcctcccatcctttaacatcttcaaatatacatagggatcattgtcattcat

SEQ ID NO: 12178 - DNA, 201 bp, Homo sapiens
ttttttttttttttacatttttattcattggccatcacattccaaagttttacagtcaaatggacagttaaatatttgtgtttgaatctgaccactgtgawtatctcaaggataccataagagctgatggacctccaaacgttagcatcactggactgagagaaagctcgttttatatctctataggtactgtcataccaa

SEQ ID NO: 12179 - DNA, 201 bp, Homo sapiens
aactggaaggctaggctgatggctttttctccattaagcagtaaacacgttaagcaagcttgagccaggttctggaggaggtcatcttgcaaggataaaaracattgcatttattggatgaatacttaatgcacggtttgccttatccctaccttagagatgagaaaactgaggctaagactagctaagtaatttacccat

SEQ ID NO: 12180 - DNA, 201 bp, Homo sapiens
cattgttcattcatggagttgtttctaaataatggtgactagagaggaggaaatggtgttatattagttctctattgctgcataacaaataactccaaaaygtagcagctcaaaaatcaacaaggcattacctcctaatttttgcaggtcaggaatccagatgtggcttagctgggtgcctctggcttagagtccctccat

SEQ ID NO: 12181 - DNA, 201 bp, Homo sapiens
tggcagagatgaaagtcctggctcctggcttggccttatctgataccactcaggctggcaagttgagaccccattatagcctaacaagtgtgagggtctakgttcctcagttgttcttcactggactgggtagatgtgggaccacactctttctgtgatgtttggctggagtatggaaattgctttgtgaaagttttttgt

SEQ ID NO: 12182 - DNA, 201 bp, Homo sapiens
tcataatttatgatatgttaaaatttccaaattttctgtttattttatgttagttacatcttagattgatgattccctggtggaatttggaaagacatctyaatcacaccagcagtatttatgtaaaccatttttaaggatggtttacttcttagttaactctaaaggaaggataatgtcatctattgaataaagattctc

SEQ ID NO: 12183 - DNA, 201 bp, Homo sapiens
tcttttcttttctttttttttttttttttttgagatggagtctcactctgtcacccaggctggagtgcagtggtgcgatatcagctcactgcaacctccayctccggagttcaagtgattctcccactgcaggatcccgagtagctgggattacaggcataccgcaccatacctgctaatttctgtatttttagtagagat

SEQ ID NO: 12184 - DNA, 201 bp, Homo sapiens
tatgactttttacagaaattttaccgatgtcaggattcactttaataaagtgtttcataaagtgtttgtttgtgccgtgatgggccatccaagattgtaaygggcgatcattggaaacaaagatgcttatagagcagcatcttgcatgtcacaaatatttgaatgaatgaaaaaatgcatatttctgttaagacatcacag

SEQ ID NO: 12185 - DNA, 201 bp, Homo sapiens
gggtgtggtggcgcatgcctgtaatcccaacgattcaggaggccatggcaaaagaatcgcttgaaacccaggaggcggaggttgcagtgagccaagattgygccattgcactccagcctgggcaacaagagcgaaactcatctcaaaaaaaaagatacttgccattggattcagagcccacctagataatccaggatgatc

SEQ ID NO: 12186 - DNA, 201 bp, Homo sapiens
aatatatacaatgattttcaaagagggtgatttttcacccctcttctctccctgccccacatacaaaggagactttgcctatgtctggaaacatttttggwtgtcacaattgaaaaggaatgtatggaggtgttgctgttatccagtgagcagaggccacagatgctgctatacattttataatgcacatgaactctggaa

SEQ ID NO: 12187 - DNA, 201 bp, Homo sapiens
agtcagagaggatttgacagaatttttaaagtaaaaagtgaaatgaaatttagatcagcctctgcaaaaggactttgtggatttcctgtcggttaaagatstggcagcattattgttcctgtttctggagatgtcaagagtaaaatggtgtgacgtttgtcaagtgcttggacttactataaccagacatgctgccggggg

SEQ ID NO: 12188 - DNA, 201 bp, Homo sapiens
actcaacttcatttcaattcaattccacaggtctttacttaacaaattctgggtaaacaggagattttgaaaaggcaagaaaaattgctgctcacagcgtrtggttaaaaagttgacatccataaatcaaataaccaaagaatcattcaagatttattgggcggttagacgttttattggcagcagagatttaacttttca

SEQ ID NO: 12189 - DNA, 201 bp, Homo sapiens
gattccacacatggttttgagaggcagcaagccatagtagaaagatgtgcttaatttgaaaccaaaaaaaagttggatttgagttccatttttcaatccayttctgtcagtgagctatgtgactttcagcaagtcattctactacttggagcttcagcttcctcttcttataaatgggcataaaatattatgttgcagggt

SEQ ID NO: 12190 - DNA, 201 bp, Homo sapiens
tccccttactttaaattctgaaaacgctaatgactgagcttttcatttagtactaactggatggttagttttctttgtgtatgtgatcgtttacgtggtcrttttgtttctcaccaacacattgtaaactcttttagaattgttatctaatagaaatataagtaacataaacctgtattatatttttggagcatctgaaag

SEQ ID NO: 12191 - DNA, 201 bp, Homo sapiens
aaaaaaaaaaagcagaaaaatgtgttgattacagagttaagggggagaaacttataaatcatggttatttaccacccctgagaaggtaggtacaaggttgrctactacttacctcttaatcctatgattttctggttctgtggcttagaaggtttaagctctgtcaagtggctcaagcaggacagcccaaggtgactccaa

SEQ ID NO: 12192 - DNA, 201 bp, Homo sapiens
aacatcacttacttcatagggttactagtaggaaaaattagttaataccagttaagatgatttgtagagaaatggcaccttcaattaatgttaactgttaytattgttgccacctctagacactcatcccttcgcactgcccttttctcatttttccctggattgttttgagtttcttagaacgtgtacatgctgttccct

SEQ ID NO: 12193 - DNA, 201 bp, Homo sapiens
gattgcagactatctcagtgttagtggaaccatttcacttctcgatgttttcttataaaacacacagtttgagctgtattgttaatctacttggaaagatrttatcattttttaaaacaaatatctgctgggtgagtgttaggcaatggctctcaaagtgtagtcccaggaccagcagcattagcaaattcccagttccca

SEQ ID NO: 12194 - DNA, 201 bp, Homo sapiens
gccataaaaaatgatgagttcacgtcctttgtagggacatggatgaaactggaaatcatcattctcagtaaactatcacaagaacaaaaaaccaaacaccrtgtattctcactcataggtggtaattgaacaatgagaacacatgaacacaggaaggggaacatcacactctggggactgttgtggggtggggggaggggg

SEQ ID NO: 12195 - DNA, 201 bp, Homo sapiens
taattctgcatcctgcttccttacagaatcttcttgttaatagtaatcattttcagttgtttcttctgagaactccaggtgctcagtcatatcatctaaamataattttatcactctctttccagttttatatctccaatttctcttgtttaattgcattagataataatcctatctaataatatagtaatgatattgtgg

SEQ ID NO: 12196 - DNA, 201 bp, Homo sapiens
aagtgggaccagggggccatcgcgagtgtggaggctgtgaaggccccaagttctgggagcccatgttatttatgggtgctcaaacaggtggtgaggatgtsgagtgaatgagaaacatatggctgtttgacataatgggagtactagaagcaagaagccagcaagtctagcagacatgcaagccctgcctcagcttctctc

SEQ ID NO: 12197 - DNA, 201 bp, Homo sapiens
aatatagccacaaacataattggtggttatgaaattatgcaatcacactgtctgaggcctcattaccctttaacttataaatctgccttgccatctttccrtgatcctcttaaagaatgtacctacccaccacctacataataaaaaaagccacaagccccagccttgggggaattgtattgatttataaagagagaggct

SEQ ID NO: 12198 - DNA, 201 bp, Homo sapiens
ggggtagaagtggggatatctggcatactatgagatttagagggccactgtagcctcataggtactcagactttatagtgttggtttaattagggattttyttaagctggctgccctgattcaaggtgatggttatctgagcaccaggtaaggcctgggaagggtagaggcaatatggctagatgtccatttcctataatc

SEQ ID NO: 12199 - DNA, 201 bp, Homo sapiens
aaacttcgttgttgttttattttaggaaattgcacagccaccccaacattcagtaaccactagcctgatcagtggttatcaaaactgaggcagaccctacrccagcaaaaagattacatctcactgaaggctgtcaacttagatgactgttagcattttttttaacaataaagtgattttaattaaggtttgtacattgtg

SEQ ID NO: 12200 - DNA, 201 bp, Homo sapiens
gtgatggcctgtcctgcttccacccttcatgaataaatacaaaatgccttgccacccagaagacgaaccctttgtagtcgtgcatctcttttgaacatgcrtctttaggaccctgtgttctttcatttcagtattcttgcttttgtgaggcttacgttagaaactgtgaaatatgctgttattgcaatggtaatatgtttt

SEQ ID NO: 12201 - DNA, 201 bp, Homo sapiens
gctagctagttctcccagcacaatttattaattagggaatcctttccccattgcttgtttttgtcagatttgtcaaagatcacatggttgtaggtgtgcgktcttatgtctgagttctctgtgcttttccattgatctatttgtctgttcttataccagtaccatgctgttttggttactgtagccttgtagaatagttta

SEQ ID NO: 12202 - DNA, 201 bp, Homo sapiens
caccaatccttttcagagaaaaattttataaacttacaagtatccattgcacgtgctttacatttgttttatatcaatatgactgtaaactttatagagakctttttaatacatgaataggacatcttatttttaaggcaggtaaatgtgctttttctcacttcaaacaaattatgtccacaagctgaataatgagaaggg

SEQ ID NO: 12203 - DNA, 201 bp, Homo sapiens
ctgggtgaacacgttaattagtttattcttttaatgcgttgaatgttttttttttttttgaaaaataatagaatcccttcagaattcttaatatgatatgrtgttctgtatattttcaagaggagaggtatatagtgtttctcaaatttatttgcacatgaaatgcctgtgggacataatatctctgaaggccgatgttcc

SEQ ID NO: 12204 - DNA, 201 bp, Homo sapiens
cctagcagaaaaattatttttcagccttctcagaagtactaaaagtcctttgccaacatcagcccagtgcaagttaacctgttatgagatttgttttgtgstttggaaatgcttgtcagacaagctttcaacattgagatgtgtgatttaaattagtttgcataagaaaatgtaatgccagggacaaatttctctctttat

SEQ ID NO: 12205 - DNA, 201 bp, Homo sapiens
catgtttggaccaataaagtgtaagcgcagtgttgtaaaagttattttccatgttatacaagagttctatttttcagttttttcacttgaaataattgtaktccttggagactgttaataaatttcgagtctcaccttaaagaggaattgatgtatattgaggcctactcaagggtcagtttgctttccgtttctttccct

SEQ ID NO: 12206 - DNA, 201 bp, Homo sapiens
tttcattgagttatatagaagaagtaaccaggtatattacttagtatacaacttaaagagcaaaggactactacagttttaagttggaggaagacattcaracctttaaacgtggaaaatcctcacggagtgttaactgtttgccctgtttttaatgtatgtggtctaattaaaaataagaataactctaaaaagcaaata

SEQ ID NO: 12207 - DNA, 201 bp, Homo sapiens
ctcaagaattgattagtcagatctctctgggaaagtagctgtagtcaggagtagaggggtagtttaaatcttgtagcccaggaaacctgccttgcctttcmtgatgcttgggtcagtcttgaacaggcaaagagcactttgtggagtgaatgatggcaactggaatgaaggagactcatcatctctagccagtgtaattca

SEQ ID NO: 12208 - DNA, 201 bp, Homo sapiens
ctggagatttttataaagtatagatcattttcactataacaaagttctctggccaattcaccatactgcagtgttgaaagcttccaaagggctattatttrtaaatcattcttgattaatgggcactatgagttgcctagtgtgcagaattaactcttgtctaaggagtatcctctgatcggatgagcattctcttctctg

SEQ ID NO: 12209 - DNA, 201 bp, Homo sapiens
gctattatttgtaaatcattcttgattaatgggcactatgagttgcctagtgtgcagaattaactcttgtctaaggagtatcctctgatcggatgagcatyctcttctctgccacttccatttctttcattgttatacattgagaaggtatttcacattatacaccaggaattcaaggacagatcaacattgtgtagcctt

SEQ ID NO: 12210 - DNA, 201 bp, Homo sapiens
tatgcaaataaaaattacttggtaaggatggaaaattaacttgaggcttttttacttttttttttttttttttttggtctgttgagaaaagggcttgtagrgtggtgcctgcataaactggccataaaaatatgggacaataagttgttgaaagccacaagaggcctctgaggaggaaagcctcctaaatgccatcatgtt

SEQ ID NO: 12211 - DNA, 201 bp, Homo sapiens
cttaaaaaaagttccacaacgaacaggggtcagcaactttttctgtaaagggccagaaagtaaatattttaggcttgtaggccacatgatctctgttgcarctactcatgtctgctgttgtagcatggaagcagccaaagataataatacatcaatgaatgagtccagccgtgtcccaataaaactttatttataaaaaca

SEQ ID NO: 12212 - DNA, 201 bp, Homo sapiens
aggatagctaaaaagtaaaatcattgagacattgctcatctgaagaatgttttattccattctcacccttgacgataatttgcctgggaaggacttgtatsttggaaattatcttcactaataaatttaaaagcatccgtccaatgtttttgggcatccaatgttgcagctgttgacatcacagtttggtgtctaattcct

SEQ ID NO: 12213 - DNA, 201 bp, Homo sapiens
cattttattcactacctaatgtgaaggtggtggcagggaatggaaaagggaagattatttagtcgataaacacttaatggccactgcctgctgtgtggacrgatctggatagagttaaaaagataataaagcaagtgtaggatgcctgtcttcatggtacttatatcatgggaagaaggcatgaacaaaccaattttacac

SEQ ID NO: 12214 - DNA, 201 bp, Homo sapiens
ctcccatttataaaaccatcagatctcttgagacttattcactactgtaagaacaatatgggggaaactgtccccatgattcagttatctcctccttaatratccccttgatgcatggggattattacaattccaggtgagatttgggcggggacacaaccaaaccatatcagggagttatccttctcctctgccatcctg

SEQ ID NO: 12215 - DNA, 201 bp, Homo sapiens
tataggttggctaagtgccaactcagagaaaatgacattatgggctatagatatttgaaagtggctggctataagcaaagcaagggattacttaggtaatkggattaaatcaagggggtaaacattttaaactcaatatctggatttattttgttgactataagaattattagattttagaactatcccataacctactgc

SEQ ID NO: 12216 - DNA, 201 bp, Homo sapiens
ctagacccaacaatttacatgtctaatgagtccgctggtgatactgctgctgggggtcttagaacctcactttgtaagcacataagtaaggtgtaagatgwtctggaaaaattccagatgagttaaaatgtgtttcctcatttcaaggactgtaatgtttgttgttagtgtgagcacagggcttaaggtttctttatgaag

SEQ ID NO: 12217 - DNA, 201 bp, Homo sapiens
gaatttttttttaaaatcctccatttgcagctttttgtactctgatcacaatatattaaatcccccagaagaactactaccttgaatacaaagcacatagyggtgctcttttaattgatttgtaaaggttagttgctcagtactagtggaaagtttcatgattacttaattgaattacctgcttcccccagtagagtgctt

SEQ ID NO: 12218 - DNA, 201 bp, Homo sapiens
gatccacctgcctcagcctctcaaagtgctgggattacaggcgtgagccactgagcccaccctccttccttccttttttaaattagaattttttatttttkatttttttttttaattttttttttggttgcttttagccacctcagttaccttgaccatccgatttcacttactgtagccagatttctaaagtatgtgttt

SEQ ID NO: 12219 - DNA, 201 bp, Homo sapiens
tattaatattaatatcagcaagataagctgttaaataagcattacatgtaagaatcctgaccttggataaaattaaatctttgtcataaatctactactgkgacaaaactgcaaaatatgcagtgaataattaaatccagatgtctcttccggcaacagcagcagcaaaaactggaggtgggggtgaagggaagatggaag

SEQ ID NO: 12220 - DNA, 201 bp, Homo sapiens
gggggccatcgcgagtgtggaggctgtgaaggccccaagttctgggagcccatgttatttatgggtgctcaaacaggtggtgaggatgtcgagtgaatgaraaacatatggctgtttgacataatgggagtactagaagcaagaagccagcaagtctagcagacatgcaagccctgcctcagcttctctcccaacactcag

SEQ ID NO: 12221 - DNA, 201 bp, Homo sapiens
tctaaactcaaattttctgagcactttaactattaaatagcaataacagaaagcattgtaaatcttttggagttttgcatgataatgtacctcttgttaaytgaattgagagatgattgccctatgattacctcgattcatttgctgcataatttaccataatgataattaactccttgtactgaatgaggtaagatgtgt

SEQ ID NO: 12222 - DNA, 201 bp, Homo sapiens
aaaagcttgctagggcaaggtcagaagataaatttattagccaggaccagtttaagtcaaaagttgaatataagtcatatctttagaaaaaaaaaaaaaawgcaggtagaaaggcacattgtttttagctaactctacaaaaagttcagagcgaaaagaaaaacagtgatgcagaactaggggagaaattaaggagcaaac

SEQ ID NO: 12223 - DNA, 201 bp, Homo sapiens
attatcagctacttgaacatttctcagggtagtcacttttgattaaaataaacaagaagctttgaatagcttcccaccaaactacttttttgtttgtttgyttgctttttgagacagagtctcgctctgtcgcccaggctggagtgcagtggcgtgatctcggctcactgcaagctctgcctcccaggttcacgccattct

SEQ ID NO: 12224 - DNA, 201 bp, Homo sapiens; identical to SEQ ID NO: 1320

SEQ ID NO: 12225 - DNA, 201 bp, Homo sapiens; identical to SEQ ID NO: 1324

SEQ ID NO: 12226 - DNA, 201 bp, Homo sapiens
taattcctttcaagtctggaaaactgttttgtttgacatttttggaatgctgtgatctgaaccattagactatttttttctcctttaaggtactaatattytgatttttaaacaattaaatatgctctaaatttgtctcgcccacttctacatcttcttccaacatttacatagacatccatgcacattcatgcacaccac

SEQ ID NO: 12227 - DNA, 201 bp, Homo sapiens
aaatactttacagacaagcaaatgctgagagattttgtcaccaccaggcctgccctataagagctcctgaaggaagcgcttaacatggaaaggaacaaccrataccagccgctgcaaaatcatgccaaaaggtaaagaccatcgagactaggaagaaactgcatcaactaacgagcaaaataaccagctaacatcataacg

SEQ ID NO: 12228 - DNA, 201 bp, Homo sapiens
cgataccagccgctgcaaaatcatgccaaaaggtaaagaccatcgagactaggaagaaactgcatcaactaacgagcaaaataaccagctaacatcataaygacaggatcacattcacacataacaatattaactttaaatgtaaatggattaaattctccaattaaaagacacagactggcaaattggttaaagagtcaa

SEQ ID NO: 12229 - DNA, 201 bp, Homo sapiens
gtaactaacctgcacaatgtgcacatgtaccctaaaacttagagtataataatgataaataaaataaaaataaataaaaataaaaaataaaaataaaaatmcaaaaaaaaaaaaagaaatcaggcagactggatctggaatctgttctcttaacctctctctctgctcaccggtaggttatagacctaacataaagtagtt

SEQ ID NO: 12230 - DNA, 201 bp, Homo sapiens
ctggccttcacatatgctttgctatctggtagaaatatctgcccaaaagattattttttatggaaataatagtgcacatgcagattctagatattattttstatttatcaactgcattcaggcagtgctaagtagatgactgatgctgaaattttactagataatctttgctctctattttgttatatgacacatggggca

SEQ ID NO: 12231 - DNA, 201 bp, Homo sapiens
gaaataatagtgcacatgcagattctagatattattttctatttatcaactgcattcaggcagtgctaagtagatgactgatgctgaaattttactagatratctttgctctctattttgttatatgacacatggggcaaatacgtgagatgagcaattagtgaaattctggaagggacagatttatgtcatactattgaa

SEQ ID NO: 12232 - DNA, 201 bp, Homo sapiens
cagaaggctataagtgaggagacagtactgagacactaagtagacattctagccaactctgtagaggattctcatgttatgagctgaagtagaaaggctaygtttgaagattctgtctgattttgggcatcttggttctagatctatcataggtgcagattaaattgtttccaggctgtacttgatagttggtaaggatca

SEQ ID NO: 12233 - DNA, 201 bp, Homo sapiens
caggtttggctgaattgatataagactggtagcataggctgggcgtggtggctcacgcctgtaatcccaacactttgggaggccgaggcaggtggatcacsaggtcaggagtttgagaccagcccggccagcatggtgaaaccctgtctctactaaaaatacaaaaaattcactgggcatggtggtgcgcgcctgtaatcc

SEQ ID NO: 12234 - DNA, 201 bp, Homo sapiens
tttggctgaattgatataagactggtagcataggctgggcgtggtggctcacgcctgtaatcccaacactttgggaggccgaggcaggtggatcacgaggkcaggagtttgagaccagcccggccagcatggtgaaaccctgtctctactaaaaatacaaaaaattcactgggcatggtggtgcgcgcctgtaatcccaac

SEQ ID NO: 12235 - DNA, 201 bp, Homo sapiens
ccgaggcaggtggatcacgaggtcaggagtttgagaccagcccggccagcatggtgaaaccctgtctctactaaaaatacaaaaaattcactgggcatggkggtgcgcgcctgtaatcccaactactcaggaggctgaggcaggagaatcacttgaacccaggaggcggaggttgcagtgagctgagatcatgccactgca

SEQ ID NO: 12236 - DNA, 201 bp, Homo sapiens
aaaaatacaaaaaattcactgggcatggtggtgcgcgcctgtaatcccaactactcaggaggctgaggcaggagaatcacttgaacccaggaggcggaggytgcagtgagctgagatcatgccactgcactccagcctgggcaatagagtgagactctgtctcaaaacaaaaaaacaaaacaaaacaaaacaaaaaaagat

SEQ ID NO: 12237 - DNA, 201 bp, Homo sapiens
aggctggtctcgaactcccgacctcaggtgatccgcccacctcggcctcccaaagtgctgggattacaggcgtgagccaccatgcccggccaatcaattgktattgatttattactgagattgctttaaataaattcatccttatttctgttgtagtctttaccttgtctccagatctttggaagtctcaggttcatttgt

SEQ ID NO: 12238 - DNA, 201 bp, Homo sapiens
caaagtgctgggattacaggcgtgagccaccatgcccggccaatcaattgttattgatttattactgagattgctttaaataaattcatccttatttctgktgtagtctttaccttgtctccagatctttggaagtctcaggttcatttgtctggactttgggggttttgtttaaaactgcctagtctctgcagccacatc

SEQ ID NO: 12239 - DNA, 201 bp, Homo sapiens
taaattcatccttatttctgttgtagtctttaccttgtctccagatctttggaagtctcaggttcatttgtctggactttgggggttttgtttaaaactgsctagtctctgcagccacatcctccaccactgtagcacatgatcaaaaaacttttctctgaggatactgagtatttcttagacctatgtcactagctccct

SEQ ID NO: 12240 - DNA, 201 bp, Homo sapiens
tccttatttctgttgtagtctttaccttgtctccagatctttggaagtctcaggttcatttgtctggactttgggggttttgtttaaaactgcctagtctytgcagccacatcctccaccactgtagcacatgatcaaaaaacttttctctgaggatactgagtatttcttagacctatgtcactagctccctgggaactc

SEQ ID NO: 12241 - DNA, 201 bp, Homo sapiens
ttgtagtctttaccttgtctccagatctttggaagtctcaggttcatttgtctggactttgggggttttgtttaaaactgcctagtctctgcagccacatyctccaccactgtagcacatgatcaaaaaacttttctctgaggatactgagtatttcttagacctatgtcactagctccctgggaactctctctaccccca

SEQ ID NO: 12242 - DNA, 201 bp, Homo sapiens
tcaggttcatttgtctggactttgggggttttgtttaaaactgcctagtctctgcagccacatcctccaccactgtagcacatgatcaaaaaacttttctytgaggatactgagtatttcttagacctatgtcactagctccctgggaactctctctacccccatcccatcaactctctgaccacaagttttcaaggaatc

SEQ ID NO: 12243 - DNA, 201 bp, Homo sapiens
ctttgggggttttgtttaaaactgcctagtctctgcagccacatcctccaccactgtagcacatgatcaaaaaacttttctctgaggatactgagtatttyttagacctatgtcactagctccctgggaactctctctacccccatcccatcaactctctgaccacaagttttcaaggaatcttcctcattatactcatct

SEQ ID NO: 12244 - DNA, 201 bp, Homo sapiens
gcctggcttatttcacttagcataatgtcctttagctccatccacattgttccaagtagcagaatttcctgctttttaaaggctgaatattattccattgkgtgtgtgtatatatatatcacatttaaaaaattttattcatccattaatggaaaaccttcattcttgaaaaaatagcttataaagctatttatgtccctg

SEQ ID NO: 12245 - DNA, 201 bp, Homo sapiens
gaggttgcagtgagccaagatggtaccgctgcactccagcctgggcgacagagtgagactctgtctcaaaaacaaaaacaaacaaacaaacaaaaaaacamaaaaaaaacaagaagaggtctccgggttgccctatctttccctttcatgtcatcgtctttactgtaaatggttggttgatacagagacttaagaaaggat

SEQ ID NO: 12246 - DNA, 201 bp, Homo sapiens
cctgggaagaacactgtattcacatgtactcatatagaagatcaacagaaaacaaatctttgggcaaagtggagcgcagagagggttaaaggtggaaaaarggggtcagaaggtgaaagatgatgtgtggggtctgcaatggggattaggggcccattcatgggatggaattggaggtagagaaggggtgggagagtgggg

SEQ ID NO: 12247 - DNA, 201 bp, Homo sapiens
aagacggttgtgagaatcacgtctaattaataactgtaactaaaaagtgtgtgtgtatatatatatatgtatatatatatatgtgtgtgtatatatatatrtatatatatatacatatatatgtatgtatgtatgtgtatatatatatgtatgtatgtatgtatatgtatgtctaggacagcatctggcttgtagtaattg

SEQ ID NO: 12248 - DNA, 201 bp, Homo sapiens
cacattcctgtgtatatatataaatagatatataccttgtatatatttgaagaacattttgttgtttcacctcatcttgtgccgcatgaatttttggtggytcaatttattttgttttcatatttactattttgatcattatggctatttttaactcattgctatacttttatgagtaactataatcattattttcaaata

SEQ ID NO: 12249 - DNA, 201 bp, Homo sapiens
ataaatggtagaggtaatattcaagtccaaatctgtttgaaaatagacattttctttatattacagtgtgccagtcattctttcaacacttctcaaagtaytaagttatcgaattttgacacgctcctttgtggagcttagcatgactcgggtttccctattgcctcaaggaggtccttggctttaactgtcttagataaa

SEQ ID NO: 12250 - DNA, 201 bp, Homo sapiens
cccattttatagtcgttcccaacatttgttgagttctccactaagtacatgagaccacataggatacaacaggacattaaaagcttttttttttttttttwtttgagacggagtctttttctgtcacccaagctggagggcagtggcacaatctcggctcactacaacctccgcctcccaggttcaggcaattctcctgcc

SEQ ID NO: 12251 - DNA, 201 bp, Homo sapiens
ctgtttttacaagaaaaaaagcccaatgaaatgtaaaccttgttttcttcagttattggtcctaggagtattcagagtaaataaaaaaaaaataccttacrtatacttctataaaatcttttatttgagcaattaaaaaaagctatcttctttcagtcttatcaaggagagcaaattcctcctagaagtcttatttctact

SEQ ID NO: 12252 - DNA, 201 bp, Homo sapiens
attctctatatgtgtgagtgtacatgcacacatgagccatttgagagtatgcatacaaaacatatttatgtagatatgtatttcccctgaaccatttgaawctcagttgtagtcatcattccttttttaaataattcagtgtgtatttcctaacaaggactttctcttacaaaatcagagtacagtgatcaaaatcagtaa

SEQ ID NO: 12253 - DNA, 201 bp, Homo sapiens
catgttggacaggctggtctcaaactcctgacctcaagtgatttgcccgccttggtcaattaaagtgttgggattacaggcgtgagccacagcacctggcygccacaaacttttatatgaccggatctcactgtcatgaggacagcaccaagccacaagagatccaccttcatgacccaaacacctcccaccaggccccac

SEQ ID NO: 12254 - DNA, 201 bp, Homo sapiens
aggcatggtggcaggcacctgtaatcccagctactcgggaggctgagccaggagaattgcttgaacccgggaggtggaggttacagtgagccgagatcacrctctgcactccagcctgggcaacagaggaagactccatctcaaaaaaaaaaaaaaaaaaaagtaaaattgtctttttttttttttgcgtaccaaatccta

SEQ ID NO: 12255 - DNA, 201 bp, Homo sapiens
aggaagactccatctcaaaaaaaaaaaaaaaaaaaagtaaaattgtctttttttttttttgcgtaccaaatcctatcaatgaaagagacaggaatagattygactggaatagtcatgggagccatttccaggctctcatagtcttagagatgacacttggtagttcagtgtcttattgtgcttcttcaagcacatacagcc

SEQ ID NO: 12256 - DNA, 201 bp, Homo sapiens
gtccccaggggacatattgtcaattgtctggagatgtttttgattgccacaactgggaagatgctaacggcatctagtgggtagaggtcaggggtgttgcyaaatagcctacagtgctcagacagcccccaccacagagaattatcccacccaaaatggcaatagtgtagaggttgaaaaatgtcactttaaaatgtaaat

SEQ ID NO: 12257 - DNA, 201 bp, Homo sapiens
caatacgaaaccagatctaactgaaacttcactcaacacattcccgacccgccaccccaaccctaatagcctctcataaccaccgttctactctacttctrtgagttcaacttttgcagtctccaaaaagaagtcaggtcatgtgatatttgtctgtgcgtggtccatttcacttagcataatagggggactaagttcaag

SEQ ID NO: 12258 - DNA, 201 bp, Homo sapiens
caccgttctactctacttctatgagttcaacttttgcagtctccaaaaagaagtcaggtcatgtgatatttgtctgtgcgtggtccatttcacttagcatratagggggactaagttcaagagatctactgcacaacatggtgaccatagcaaataataacatcttgtattttgaaaatcactaagggagtagattttaag

SEQ ID NO: 12259 - DNA, 201 bp, Homo sapiens
aaattatcactgctttctaagacttaccaagctaggggtgttgtaaagtatgtatgcaattgacttttgacttttgattcttatgttgaaaggcaacataraaaataagcttccattaatgtaatgatatagtgttaggaagacagtatctacagtccattcaaaatattctgaaaattatagtattgattttggaacagt

SEQ ID NO: 12260 - DNA, 201 bp, Homo sapiens
ttgcttttggattctttctaaaccaaataaataaatcttcgagactgcaggttaatcaaatgccttcaaacatgaaggctgtttaggagctaagctgcacrgacattttccaacatttaaactcttcatgcagcatcttcctatctcaatttgtacccgttagccagttccacagggcatattgggaaataccttttattt

SEQ ID NO: 12261 - DNA, 201 bp, Homo sapiens
agctaataaatactgtgcagagaatcatgaggagttgatgttcagttagtgagcaggctggttcgttactagggaagatgtgaagggcctctgagaagtaraattgtagcagagacctaaataacgagaaagacctagccaagcactgagcaaggcaagggatgttcctggaagggaagccagagagtatggccagagccc

SEQ ID NO: 12262 - DNA, 201 bp, Homo sapiens
tcatgaatcacaaatgttcttaatggtatctagaatggcggatccttctaacaattttttcaatttatttttcccagatccattagaagaatcactatctrtggcagctattgccttacaaaacgtgtttcttaagtaagatgttaaagtcaaaattgctttttgatccatgcacagcagaatggatgttgtgttagcagg

SEQ ID NO: 12263 - DNA, 201 bp, Homo sapiens
gaacagtactattttgaaaggaatcttttattccaagcactaggtctcaacaatggacttaaaatatttagtaaaccatgctgtaaacaactgtcatctakgctttgctagtccacttaaagactacaggcatagtacatttagcataattcttaagaaccctaggaattttgaagtggcaaataagtattgactttaagt

SEQ ID NO: 12264 - DNA, 201 bp, Homo sapiens
tttgatggctctgcggctcttttttccctttttccttgcttttttttttttttttttttgcaacacaacagtcgtgcgatggcctttcctacatgccacasggatgcagccttctgataggagggcaaagtcggcacatccacacacacactggcatacgctcttgcacacacagtctctgtcacatacacaggcgccaag

SEQ ID NO: 12265 - DNA, 201 bp, Homo sapiens
tctttattagtaattataagtgaaattggaaaacattttgcctaaaagaaaaaaatcacaaaatcctcagagcaaaatgctgatggtcttacctttctagmatccctctcccttcttggggctgaccctgaggagttagggagacagggttacgtcattgccagagaaaggggataaatggggagtaggatgccttggggg

SEQ ID NO: 12266 - DNA, 201 bp, Homo sapiens
ttacgtcattgccagagaaaggggataaatggggagtaggatgccttgggggtaaattattgtgcccaatgcagagaagagattgctcttggtatcccccrgccgtgttctccttacatgacccctcaggtgtggataggagacttgcaaaagaagaagcattccttctaaaacctcactgcctagaaatgtgctggcccg

SEQ ID NO: 12267 - DNA, 201 bp, Homo sapiens
ttcctggctgccagggtagggctctttctactccatcatgctgcctggtgggctgtgggcccttttccaagggtattgcagctgctgctgtgggggctgcmtggggtgccttcttagttctctttcttcagaggggagtgaggtcttggtggggcaggtgggtggtaggtgtgtctctaaggaaggcacacttgcagagct

SEQ ID NO: 12268 - DNA, 201 bp, Homo sapiens
ttcaggcttaggaggagggggctgctggttgtagcactgctgcttaggagtaatgctgctggttgtcttttgcatggcactaaggaaactctgtttcccarggtgtccccgttaccttcttccttgcttcatgcaccttgtctgaggagggagttgaggtgatttggggtggtgataggtgggcagaaggtagagaacctg

SEQ ID NO: 12269 - DNA, 201 bp, Homo sapiens
taaacctgcatgggacagccacactccccatggcccttgcagcagggactggccctcagcgtgagatttcagtgaaaggacaattatccagcacctgcttygagcagggcatcatgctctgctatttttcacttaggtgggtagtgtcctcatttatctgttgaggaaactggtgatcagaggggttaaatcgctttttta

SEQ ID NO: 12270 - DNA, 201 bp, Homo sapiens
aaacctgcatgggacagccacactccccatggcccttgcagcagggactggccctcagcgtgagatttcagtgaaaggacaattatccagcacctgctttsagcagggcatcatgctctgctatttttcacttaggtgggtagtgtcctcatttatctgttgaggaaactggtgatcagaggggttaaatcgcttttttag

SEQ ID NO: 12271 - DNA, 201 bp, Homo sapiens
ctgtgtacccagtctcgtgttcagcatgtgacatatatttgttctttgtttttttttttttttgtttctgtttttttgtttttttttttttcttgttttaracagaatcctgctcttgttacccaggttggagtgcagtggcttgatcttggctcactgcaatctttgcctcctgggttcaagggattctcctgcctcagc

SEQ ID NO: 12272 - DNA, 201 bp, Homo sapiens
aacttgctgcatattgaaatcaccatattaaaattccaaacccatgctgcacctcacaccaactaaattagactctttagggacaagagcctgtcctcggygtattttaaagcttccaggtgatcccaccaggcttgctaactgatagtttggaacagcctctcctgcaaagcaggtgttgggaggctggcatctcttcca

SEQ ID NO: 12273 - DNA, 201 bp, Homo sapiens
atcagagcagccaaatgtgaatgcaggtgagttctgtgtgtgcaaacttgggcaagtaatttcccttctcagagtctcagatttgtcatttacaaaatagsaatggcgtcatacctaccctacggattcctacaggttggttgggaatattgaggagttgtcagtaaattatctactttagtgctctcagaatgatgtctg

SEQ ID NO: 12274 - DNA, 201 bp, Homo sapiens
agtccttgagggccaaatgagaatgtctcaccctcctatcctcagttccctttcaggaactaccttccacagacaaagcctggaactttctcattttgaasaggaatacctgtgccatgtgcattgcaaaataacaacacaaactagaaaacaacaaaattcagaaaacagagaaattcatagaaaagaaaatgaagatca

SEQ ID NO: 12275 - DNA, 201 bp, Homo sapiens
accttagcctcccaaagtgctgggattacaggcatgagctgctgcccccacccagtgactctcttttatatatgaaaggaaatcgatttgtttctaaccakgtaagcgtcctacataagggaagacaatgaaatttcctcagaaaagtacaaggaaaattcattttcccttatttttcaaagcatctgcttggatagagct

SEQ ID NO: 12276 - DNA, 201 bp, Homo sapiens
gaagacaatgaaatttcctcagaaaagtacaaggaaaattcattttcccttatttttcaaagcatctgcttggatagagctgtaaaaccagaagaactgtrtgtttcattacaagcaaattcacaactggtggggtgtggggctgggccagggggatgaccattggtgaaggactaacttacatgtttcagaagctttaca

SEQ ID NO: 12277 - DNA, 201 bp, Homo sapiens
gggctggtgtgatggaggtgggaatgtgggagtggtgccaccagtgtgactgaatgaggaaaatcttgagatggaaatgatgggggaaccaagcagacccstaggtcactctttagctcagggcctcttgtggcaagtaccaccatgccgatgggtcagagttccagaaactgggatgagcaggggatattaaatcatccc

SEQ ID NO: 12278 - DNA, 201 bp, Homo sapiens
actgtaagtttgggtaggggagcctggaaaagcatcacatgaaaggcttttaaagagtcagggcagtgttaggaaacacaggctagccagggagtctgctrgagggtaagggcctatgtcttacaaacagaattggctccttttactaagaaacttgaatatcaagcacaaatggactgaagaggccaaagttaggtgtga

SEQ ID NO: 12279 - DNA, 201 bp, Homo sapiens
cctgcccttggaaagccctcctgccaggcactggacccatcaatgcatggtggcttgagggctctgcctttctctctctgtacctcacccacctgtcctgstagacatggtatcatagtgcccatcctctgcggctggctgctaggctaactctccccctctgcatctggactctggcccataggcatagaaagggggctg

SEQ ID NO: 12280 - DNA, 201 bp, Homo sapiens
gccatttgtctttgtgtctaatctgcaacgtgtgcagatgcagaagtggctcaattgatgacctgtcttctggagcactcaggggatcctgggaggctctsttgctcagacatttcagaggtgttaagaagcccttggtggagatctgtgtggggaggttaattatgactgtcccccgaccccccacccttttttttccct

SEQ ID NO: 12281 - DNA, 201 bp, Homo sapiens
ctaatcccattcatgaaggctccaccctcgtgacccaatcacctcccaaaggctccacctcttattatcacactggggatgatttcaacatataaacttargtgggggaatgtgagcattcaggccataacactgccatttatatttttgtgttcattcatttagtaagtaggtttccaaaaatttgtttgaggtgtaagc

SEQ ID NO: 12282 - DNA, 201 bp, Homo sapiens
actaggaagcacccttgtccacagctgtttcctgccgctgctttgttggtgctgggaagtttcgtttgtgctgggggggtttcgtttgtgctgcagggggktggggggggcaggggttagtttgtgcacctaggtggccactctttggatctcccacatctgttctgggttctgaactttgaccccgttcctgcttcttcc

SEQ ID NO: 12283 - DNA, 201 bp, Homo sapiens
ctaggaagcacccttgtccacagctgtttcctgccgctgctttgttggtgctgggaagtttcgtttgtgctgggggggtttcgtttgtgctgcaggggggkggggggggcaggggttagtttgtgcacctaggtggccactctttggatctcccacatctgttctgggttctgaactttgaccccgttcctgcttcttcct

SEQ ID NO: 12284 - DNA, 201 bp, Homo sapiens
ggcacggggatcaagcccgggcccctctcctatctaccctggatatgagccgtggccaccttattagtctgtctgtgtcctgctgtattcctttcaaaacmgggtcccacaccatcgaaaatacagactttgtctcatcactccctctgtttaaaatcttccaacagctccccaagactttcttagcttggcatccaggac

SEQ ID NO: 12285 - DNA, 201 bp, Homo sapiens
agattctggatattagccctttgtcagatgagtaggttgcgaaaattttctcccattttgtaggttgcctgttcactctgatggtagtttcttttgctgtkcagaaactctttagtttaattagatcccatttgtcaattttggcttttccaacaagactttttagccttacatttttttcccactattcgctcccaccca

SEQ ID NO: 12286 - DNA, 201 bp, Homo sapiens
tgatgttaaattgccaagggtatggagatggggagagtgaagaatttgagacattaatacaatcaaacccaatcaaaccactacacaacattatgggagaratcgctgaattttctttcttttttttttttttttttgagacagagtctcactctgtcgcccaggctggagtgtaatgcgtgatctccgctcactgtaacc

SEQ ID NO: 12287 - DNA, 201 bp, Homo sapiens
gaggctgggaagcaagattccacctcctacttctgcagagaagctctgcttttaactgtcttatgttttggggtttacttctttttttttttttcaatcaragtcttgtggcttaagaaaggaaagccctgttataatggaaataaacccggtcaaagggtcctgatagttgagctgtagtgccacttccgccaccgtcca

SEQ ID NO: 12288 - DNA, 201 bp, Homo sapiens
tggattgtattgtactccatgtatagacctacttagtactggacatagaacccctaaagatgtccagtctcttctgggtcatccccagtaacagggagccygcttcatttggaggtaatctgcttctaagataaagacataaatactctctgtagaacttccgttcactagacaaaattctatcctggagggcaatagaga

SEQ ID NO: 12289 - DNA, 201 bp, Homo sapiens
tcgtgacttcctaaatcaaacccacttgtagacagtccgacttccttgagtctgtctcaagctcagctaaagctccaggcagttggaaaagggaggaatgraattggaaggaggggtggggagggcaaatggcagccagatcttctgagccacaccttgtggcaaatagcccacatgtcagagttgtgtgagccccccccc

SEQ ID NO: 12290 - DNA, 201 bp, Homo sapiens
ctttctccttcacagggcagatgaggtggggtgtgtgttgcaggctgcacttgggggatgggactaccatgaccccctttacttgcagtcactggctccayagtatgggtccatcacagtgaggccccagaggcagagctagagtaagggaggctttagggcagggctccaaaggtcgagtgcccttccttacacaaaata

SEQ ID NO: 12291 - DNA, 201 bp, Homo sapiens
gcctgtgtctctgtcgtgagatggagcattgcctccctggatgcggatgataagcaaaatgtcaagttcctggtgcaggaggttatcagcttggcctgtcycaggggctttgttccttctagccagagagagagagagagagagagagagggagaataggaaagaaaatgaaaatgaatgaatatgagtatagtattcaat

SEQ ID NO: 12292 - DNA, 201 bp, Homo sapiens
gccgagatcacgccactgcactccagcctgggtgacagagtgagactccatctccaaaaaaaaaaaaaaaagattggaagttctggaatacattggagaaratgaaaaggggattggattagacttgcctaacaagcccatcatggtagccagagtcagacacaccaacagaaataaagatttcgctaaaaggcctagtag

SEQ ID NO: 12293 - DNA, 201 bp, Homo sapiens
gaatgtgtccaaaacatattcatgaagtcaaaacgtcaggaccaaaatagcctgtgttgtttatagagaccagccactcagaaggattaagaaacttaccygaggtcatacataaagtgggcagcagatatctgttgggtcactatagaatctacagcccctcttgttcagtgaggggcagagtaaggatgtaaaattggg

SEQ ID NO: 12294 - DNA, 201 bp, Homo sapiens
agtatggatgaaatcttctgaagacttgggatattaaaaaacaaacttggtgtgctctaaatttactggaccaccgttttgttttgttttgttttgttttkttttcaaagaacaactgttcacatcttgctggatgttgtgatgttgtatttttatggaatttagttttggatatgctaccccagcttttaatcctttctc

SEQ ID NO: 12295 - DNA, 201 bp, Homo sapiens
ccagagtcctggttttaagcattgcgtgtgtatagacaaatatatatgcacacacacatacatagaatcatgtgaactgatgcaggcatttatggataagwgtcagatgacttagaatggtttggagactattctgaactggctagaactttgagttaaaaagaataattaacttgaccaaataggaagggagcatcattt

SEQ ID NO: 12296 - DNA, 201 bp, Homo sapiens
tcccagcagagaagtgaccaggggtcaccacatagagctgggccctgcatagggtctcccagccaagggggtgaatgggggtatgaatccaacctgtgttyctcttgccaagcttgtgcccatgaggctgcctctgacaaaaggggcatctttttctagtgctcacacaggcgccatattggtcctgggtgagataacatg

SEQ ID NO: 12297 - DNA, 201 bp, Homo sapiens
gaagtgaccaggggtcaccacatagagctgggccctgcatagggtctcccagccaagggggtgaatgggggtatgaatccaacctgtgttcctcttgccawgcttgtgcccatgaggctgcctctgacaaaaggggcatctttttctagtgctcacacaggcgccatattggtcctgggtgagataacatggtggagtgaa

SEQ ID NO: 12298 - DNA, 201 bp, Homo sapiens
ctggcagtgtcctggttgcttctgaaaagctaaacagaaaagtccttaccaatgcactttatgatcctggtagcccatgctgctacctggaatgtcctccmtctaaaccctaaaccattttccaagacctgttaaaaattcctctgtcctccagaaaccttttctgagcacctggaaccctctttatagtccctactggtc

SEQ ID NO: 12299 - DNA, 201 bp, Homo sapiens
tccagaaaccttttctgagcacctggaaccctctttatagtccctactggtcttattgtctgaattaatcatttgacacttaggaattatccattcactcrttcaatcatcaaacacacactgaacacttattgtctgtcaggtactataataggtgttgccttacatgtcagtacatttccatagcataataaaaataac

SEQ ID NO: 12300 - DNA, 201 bp, Homo sapiens
ttatcacaaatcctacctattgcacagaacaacggtaaaaggaaagttctcgtgattaggcccagagcagttctgcaaacacaagactgtaagctagaaarccaggctttctgcccagcagcaggaaggctggggtgtccatgtttgttgcatgtcccagggtatgtgcatgtggagtctgacatgtgagcaagcgtgcgg

SEQ ID NO: 12301 - DNA, 201 bp, Homo sapiens
aggatgggactgagaagaaatgaatgggatggagcttgaacatgaagctgagggagcagccttgctggtcacagcgtttactgcttgtttaagcttccacrttgtatgtttgttttgcgctgcctccttaggatgttgcaatgctactgcctttactgttgtgagtttttgttttgtgtgttttatgtctctttgtgtgtt

SEQ ID NO: 12302 - DNA, 201 bp, Homo sapiens
ttcagtgcatttcatgttcagtgtttggggatgattctgtgttggcctgcctccctctaaactgagggcgggccttctgcatgatcttgtactctttctakcaggaacgggggagggtgttctaagatcccctcccagtaaatatattgagggaacaggggaagtatgaaattatgtatcattgttgctattatttggaat

SEQ ID NO: 12303 - DNA, 201 bp, Homo sapiens
gaaaggaggtgggtgggaaagcagggagaggaagaggaataaatgattaaagggctacatctggctgtatctccacctctccactgacgctacttagtggraggcactggtgacctcataggcacagccaccaatctgcctaggactcaacttttctgatgcgtgtggcactgttgcctcttctctcattggcaatacatt

SEQ ID NO: 12304 - DNA, 201 bp, Homo sapiens
gataagtagtgtcctagtgtaagagaagcaataggtcatggtgggaatcatggcaaactggagagtgcaagtcccatcaaaggcagtagtctccactctgytccagctgatcgctgccatgcaaggatgcaggcacagtcaccagatgctcaagaaaagccagaagtggacgtgataaaaatgtcatctgaaggtatcttc

SEQ ID NO: 12305 - DNA, 201 bp, Homo sapiens
tcaatagtgggaggtagtttgattaattttctctttgaccattgctgtgatcagttaccaagaatccttcctacccttggcactaccttcggagaggctgktctgtgtgttgggtaaagttgcttttgtagagtggtgtgggaaagtgtggggagggtatggagaatgcagagaatgacctgggagagaggtatctgacat

SEQ ID NO: 12306 - DNA, 201 bp, Homo sapiens
aagttaatttactgttgactcttaaagagatactgctctttttttcccccaacccacacaaaacagagaccttccacctggagctttgaaaagtgcttccstgcaggttggaagctttccagtcagttgtaacaacgatggcaagtattgggatgaaaaatgttgcttaataacattttcttgttttttttttatgaatat

SEQ ID NO: 12307 - DNA, 201 bp, Homo sapiens
atgtgcagatttgttatacaggtaaattgtgtgccataggggtttggtataaattattttgtcacccaggtaataagcattgtacccgataggtagttttyccatcctctttctcctcccaccctccatcctccaccctcaagtagtccctggtgtcttgttcctgtcttggtgtccatgtgtactcaatgtttagagatg

SEQ ID NO: 12308 - DNA, 201 bp, Homo sapiens
gggcctggtggctacagtgacagtctctgccccagtggatgagttgtgttctgtgcttctgtgttctgatcttgtgtcatgcgtattagctttcttcagcycaccttcattcaaacaaaggtgagtatggtttctatgagatagagaatcacttctcattcatttttctattacacacatgtatgtgtattttgtgtattt

SEQ ID NO: 12309 - DNA, 201 bp, Homo sapiens
ctgccccagtggatgagttgtgttctgtgcttctgtgttctgatcttgtgtcatgcgtattagctttcttcagctcaccttcattcaaacaaaggtgagtrtggtttctatgagatagagaatcacttctcattcatttttctattacacacatgtatgtgtattttgtgtatttttcttttcctttctttctttctttct

SEQ ID NO: 12310 - DNA, 201 bp, Homo sapiens
tcaaacaaaggtgagtatggtttctatgagatagagaatcacttctcattcatttttctattacacacatgtatgtgtattttgtgtatttttcttttcckttctttctttctttctttctttctttctttctttctttctttctttctttctttctttctttcttccttccttccttccttccttcctctccttccttcc

SEQ ID NO: 12311 - DNA, 201 bp, Homo sapiens
tgtatttttcttttcctttctttctttctttctttctttctttctttctttctttctttctttctttctttctttctttcttccttccttccttccttccytcctctccttccttccttccttcctttctctttctttctttctttcttttctttttatttttttttgagacagggtcttgctctgtcacccaggctggag

SEQ ID NO: 12312 - DNA, 201 bp, Homo sapiens
cttaaacaacaaagggcatttatgggctcagtttctaaaaagtccagtaactcacatgatatgaccaagacctagtgtttgtcttccccattttttggctygactttcttggtgttggcttcatttttggcagctcctgcccatgtgattttaagatggctgatggccattcccaggatgatttggtttttggtctttgta

SEQ ID NO: 12313 - DNA, 201 bp, Homo sapiens
atcccatttagaaataccttcccagacacactcagaacaatgtttaatcagagtactgggactcagttaagttgacacgtaaaattacacttcacaagtcyaccccttttcaactcgacactcatctatatctccttaaatgatacttaatctataaataaagataaaaagatcataatttcacctaacatgatacaccta

SEQ ID NO: 12314 - DNA, 201 bp, Homo sapiens
ccgtgagccccaagtcccacccccttgcccaaatttatcagggcttgccttacacactggtggttgctatgggcttgggtgactcccaacagcgatgacartatacattctcagtaacctggagctggcactgaggctgcagccctggacatggggtgtcctctgggtataatctcacttaactttactctgcaaatgcaa

SEQ ID NO: 12315 - DNA, 201 bp, Homo sapiens
gctgggcgtcggagattcagagaccatgttccttgataaccagcaattaccttctgaatgttacctgagtgcagatgaggaaggtctctgaaagcatacarggcgggggcttccaatacacactccctactttggactgttcaccactttgaataaaactaggatcacactcccattccttccaaaattcttactcctttc

SEQ ID NO: 12316 - DNA, 201 bp, Homo sapiens
ccgtccaaggatttatccttccataatttgaactgaacgtgaggaatggacaggggttatgtttcggggtgtgggaaggcacctgagccatggtggtcctyatagccacagtgttgcataggactatcccttcctctctcttcagtgtgatagggtcagaggcagaagtactctgcctttcacagtgtcacagattgcttg

SEQ ID NO: 12317 - DNA, 201 bp, Homo sapiens
gttatctattattatcgttatttttatcattatcatcattgccctgtgtgcccagtctgtacctgatggaatggcctttctcattcaagtaggggaagaarcatccagagaacagtttgaaaaaaatcatagggtgtaaaaaaaaagcctagggtcaggggatctagattctttcccaagctctgctatagctgaccttga

SEQ ID NO: 12318 - DNA, 201 bp, Homo sapiens
tcattatcatcattgccctgtgtgcccagtctgtacctgatggaatggcctttctcattcaagtaggggaagaagcatccagagaacagtttgaaaaaaakcatagggtgtaaaaaaaaagcctagggtcaggggatctagattctttcccaagctctgctatagctgaccttgaatgagttgtttcatctctctgcccct

SEQ ID NO: 12319 - DNA, 201 bp, Homo sapiens
ctccatcatattacattaatctcagagctaatctaaaactcaggttttaaatttttgattccatgctgtttctacaatataatgtatttccttgaaataargtatgccatagtgctgaaagccattgccatgtatgatatacttgggttttttgaatttgtccagtcttttccactttgtaggaaggttctaagattagcc

SEQ ID NO: 12320 - DNA, 201 bp, Homo sapiens
ttaatctcagagctaatctaaaactcaggttttaaatttttgattccatgctgtttctacaatataatgtatttccttgaaataaggtatgccatagtgcwgaaagccattgccatgtatgatatacttgggttttttgaatttgtccagtcttttccactttgtaggaaggttctaagattagccaaccccttaatgggc

SEQ ID NO: 12321 - DNA, 201 bp, Homo sapiens
aaccactaacatttcttgggtgcttacatatatgtcaggtaaattgtatgtttcacattcattatctgattaaatgttctctcagcaaacctgtgagctargtactattattttctcaattttacagacaattaacttatggtttagagagttgtgttgacttgtccagtcacatagctaatacattggtgttcaaatgct

SEQ ID NO: 12322 - DNA, 201 bp, Homo sapiens
atagtactcacagaaatggtttctatagttttctgcaaattgttctacatagtgttgatatgtttagctctagggcatctatttttgcctgctgtatagtrttctatcaataaatatactacattcctttcttctagtagtagacatttagattgtttacagttattagcttttgcaaacatttcagtttttgcatacatg

SEQ ID NO: 12323 - DNA, 201 bp, Homo sapiens
tgtatttattataggaagagatttacattcttttcctttatactaataacctaagccagtttatgggcataggtaggtggagaaatgtaattcattactgwgtaagtgggtctacagcccatttagtagggccattatatatttttttccagatagaatttatttaaagaaaatgattttcaaagctgatattaagtcaga

SEQ ID NO: 12324 - DNA, 201 bp, Homo sapiens
tactaataacctaagccagtttatgggcataggtaggtggagaaatgtaattcattactgtgtaagtgggtctacagcccatttagtagggccattatatwtttttttccagatagaatttatttaaagaaaatgattttcaaagctgatattaagtcagattctgtgacaagtacgcagtggttctcaaccttggctgca

SEQ ID NO: 12325 - DNA, 201 bp, Homo sapiens
atttatttaaagaaaatgattttcaaagctgatattaagtcagattctgtgacaagtacgcagtggttctcaaccttggctgcacattggaatcaatgggragctttaaaaaattctgatgtatggttctcagccccccagagagtctggttttaattggtctcaggtgtggcctgggcagtggacgtcttaaaggctctc

SEQ ID NO: 12326 - DNA, 201 bp, Homo sapiens
tccacaaaacagacaggtgtcttatacaaactcccaaagaaactgtgggtggaggagaaaccagcactgtatgagagcaacaatgaagtggccgagctgtyacttctcctgatttgagttctttgtccagccacattccacggtgaaaacactaaaggtacgttcagaaccgatacaaactcatccaccacaaatatcaag

SEQ ID NO: 12327 - DNA, 201 bp, Homo sapiens
aatttgttttcactattgttaatgattaacctttccctaagttccactgtacctggaaatgttgcctagtaatgcaatggaaccaacaggattagcaagamattaaaaaaaattaatctacatctcattctttttacattttatattttgatgtaggttttatagttaatgtaatgttgcaatagatcatgtacatgattt

SEQ ID NO: 12328 - DNA, 201 bp, Homo sapiens
ttgtccttagaaaaaagcatatttattttctttctttttttttaaaacaaggatatccacattttattgttttccttttatctgattctgaaaaaaaaaawtttaccagaactatgtattttttcctgtggatataatcatcaggctaatccctacgatgactaaaagttgtggtggttgcatggtcaccaacttctctct

SEQ ID NO: 12329 - DNA, 201 bp, Homo sapiens
agtgcagttcactgcagcctctgcctcctgggttcaagcaattctcctgcctcagcctcctgagtagctgggatcacaggcacccaccaccatgcctggcwaatttttttgtatttttagtagagatagggtttcaccatgttggccaggctggtctcccactcctgacctcaagtgatccacctaccttggtttcccaaa

SEQ ID NO: 12330 - DNA, 201 bp, Homo sapiens
ttagaacttcctggatttaatttctgactccatcacttgcaacatattggtgctgtgcatgttattagaatgatttgaggtcatctaaatattaaggatawgctaaggtatgttgaaaacatcatgcagagttacacatagtagggttcaaatattcatttctaacttttctttcattaaagagttcctcttcctcttgaa

SEQ ID NO: 12331 - DNA, 201 bp, Homo sapiens
aatctttagtataagttttatggttgtttattacttaaaataggaaagcttcactaatagagtggttgttataagtaagggttagagagagcatattaagktatacctgggagtttatagttctttaaatcttgtcaaactgtattattcttttaaatatgtcatatgacggtttataattattgtgaatactttaaaaag

SEQ ID NO: 12332 - DNA, 201 bp, Homo sapiens
gagagagcatattaagttatacctgggagtttatagttctttaaatcttgtcaaactgtattattcttttaaatatgtcatatgacggtttataattattrtgaatactttaaaaagctggtggtgaatacgttacaggtggatcacacctgtaatcccagcactttgggaggctgaggcaggtggatcacttgaggtcga

SEQ ID NO: 12333 - DNA, 201 bp, Homo sapiens
agagagcatattaagttatacctgggagtttatagttctttaaatcttgtcaaactgtattattcttttaaatatgtcatatgacggtttataattattgwgaatactttaaaaagctggtggtgaatacgttacaggtggatcacacctgtaatcccagcactttgggaggctgaggcaggtggatcacttgaggtcgag

SEQ ID NO: 12334 - DNA, 201 bp, Homo sapiens
gtttataattattgtgaatactttaaaaagctggtggtgaatacgttacaggtggatcacacctgtaatcccagcactttgggaggctgaggcaggtggakcacttgaggtcgagtttgagaccagtctggccaacatggtgaaaccccatctctactaaaataccaaaattagccaggtgtggtatccttcgcctataat

SEQ ID NO: 12335 - DNA, 201 bp, Homo sapiens
tttataattattgtgaatactttaaaaagctggtggtgaatacgttacaggtggatcacacctgtaatcccagcactttgggaggctgaggcaggtggatmacttgaggtcgagtttgagaccagtctggccaacatggtgaaaccccatctctactaaaataccaaaattagccaggtgtggtatccttcgcctataatc

SEQ ID NO: 12336 - DNA, 201 bp, Homo sapiens
attgtgaatactttaaaaagctggtggtgaatacgttacaggtggatcacacctgtaatcccagcactttgggaggctgaggcaggtggatcacttgaggkcgagtttgagaccagtctggccaacatggtgaaaccccatctctactaaaataccaaaattagccaggtgtggtatccttcgcctataatcccagctact

SEQ ID NO: 12337 - DNA, 201 bp, Homo sapiens
agtgaaaattctttttttaaaaatttttgctggttcaacttcttcctccttgatacacacacacacacacacacacacacacacacactcattctcctaamgataatatcatctctgctagatccattctttgagatttgtgatacagcactgaaagactgagaagaaagagagaattaaagtagcaggactaaaaatggg

SEQ ID NO: 12338 - DNA, 201 bp, Homo sapiens
aagagattgggagaaaggattaaaaacatgacccaactctgtgttatctatgagaaatacactttcgatataattatgtagacaaaatgaaaatgataggwaaatatatattatgccaacattaattgaaagaaaataggagtgatgatattaatatcacatagactttagagcaaagactgttgccagagacaaacaggg

SEQ ID NO: 12339 - DNA, 201 bp, Homo sapiens
ttggaggcttcacagtcttctcaaaattggtaataggtaattggtaataaattgatataggaaatcagcaaggataaatgtatgagtctgctagggatgcygtaacataatgtcacacacagagtggcttaaacaatgtaaatttatttctcacaagataatgtggaagctgaaagtccaagagagaggtgtcagaagttt

SEQ ID NO: 12340 - DNA, 201 bp, Homo sapiens
gtcacattgggagttagagcttcaacatatgaattgggatggggaaacataatttagtccataacaatataaaataactcaaaaccactaccaactaatasgaactaattgacatatatagaatacccaacagcagcagaatacatatttttttgcaggtgtccatagaacatataccaagatagaccacatcctgggcca

SEQ ID NO: 12341 - DNA, 201 bp, Homo sapiens
aagatagtacaaaaaccccactacataccaatgtccttcatgaatatgacacacaatctttaaaaaaatattagcaagtacaattcagcaatatgtaaaargaattatgtaccaggaacaagtaaagtagaagggtgcagggaatgcaaatctggctcagcattcaaaaattgatatatcccacaatattaacaggctaaa

SEQ ID NO: 12342 - DNA, 201 bp, Homo sapiens
caggtaagttcagcagtgtcacaggattcaatttaaatatacaaagaacaattgtatttctatgtattagtagtgaaccacatggacatcaaaattaaaayatgatgccatttataatggctcagaaaataaaatacttcagtataaatctaacaaaatgtgcacaacttgtatgctgaaaactgcaatgctaaaagaaat

SEQ ID NO: 12343 - DNA, 201 bp, Homo sapiens
gaagactcaaaatagtagagatttcaattctccctgaattgatatccaggttgtaatgagttgagtttggcccctcaaaagatgtgtttacagcttgcagygagccgagattgcgccactgcagtccgcagtccggcctgggcgacagagcgagactccgtctcaaaaaaaaaaaaaaaaaaaaaagatgtgtttacatct

SEQ ID NO: 12344 - DNA, 201 bp, Homo sapiens
cacacacacaggagtacacagacgcaaaggagaaggcaatgtgaagacagagcagagggaaatgcagccacaagccaagaaatgttaccagtgccagaagstggaggaattaagaaaagattcttccctaaaacctccagagggagtgcaaacttgcttgatcctctgatttcagactcctggtctttagaactgtgagag

SEQ ID NO: 12345 - DNA, 201 bp, Homo sapiens
ggggtttcaccatgttggtcaggctagtctcgatctcctgactcaaatgatccaccctcctcggcctcccaaaatgctgggattacaggtgtgagccaccrcacccggcctatacttaatattgtttttgaggttatctgcaatgctcacccccagctcacaagaccaatgtagtactttatgtataacaaatgtcaataa

SEQ ID NO: 12346 - DNA, 201 bp, Homo sapiens
tctgtgctcaatgaaatatgtgttttcctaactctgacactcactgttattgcaatgcatacagactcctcaaagatcgtaagccctaaaagttgataagwgttcagagaacaagctctcactcagtacaggaattctatcctgtgatatttcttgagagaatgaaattgttgaattcttagatcttgaaagcagtttaaa

SEQ ID NO: 12347 - DNA, 201 bp, Homo sapiens
tcctaactctgacactcactgttattgcaatgcatacagactcctcaaagatcgtaagccctaaaagttgataagtgttcagagaacaagctctcactcartacaggaattctatcctgtgatatttcttgagagaatgaaattgttgaattcttagatcttgaaagcagtttaaatcctcgagtagtggctaagactggg

SEQ ID NO: 12348 - DNA, 201 bp, Homo sapiens
gtaacaaccaggttattgacgctgatatcatcaagatacagaccatttccatcaccacaaggatccctcctgttaccctcttatagccatactaacttccygtaggcctatttatgatatccctattctgttccattgacctgtgtctttttgccagtactctgaagtatttattactgtagctgtacagtaagttttgaa

SEQ ID NO: 12349 - DNA, 201 bp, Homo sapiens
aaaaacaccaaagcatttgataagtgtatgagaaatgatggtcaattacagtataggctcattttggaaatacgaaggttcccagggagctgtccagggtrctggactctccttaaagctctcagactcagtgcatgagaattttccatttctctgtcttctaatttcttcttctgtttaacctttttaaataccagcctc

SEQ ID NO: 12350 - DNA, 201 bp, Homo sapiens
ctccagtcattttataaagcactagtggggtcccaaaatgccactttttattttttttgggatggcgtctttctctgttgcccaggctggagtgcaatagygtgatcttggctcactgcagccaccgcctcctgggttcaagtgattctcctgcctcagcctcctgagtagctggaattacaggcacccgccaccatgcct

SEQ ID NO: 12351 - DNA, 201 bp, Homo sapiens
tattttattggtgcaaagtggtatttggaagcttaaatgtggggcagaggtttgaagtagccaaatgaactctgtggccctgagagaagagaaaggataamcaaaagaaagggaaggggactcaggcatttttctcctaataaatctctaatttttcttggaaattttgcctccaggccgatgcctggccccagaacaggg

SEQ ID NO: 12352 - DNA, 201 bp, Homo sapiens
atacatacttttgggataagctcggattgatattctgggttctgcttagaatgataagatggagtaataagggagagtaatgttgattggtagataattaygaagaaatgagttctgttaaatagtagattaatatctgcaagtggaattattagacaaggacacacaaacacagggtctctctgcctgcctatcgtctgt

SEQ ID NO: 12353 - DNA, 201 bp, Homo sapiens
cgatcctgcttaataaaatattctattattttctcagctgcaaaagtacactattatcactgatcattccctcctcatctcagagtgtttgtcactggccmcagtttatatacaagctatacaggctgcctggaacttgaattggctttagagtggatgctggggaaggggcgggggggttccgggtatctgatgaattcc

SEQ ID NO: 12354 - DNA, 201 bp, Homo sapiens
ccaagggttgaccctgttttcatgctcctgtgatttacttacagaagggattatcacattggatgagaggctgaatttcatagacctcaaatgtccttttycaactctgagattttatgtgtctatgttttcatttccaaatagaaaataacccttatcattgctaatggtattcccttaaggaagttacttaatctttct

SEQ ID NO: 12355 - DNA, 201 bp, Homo sapiens
tctcggcctccctgagttctgggattacaggcatgagccaccatgcctggccatagtccaacttttaaattttggtttaggaagtgttttttatcccatcmatccagatctccctctcatagtcagttttcacctcttccctggggatacggctcaaggagaactttcatcatcttcaaatgcaaagaccacgtggcaatt

SEQ ID NO: 12356 - DNA, 201 bp, Homo sapiens
taactgactctttctcagctctcagtatcattcatagtcaggactttacatgtgtgtgtgtaatgtatatatatctgtgtgcacgtgtgtgcgcgcgcgcrcgcacgcacacacacacacacacacacacacgtaaagtcctgactaccagtgataataatacatagttttttgggggaagaagggatgcctcttgtatgc

SEQ ID NO: 12357 - DNA, 201 bp, Homo sapiens
tctcttgaacccgggaggcggagcttgcagtgagccgagattgtgccattgcactctagcctggtgacagactgagactccatctcaaaaaaaaaaaaagraaaaaaagaaaagaaaacgtgattacattgtaggagctggaggattgttactaaatcattcaaaacagcaaaagttaaaaataaaatagtgaccagttaa

SEQ ID NO: 12358 - DNA, 201 bp, Homo sapiens
aaaaaaaaagaaaaaaaagaaaagaaaacgtgattacattgtaggagctggaggattgttactaaatcattcaaaacagcaaaagttaaaaataaaatagygaccagttaaaaatattccactggtctaacaaggaggatataaataaattatgatgccttatagatataatattaggaatatttttcagccattaaaaac

SEQ ID NO: 12359 - DNA, 201 bp, Homo sapiens
tcacgtgattatggaggctgaaaagtcccaagctctacagggtgagttggcaagctggagacccaggaaagctgatgttgtagttctagtctaaagactgrcaggtctgagattgaggaagagccagtgtttcagttcaaaggccattagacaggacagattctgtcttactgcgggaggtcagcctttgtgttctattct

SEQ ID NO: 12360 - DNA, 201 bp, Homo sapiens
ctattctgctcttcacccaattgcatgaagcctatgcacagtcaatctgttttattcaacctacaaatttaactgttaatctcatccaaaaaaacgccctmacagaaacaactagaataatgtttgttcaagtatctgggtacctgatagcccaatcaactttgcacctaaaattaatcattttaatcatcacaccaatct

SEQ ID NO: 12361 - DNA, 201 bp, Homo sapiens
aagaccccacctctaaaacaaatgtttaaaaaaattagctgggtatggtgttgcacgtctacagtcccagccactcgggaggctaaggtgggaagaccacwtgagcccaggaggtcaaggctgcagtgagcagtgatcacaccactgcactctagcctgggtgacagagcaacaccctgtctcaatttttgaaaaatgaaa

SEQ ID NO: 12362 - DNA, 201 bp, Homo sapiens
ctattgggcccacctagataatcttccttttgccatgtacgttagcttgctaggactgccgtaacaagctgggtggctactgtgtttgaatgtgtcccccmaagtttatatgttgggtacttagtccccaatgcaacaatgtgagagttgggacctttaagaggtgattaggtcacgtgggctgtaccctatgaatggatt

SEQ ID NO: 12363 - DNA, 201 bp, Homo sapiens
agctgtggccaagaggaggccaggtggtgagaagagagggaaacagaggtgaataacagttccactaaaatccaagagacctgagcttgctagttgtctakagacaactgacagagaggggcttgcaggcggctaaagccattcaacaatttctggttgtccacatgccccttctatgggaacttgacttggtaccaggta

SEQ ID NO: 12364 - DNA, 201 bp, Homo sapiens
tgagggagagttggaattcaacccacaggtagcctgatttcaaagttcaggttcttaacaattatatggtggtttatttttttcttttcttttctttttcyttttttttttttatttttgagacagagtctcactctgttgcccaggctggagtgcagtggcatgatctcagctcactgcaacctctgcctcctgggttca

SEQ ID NO: 12365 - DNA, 201 bp, Homo sapiens
atgatctcagctcactgcaacctctgcctcctgggttcaagtgattcccttgtctcagtctcctgagtagctgggattacaggcatgcgccatgatgcccrgctaagttttgtagttttagtagagacagggtttcctcatgttggccaggctggtcttgaactcctgacctcaagtgatccacctgccttggcctctcaa

SEQ ID NO: 12366 - DNA, 201 bp, Homo sapiens
ttccttgagatgcaaaaaaaaaaaaatgtaatttgcaaagatgctttgttgggagataagtaggcttcctcttgggcacggagtttatctcactcgtgcayaggttcctagaggtcgtgcaactcacgagataaagctccaggatcctccccagggaaggccagagtcagtgttcagctgttttcctagatccagggttaa

SEQ ID NO: 12367 - DNA, 201 bp, Homo sapiens
tggctcatgcctgtaatcccagcactttgggaggctgaggcgggtggatgatctgaggtcaggagtttgagaccagcttggccaacatagtgaaactgcgyctctactaaaaatacaaaatgagccgggcctcatggtggatacctgtaatcccagctactcgggaggctgaggcagaagaaccacgtgaacccgggaggc

SEQ ID NO: 12368 - DNA, 201 bp, Homo sapiens
agtgagccgagatcgcaccactgcactccagcctgggcaataagggcaaaactctgtctcaaaaaaaaaaaaaaaaaaaaaaaaaggagtgtttgagtaarggagtaaggccacccaagatatttaatacaaggcaggttgtaagtttaagtgagtatagttggagtaaaaatagaagaaattatatctgttcttaaatta

SEQ ID NO: 12369 - DNA, 201 bp, Homo sapiens
ttcctcattccctccgcagcctcctatgacttctgatttcttgtctgaacttcaggaacagcacctctctctgtgtcttcctcatctcactcctatatggkgtttcattctctttatggtgttatcacatttatttatttatttttgagatggtgtctcactctgtcacctaggtaggaatatcgtggcgcgatcttggct

SEQ ID NO: 12370 - DNA, 201 bp, Homo sapiens
tcctatgacttctgatttcttgtctgaacttcaggaacagcacctctctctgtgtcttcctcatctcactcctatatggtgtttcattctctttatggtgktatcacatttatttatttatttttgagatggtgtctcactctgtcacctaggtaggaatatcgtggcgcgatcttggctcaccgtaacctccgcctttca

SEQ ID NO: 12371 - DNA, 201 bp, Homo sapiens
aaattttcttcagtgagatttttaacttttataatggaaaataaacattacaaagtggaaaaaaatgttttgtgccacaggtttgggatgtgtttgtgcakctgtgtgcatgggagtggctgttgccacattgtgttaaatgggatggaggctgggtagggcaggaactgtgctccagtcttctccaaggacaggtcattg

SEQ ID NO: 12372 - DNA, 201 bp, Homo sapiens
tcccttccttgcttccttccttcttccttctcctccttctcctcttcttctttctcttcctcctcctcatctcccttccctcccccatcccctctcccccsccacctcctctttctcctcccactctgtggtccaggctggagtgcggtggttcaatctcacctcactgcaacctctgtctcctgggttcaagtgatcctc

SEQ ID NO: 12373 - DNA, 201 bp, Homo sapiens
gttgttgggattttttttagatatagcaagtactcagcaaatttttgctgaatacatttacttagaacaaagggacactggcctcctccagccagccacayattattttatatatattattatgcaaaacacagttgttcagtattgcccctttgcaagatgctccttgacctttatctaagggaattaactgctattatt

SEQ ID NO: 12374 - DNA, 201 bp, Homo sapiens
gagacagaatcttgctctgtcgccaggctggagtgcagtggcgcgatctcggctcgctgcaacctctgcctcccaggttcaaacagttctcctgcctcacyctcccgagtagctgggacaggcatgcaccaccatgcccggctaatttttgtatttttagtagagatggggtttcaccgtgttggccaagatggtctcaat

SEQ ID NO: 12375 - DNA, 201 bp, Homo sapiens
acatgattcgtgagtgtcttcattcttctctttcttccctttcttctcttcaacacactcaacacacacacacacacacacacacacacacacacacccamgaaattcacctctggctctggaatctggagaaagttcaaagtcatgcagcaatgaccgtcagcatgattaggcctactggaatcaacaagataaattcag

SEQ ID NO: 12376 - DNA, 201 bp, Homo sapiens
attgctatatataataatttgacaaatccattaaactaatacttactgagtgcttactatgtgtcacacagtattgggcaatggagatacagtgataagasaagttttgtaatttcacagtgcctaatttttttaggccaggaaaaagactataaacaaagaaagacacataagaaacatatgagatagtgatttgtgcta

SEQ ID NO: 12377 - DNA, 201 bp, Homo sapiens
tgatggcagatgcctataatcccagctgctcaggaggctgaggcaggaagaattgcttgaacctgggaggcggaggttgcagtgagcagagatcacgccayggcactccagcctgggtgatagagtgagaccctcaaagaaacaaacaaacaaaaaacccaaaaaagaaatttggagaaataagcttcgtcatggggctta

SEQ ID NO: 12378 - DNA, 201 bp, Homo sapiens
taatcccagctgctcaggaggctgaggcaggaagaattgcttgaacctgggaggcggaggttgcagtgagcagagatcacgccacggcactccagcctggrtgatagagtgagaccctcaaagaaacaaacaaacaaaaaacccaaaaaagaaatttggagaaataagcttcgtcatggggcttatattataacaacagac

SEQ ID NO: 12379 - DNA, 201 bp, Homo sapiens
gtatttgttaaaagttagattcccaagtcagagctccagagagtcccagctctgggtggcatccaggaatctttatttaacaaaagtagattcttatacartgggtccaggaatctcattttaagaaatagtggattggagaatatgaagtataaaaattgttttcacagttgacctgagttgctaataaacaatttgcta

SEQ ID NO: 12380 - DNA, 201 bp, Homo sapiens
tagtcaatctgggttgcagttctgatttagatgtcaccgtactctgctttaaaggttattttggatctttgcctgtctttgatgtgttctagtacccatcktcctgtctccatccccagcatctgagaacacttctcatttccccactagattgtttttttaaatttttgagcatgctctgttttattttctgattatgaa

SEQ ID NO: 12381 - DNA, 201 bp, Homo sapiens
gtggctcacacctgtaatcccaacactttgggaagccaaggcaagtggatcacttgaggtcaggagttcaagaccagcctggccaacatggtgaaaccccrtctctactaaaaatacaaaattagccaggtgtggtggcatgcatctctagtcccagctactcaggaggctaaggcataagaatcacttgaacccaggagg

SEQ ID NO: 12382 - DNA, 201 bp, Homo sapiens
acatggtgaaaccccatctctactaaaaatacaaaattagccaggtgtggtggcatgcatctctagtcccagctactcaggaggctaaggcataagaatcrcttgaacccaggaggcagaggttgcagtgagctgagatcatgccaccacactccagcctgggccacaagagtgaaactccatctcataaataaataaata

SEQ ID NO: 12383 - DNA, 201 bp, Homo sapiens
atggataaagaagcagtttctaagatgccactcaagagctctctggagatttacagagagctggacttttttttttttttttgagacagagtctcacgctwtcacccaggctggagtgcagtggcacgatcttggctcactgcaacctctgcctcctgggttcaagcgattctcctgcctcagcctcctgagtagctggga

SEQ ID NO: 12384 - DNA, 201 bp, Homo sapiens
agttggccagaatggtcttgatctcctgatcttgtgatccacccacctcggcctccgaaagtgctgggattacaggtgtgatccaccacacccggcctccsaaagtgctgggattacaggtgtgatccaccacacccggcctgagttttctaaacttctgggtaaggctgtttgactttggacatgacgctaggcttaact

SEQ ID NO: 12385 - DNA, 201 bp, Homo sapiens
ttgataagggagtaggcaaaaaatgtctgagtcaccagaactggggtttcacaaatgaatggtctcgctgtaacctaaagtaagggttgaagtgggggaaratgaaacaataggtggctgtagcactggaagaatatttgcagccccacaaactaatgtctgaattacttaggatacatccctctgtctagagccagccca

SEQ ID NO: 12386 - DNA, 201 bp, Homo sapiens
gataagggagtaggcaaaaaatgtctgagtcaccagaactggggtttcacaaatgaatggtctcgctgtaacctaaagtaagggttgaagtgggggaagawgaaacaataggtggctgtagcactggaagaatatttgcagccccacaaactaatgtctgaattacttaggatacatccctctgtctagagccagcccaaa

SEQ ID NO: 12387 - DNA, 201 bp, Homo sapiens
atcctctggtttatggtttcttacaggttgcaatcaaggttttagccagggctgagttctcatctgaaagcttgactggagaagaacctgcctccaagttyacctggttgtaagcacaacttcattcctggagtgttgtgggattgaaggtgtcagttcctagctggctgttcactagaggctgccctcagtttcttgccg

SEQ ID NO: 12388 - DNA, 201 bp, Homo sapiens
tcctctggtttatggtttcttacaggttgcaatcaaggttttagccagggctgagttctcatctgaaagcttgactggagaagaacctgcctccaagttcrcctggttgtaagcacaacttcattcctggagtgttgtgggattgaaggtgtcagttcctagctggctgttcactagaggctgccctcagtttcttgccgt

SEQ ID NO: 12389 - DNA, 201 bp, Homo sapiens
tgagtttgactattacagatatgtcatataaatggaaccctgtagtatttgtcctgtgactggcttatttcccttagcgtaatgtcctccagtttcattcrtgttgcaaatgataggatttccttcttttaaaaaactaaataatagtcatgcttggatgaaactttgggttgtttccatatgttattgcgaacagtgctg

SEQ ID NO: 12390 - DNA, 201 bp, Homo sapiens
cacatatctcaaaggagtgctattgatttgatcattttatgaaattcttacccttttgctttcagaattctagctagatgacaaaaaggaaataactcacrcatgtaaattaatcaaactattttggaactcaaacattgcttgtggaagacttgcagattgagccaagccctgttctttattaactctggataatttgct

SEQ ID NO: 12391 - DNA, 201 bp, Homo sapiens
tgaaatcctatcccatgtttgcattgttaattatagttttcgaaagactgtcatctaggcaatctcatttcgcatgaccattctatgagacacaggaacawgcagtctattttggcagataaaaaataaatacatgaggagttaagtaaaaactgtgttactgagactgcagtaacttttataaatcaatgtgcaaaaaaa

SEQ ID NO: 12392 - DNA, 201 bp, Homo sapiens
tgcagtaacttttataaatcaatgtgcaaaaaaaattcaagtattttggaatgagatttgttggattgaaatattttatggtggtctgtaacatcagctcrtgagctcatagaccaaaccccatcccaaatacctggtgttcaggattatcaatataaaaattgatttaagatccccataattcatttactcctatttcct

SEQ ID NO: 12393 - DNA, 201 bp, Homo sapiens
acaagtgagaaagtattttaatcttcttacatttttaggccatgtccaaatcatttgttttttcactttattttatttgaatataatttaggttttctttytcatggggtgaatgaaaataaacactttagaaatgtataaatcagtgtgcatttattggagtatggccaataactttagataatgaaaaggatgattgag

SEQ ID NO: 12394 - DNA, 201 bp, Homo sapiens
catttcttatctggctggtatgatttaggcattattttatcactagaaaagccataacgatgaagggatggtatgttcaaagcagaggattaatatttackacatatctactatgagtaagttactatgcttttttacatatacttttttacatatcatttaatcaacagtcttgtgaattaggctattctgacagatgag

SEQ ID NO: 12395 - DNA, 201 bp, Homo sapiens
ggctgaggcaggagaatggtatgaacccaggaggcggagcttgcagtgagctgagatcgcgtcactgcactccagcctgggtgacagagcaagactctgtytcaaaaaaaaaaaaaaaaaaaaaaaaaaaaagaatacaagagagtgtgacccatagttcagactactcaagtctatgtgggtctgcttcctgaacagctg

SEQ ID NO: 12396 - DNA, 201 bp, Homo sapiens
gtcctgtgtttctctttctatattttgcttctgttgctcaacattactttataaaaattttttcatatcaaaaggcagtgctctaattcactctttttaaygggtgcataatattccagtctgatgatatgttatatatgtggtattctccttcctgtaaattataattttatttccatcttacttttttctaccatgcac

SEQ ID NO: 12397 - DNA, 201 bp, Homo sapiens
cacatactgtatgtaactgcacttcagaagtcaggtgcctagcttttaagaggataaatctaaattctttgcctgcttcttctagaatccttcccaaaccmttttccgttgccccctccctttttacctgttctacactgcatcccaactggttgttacattgtcccctgcacacgttttgcacattcctctgttgtttgc

SEQ ID NO: 12398 - DNA, 201 bp, Homo sapiens
tttacctgttctacactgcatcccaactggttgttacattgtcccctgcacacgttttgcacattcctctgttgtttgcccatccattcccctcactagaygtattctattcctttttctttcatgtaattctgattcgccctgtagggctctctgcacgttcccatcaaatgcttgttccattacccaagaccaggtccc

SEQ ID NO: 12399 - DNA, 201 bp, Homo sapiens
ctgaagaacctccagctgtcacagtctcttcactcctaggactgaaggacctgttctcttctccgcatctgttcctgcatccctgtgacatctgccccaaygaaatcagaagaggagaagggaccaggactctcacttcccagactatacattgttcagcttcctctttccccctttctgacatggaaatagcgagcgaag

SEQ ID NO: 12400 - DNA, 201 bp, Homo sapiens
cattcatagtgcattcattccagtattcatttcttccttgggtcctggcctactccttccttttctctcatctattcattctaatctcatttgaacatcargctcctcccactgtcgatactttatcatcattactatcccttttagtaacttagtaaaaaagcacctctaggatctttcaacttactaaagacttttcct

SEQ ID NO: 12401 - DNA, 201 bp, Homo sapiens
tttttttttttttttttgagacaggatctcactttgtcacccaggttggagtgcagtagtgcgatcacagcacactgcagcctcaacctccccaggctcargtgatcctcccacctcagcctcctgagtagctggaacgacagtcatgtgccaccacgcctggctaaattttgtaatttttgtagcgacagggattcagca

SEQ ID NO: 12402 - DNA, 201 bp, Homo sapiens
tactccaaggaggcataggagtttaaaataggaaaacagtagtacgttgtgatggattgtatttttcaaagaaagtcacaataatatttcccatcccatgmactcttctgcaatgtatccttgacattctgtcatcaagattaagaggtagactctctctctaccctcttgaatgtggataggccctatgatggcttcgat

SEQ ID NO: 12403 - DNA, 201 bp, Homo sapiens
ttaagaggtagactctctctctaccctcttgaatgtggataggccctatgatggcttcgatcaataaaatatggtggtttaacgctgaggcaggtggggcrcgatgtctcacgcctgtaatcccagcactttgggaggccgaggtgggtggatcatgaggtcaggagattgagaacatcctggccaacatgatgaaaccca

SEQ ID NO: 12404 - DNA, 201 bp, Homo sapiens
cgcgatgtctcacgcctgtaatcccagcactttgggaggccgaggtgggtggatcatgaggtcaggagattgagaacatcctggccaacatgatgaaaccyagtctttactaaaaatacaaaaattagtcaggtgtggtggcacacccctgtagtcccggctactcaggaggctgaggcagaggaatcgcttgaacccaga

SEQ ID NO: 12405 - DNA, 201 bp, Homo sapiens
aacccagaaggcggaggtttcagtgacccaagatcgcgccactgcactccagcctggtgacagagtgagacttatatctcaaaaaaaaaaaaaaaaaaaamaaaagtgctgaggcagtgaggcagctctggaaatagcccttaactggcttggcagcttctgttttctgactcttagaagccagttgccatgtaagtaatg

SEQ ID NO: 12406 - DNA, 201 bp, Homo sapiens
gattaaaccactcaattgaccccagccaactcatagcaccatgagaaataacattgttttaagccactatattttggaatagttttcttaaaaatataaartgatagataaccataatagaaatttgtgctagaggaaaatccttaagactcttgaaagccattttgtctaacaaagagtgtaaataagatatggccttaa

SEQ ID NO: 12407 - DNA, 201 bp, Homo sapiens
aaatggtgacttcaggtccagggaggctactgtcctcagctctgttttcatgtaaatgtcgctcctgctgaaaggaagtggatgcaaaaaaatatctgctrtggaagcagaactaccccagactaaaatgttggtttttttttttttctctcccccttttcttttccttcaagttttccatgtggcatcagcagctgagta

SEQ ID NO: 12408 - DNA, 201 bp, Homo sapiens
ctgggactacaggcgccagccaccacgcctggctaattttttgtatttttagtagagatggggtttcaccgtgttagccaggatggtctcgatctcctgayctcaggtgatcttcccgcctcggcctcccaaagtgctgggattgcaggcatgagccactgtgcccggccttttctttattttttgagacagagtctcatt

SEQ ID NO: 12409 - DNA, 201 bp, Homo sapiens
aggcgccagccaccacgcctggctaattttttgtatttttagtagagatggggtttcaccgtgttagccaggatggtctcgatctcctgatctcaggtgaycttcccgcctcggcctcccaaagtgctgggattgcaggcatgagccactgtgcccggccttttctttattttttgagacagagtctcattctgtcaccca

SEQ ID NO: 12410 - DNA, 201 bp, Homo sapiens
gctgggattgcaggcatgagccactgtgcccggccttttctttattttttgagacagagtctcattctgtcacccaggctggagtgcagcagcgtggtctyggctcactgcaagctccgcctcccgggttcacgccattctcctgcctcagccttctgagtagctgggactacaggtgcccactaccacgcccagctaatt

SEQ ID NO: 12411 - DNA, 201 bp, Homo sapiens
ctcagtgtctgggaggagaaatcctctctgatggtggcaggggtggggacagcagccccgctgggccctgtggggacagtcccagcagcagacagtcccakttgggcttatcctgtgatgttggcctcactgtcttggcagcctctggcatttctgttctctgttcatcttccacatatggttctcaggttcactcatcaa

SEQ ID NO: 12412 - DNA, 201 bp, Homo sapiens
gtgcctggctggactctagggactcacgcttgatcatactaggattcaagaacaacgcagttgtcactgttagcccatgatcccacacgtacccagacacrttctctcacggcaagtacatctgcacctggatgccttctactagtatgacatacttaaaagtatcttggatatgccttaaagatcattgttggctgcttc

SEQ ID NO: 12413 - DNA, 201 bp, Homo sapiens
tttgtgttgtttaccagtttttttcagcttctttaaaaatagaatctttagtttgctaccttcttcttcattgtctggatatcagctatttttttaatagstatatccagtattatccccatcactttctaattttttacttttaacttgattttgcacaaggactgaaataaccaagatgattaataatgtactcaaagc

SEQ ID NO: 12414 - DNA, 201 bp, Homo sapiens
tccatccccatcttgcatcttacaaaggacccaatagaagcttcatggggtacaggaaagaatatagcaaggaccttggaggcctcaggcctcaatctggytctgccattcaatagtttgaccttggagagcaatcagaattctcagggccttagatcctctgcccgtgaagctgaggtattggactggatatctccaagg

SEQ ID NO: 12415 - DNA, 201 bp, Homo sapiens
ggaaaggaaatgaggggaaatagcacatttcatggcatcgaagagggcatctttgaaacctagcggctttccacctacagacatttagaatgcaacttatkctggcaaagctattgagggtttaaatgatatgctttatagcgtgttgcatttcttcctttgaaaatgaggagcttgaattacctttcttgcttcataata

SEQ ID NO: 12416 - DNA, 201 bp, Homo sapiens
ctcaagactctgaacacccacaccggcccatgagggcagagagtggtggctggctttctaaaccagccttgtgtcttcagagtccttgatcagagataacytggggaaagctgtgtctcataaatccactttgctactgggtcagagagatgccttgagaatgaccttagctagggaagggatggaatattggtttccctt

SEQ ID NO: 12417 - DNA, 201 bp, Homo sapiens
ccatgacttggaacaataaagcaaacatatttccaaaatggccatggcagaacagtgaaaaggtactttggtatatctcatgccacatttcacagatcttytgttctgtgatggtttatggaagtgaagtactttattatgtaaaattcatcctgttttttgtttgtttgtttgtttgttttgttttgtgatactacagat

SEQ ID NO: 12418 - DNA, 201 bp, Homo sapiens
ggggtgggagccctggctctgcatctggctagctttgtaacccagtcccacgtctactgaccccttgacttcctgttcctttgtgtgtgtgtgtgtgtgtktgtttgtttgtttgtttgtttgtttgttttgagaaggagtctcgctgtgtcacccaggctggagtgcagtggtgcgatcttggttcactgcaacctccgc

SEQ ID NO: 12419 - DNA, 201 bp, Homo sapiens
tgaataaatgcacagtgcataaatttagcttttactacaaatgtactacactcttcttatttttctttctttctttcttttttttttttttttgttgtttytgagacggagtctcattctgtcacccaggctggagtgcagtggcgcgatcttggctcacggcaagctccgcctcctgggttcacgccattctcctgcctc

SEQ ID NO: 12420 - DNA, 201 bp, Homo sapiens
agtctgcatccattttagagaactctccctccccactccccttcaacatatcccatcctctttcacctatccattcagattctttcatttaattatttcaraccctgggaattagcagtcccttcttgaaagcattggaatggggcagttttaatttttattagtatcagctttctcctcctcactgccatatttacttct

SEQ ID NO: 12421 - DNA, 201 bp, Homo sapiens
agccctattgatcttgttcaggcattgactccaggtccttttaacaagccactctgtctagacttgcaggctagagcccacagtgctaacaaaggaggagstgggctgccctccctccccctgcaggggaaggctaagaggatgggcacagattcaggcttctcaatggggattttcttaaagaactagcatgattttatt

SEQ ID NO: 12422 - DNA, 201 bp, Homo sapiens
atctttctgaattcctctgtttctctgttcttgatgcggtggtcctactctattgcccctgtctctccctccgagactcttcagttgactgggaggcctgraaagtggaaggacccaaataaaaaagtcaactttggagcagcctttcctggttctgtccgtgcttgggaactcccatcgcttgccgattctaagcaggca

SEQ ID NO: 12423 - DNA, 201 bp, Homo sapiens
cctacctgcatcagaatttgtttcctcattttcctcctcattactaacaacctaccaatcatcaacccaatttcagtttcttctcttttatttttccccaytcttcattctcctttcatctttcatatatttgggggttgggtttggactttttcttttcttttcttttcttttatttagtaagggaggtggcaggcagag

SEQ ID NO: 12424 - DNA, 201 bp, Homo sapiens
tgcttttaggtactattgaccacttgactttcctgggatgactaaagaacatcttgacatggcagtggttgaatctttcaagaatcttctctgcctccccytgagctatcagatatgagaaaaagattatattaaaagcctcagcaaggctaagaggaatgattggaagttcctctatgaaaaatgggttagaaaaggcta

SEQ ID NO: 12425 - DNA, 201 bp, Homo sapiens
atgaaatacaggaaggccaagccaagactgagttacatgagtagggtccccatcaggctactcaagcccatcacagtttcctcccacgtgttggaccttcygtgtagtttgatttggttatttccacaccatcctcttttctcctcaatctgacactcctccattttcccaagtggagaagcgaaagtgccactgagacct

SEQ ID NO: 12426 - DNA, 201 bp, Homo sapiens
tctgtcttatattaaggacttgaagagacataagagaacatggcttgttaactttgtggatggcagggacagaaaatggtagaaattgtgcatctgtgttwtctgaggttgaattaatagaggtctgacctgtgcaacaaaggaggtaacagttctgcagtataatttattggttaagaaagcaggctctggagttagagt

SEQ ID NO: 12427 - DNA, 201 bp, Homo sapiens
attggccccagagggttagtttgctgactcttgctatagttaaatggcaggcaaaacttgataattataatgcaacatattaaactctatctatctatctrtctgtctgtctgtctgtctgtctgtctgtctatctatctacctacctacctagatctatctgtctacctagatagatagatcagtcaaagttttcacagg

SEQ ID NO: 12428 - DNA, 201 bp, Homo sapiens
gctatagttaaatggcaggcaaaacttgataattataatgcaacatattaaactctatctatctatctatctgtctgtctgtctgtctgtctgtctgtctrtctatctacctacctacctagatctatctgtctacctagatagatagatcagtcaaagttttcacaggtttacaatgaagccccagataagagcacttag

SEQ ID NO: 12429 - DNA, 201 bp, Homo sapiens
ggtcacttttgtcaccatcttggttttggtgggttttggctggcgggatttttttaaattttatgtatttatttattttttattatactgtaagttctggkttacatgtgcagaacgtacagttttgttacttgggtatacgcatatcctggtggtttgctgcacccatcaacccgtcacctacattaggtatttctccta

SEQ ID NO: 12430 - DNA, 201 bp, Homo sapiens
gattacaggcatgcaccaccatgtcagctaatgtttttctttcttttttttttttttttgtatttagtaaagcctgggtttcacagtgttaggctgatctygaactcctgacctcaggtgatccacccacctcggcctcccaaagtgctgggattacaggcgtgtgccaccgcacccggccatgtcacagttttataggcc

SEQ ID NO: 12431 - DNA, 201 bp, Homo sapiens
taagagtgaattgggctggccacagcctccctcatattgagaaacccaattggtaatactcagctagcatacagattagtaatgtgtgagtgtctgcatgygtgtgcatgcttccgtgtttatatattaccagtgtatgtgcgtacctttgtatatatgagtaaaaatatatatgaagtaaaaaatcaaaatctaataact

SEQ ID NO: 12432 - DNA, 201 bp, Homo sapiens
gtcataagaattagatagcctccagcacaacgaattacaaatacttcatactctaatgcacatgtttaatttttgcttggagttgaacttaagttatggtrccttatgagagagtcaggcagcttctctgtactacataagcatgtactcgatgaagcttggggtcaaaaacctggaaactaagtttagttggaaatttaa

SEQ ID NO: 12433 - DNA, 201 bp, Homo sapiens
tgattaaagccttcattaggctagaagcagaagtgcttcacaggccaggcaagaaatactttgtaattgcttctgacgggcagatctcctttggcggttgytgagccatcaggaagccgtacagcactggtccacgtgtattttgtataaattagtgggcttgacattacaagaggttgcccctatacgcagtcatcttct

SEQ ID NO: 12434 - DNA, 201 bp, Homo sapiens
taacttttattttgagctctagaacttggacattttctggctcctgccttgcaagtctgaacctcagttccagttttctatttttggtgcttagtgttttygtctttggcagatcctgaccactgttaacaaaatataaagcatgaaaatggtggcatccatgcgatgcagcagttgggactatgagccccaggttggatg

SEQ ID NO: 12435 - DNA, 201 bp, Homo sapiens
tgtgctgtacaaagataacaaagttgagagagttttaagtgatgagtgagtggagtggacagtttagcggagggagaaatcacagcaggcccaagtcatcrgctgcctgagggagagaagggaagtggggcagagacagtgggatgtgtgattccgtggagaccccagaagcaagattctttcacaacacttcttagtcat

SEQ ID NO: 12436 - DNA, 201 bp, Homo sapiens
aagcaagattctttcacaacacttcttagtcattcttttaccctgagtaggaacgttatgcaataataagattagcccagaagttttatctagaagctgtrtcatcctggaagctgaagagaataagttcatttcattattatctattgtcaaaggattaaatttggaagggagataagtatatatttatttttttgcttg

SEQ ID NO: 12437 - DNA, 201 bp, Homo sapiens
agaaagctctgctggacccccttgcaaggtgaattagtatctggttcagtattctttgtaaaatcagactctcaactaaatcaatgtccttgactgactgrctgaaatagggcttcagggtgtctcattctaccactgtacagagggcacatgcaatgtgcaaaaaataaaaacaaaaacagacctctgtccccaccagct

SEQ ID NO: 12438 - DNA, 201 bp, Homo sapiens
aaacaaaaacagacctctgtccccaccagcttttaacacttactcttttctttcaagtaatatatccacatggttgaaaaaaagtctaacactgtaagagsgcacagtgaaaagtaagtcaccctcccactccagaatattaatcccgcaaatatactccccaatgacaattttatagttccaaagagactttatgcttac

SEQ ID NO: 12439 - DNA, 201 bp, Homo sapiens
cgaaagctgtagcttctcagtttgttttttggctttatgtttcttaattttcacccttgcatgcttgttgattcttttgctactctctttaatggctgttktaaaattatgtttctgaaaagatacctgtctcatagatggctcacattctccgcttatctctcttgtcactcactgcgcaattgtctcagtgatagctct

SEQ ID NO: 12440 - DNA, 201 bp, Homo sapiens
ttgttttttggctttatgtttcttaattttcacccttgcatgcttgttgattcttttgctactctctttaatggctgttgtaaaattatgtttctgaaaasatacctgtctcatagatggctcacattctccgcttatctctcttgtcactcactgcgcaattgtctcagtgatagctctacgatcctggagctaaggatg

SEQ ID NO: 12441 - DNA, 201 bp, Homo sapiens
gagctaaggatggttttacaagtagcatttccactgctaccagagcaactctcatgtcactggtgtgatccgcccccattgccccattctttgcttctctytttcctcatcaccatggaaaccgattgtgacatcacagatgctgcattatgtgattattttgtaggataaacttcactgtgcaagaatttatgcaacaat

SEQ ID NO: 12442 - DNA, 201 bp, Homo sapiens
cctcactaactctctcttcctcttcataaccttttacattttgtttaaatggctttgtttctgcagctgcagatcaaacaagctagccccaggcagtacayagctactatggaatagtaacaaagtgggggtgggggtggggcaaaatagtcaggggtttttgaatgcctggacagtctgcctagctttctatggaccatg

SEQ ID NO: 12443 - DNA, 201 bp, Homo sapiens
cttggcacagcataaaagttaccttacccgtgtctcaggcaggctaaaacacacaaaattgccatttgttcatttctgtctgttcctaatacaaatttttytttcaaacaattttgaacaaaggggaacagtttttgttgtttaaaccaccagtggacccaacttcaacaaatatgtttgaatttcagaagtcttaaattt

SEQ ID NO: 12444 - DNA, 201 bp, Homo sapiens
tgttgtttaaaccaccagtggacccaacttcaacaaatatgtttgaatttcagaagtcttaaatttcatacctgggagctaaagcactggctaattctttkctcttttttttttttttttttttttttgagacagagtttctctcttgctgcccaggctggagtgcaatggcgcagtctcggctcactgcaaactctacct

SEQ ID NO: 12445 - DNA, 201 bp, Homo sapiens
ctgggattacaggagtaagccaccgtgcccggcctggccagttttttgaactactgatgaatttgatcaaagcctattaaaaacttactgagtaaacaaayaattgtcccatgaaagcagtataatctaaaattttaatacagtctgttaaactttcattttttcatgagaatgttttctggtaacttgttttagattata

SEQ ID NO: 12446 - DNA, 201 bp, Homo sapiens
gaaactgaggcacaggaaggtgaagtcacttcttcacggttatacagctcatacatattagagctggaatttaaatacaggcaggaactgtgctgctctcwacctgtatggtctcagccaagagggttaagtagagaaaagatacactagatgttaggtcactgagatttttctgggtcttcctaagggccagcttgactt

SEQ ID NO: 12447 - DNA, 201 bp, Homo sapiens
agagacataatctgcaaactctaatgcaatctaccagtgtcaatgattcaggaaataatcacaggaaagaaaaagataacaattagaaagcaagatatgaygcacattttataccattttataattagttctggattcactgaggtcttgctcagactatctcactggtgtgggaataagagaaacctgggcttccaaggt

SEQ ID NO: 12448 - DNA, 201 bp, Homo sapiens
caacaggtcagcatataatagtccagtttgcattggtattaattcaggaatgagagataagagccctccctgaagaaacaagagtggaggtcgagttttcraacatatctgataaataaaaaaggggcaatgtcaataggacttagttagtaatcaattacacacagctaaagaatagctgaaattgaattagagcaaggg

SEQ ID NO: 12449 - DNA, 201 bp, Homo sapiens
gacaaaactggatttgtgggggcggtggggaggtgcacagtggctcatgcctgtaatcccagtgctttgggagatagaggtgggcggatcacgaggtcatragttcgagaccagcctggccaacatagtgaaaaccccgtctctactaaaaataccaaaaaaattagccaggcatggtggcaggtgcctgtaatcccactt

SEQ ID NO: 12450 - DNA, 201 bp, Homo sapiens
actattcctgtaactcagtattagctatagagcggcaagattcagtgttgcttaaagtggacaggtgggcaggcatggaatgaatgaatctggaatagagygagaagcaggcttatgcatctgaggcaggcatttctaccatctaaaacaatggggtgactttgcagctctccttggtgaaaagagcacttcgtggatgat

SEQ ID NO: 12451 - DNA, 201 bp, Homo sapiens
tgtagaaaatttggcacatggaagtttattaattcaacttattctttggccgacattaactgagtacctgaatacaaaacctgtggtggttctacaaaacscatttcatgataaacaaaaataaatataattgagcataactgtaccaagcagaaatggttattattaacatatctgtatgctttattctattattttggg

SEQ ID NO: 12452 - DNA, 201 bp, Homo sapiens
aatagcaccagaattctaagtctgctggccaaggtgctgcctcctgcagagagagaaagcccatcaaagttgacttcagtgactcccccttcactcacccmtcatcttccacggccaaccaactccctttttgattgacacatcatttctttacatacattaatgccttccatattaccacagagagtttgttagactgga

SEQ ID NO: 12453 - DNA, 201 bp, Homo sapiens
aatggcacaaatgctgacctccattcaaatcttgccttaccactaactagctgcgtgatcttggagtaattgcattgcctttctgaggtttcattccccakatcttcaaaggaagtgacaattatataccttgaaatgttgttgtaagcatttgagataataggcatacagtgtgtggtgttttggtagattctcagaaaa

SEQ ID NO: 12454 - DNA, 201 bp, Homo sapiens
agtagagagaactcatctcagccttgtccctgggtcccttgaagtacaagtgtccttagtaaggacaatgacaattcatgtggaattaattagtagaaatycccacatataaaatttgtccttcactctatttcttaacaggaaaaatcaaatcaaatacattaacaccaattagatgacaacataatcgaaaacaaatgt

SEQ ID NO: 12455 - DNA, 201 bp, Homo sapiens
atctctggaagtctgggggtagggtttaaagttccaaccctctaatcacatggttggtttctttggcagtcagtccccatcctgaagctatctagggtccwttaagagttaccttattaggataaactcagattatggttcaaaagggctacttatgaataacaaaagacactctcctccctgtcactcaggaaatttcaa

SEQ ID NO: 12456 - DNA, 201 bp, Homo sapiens
ttctcatttcttcccttcttttccttttcttttctcttttcttttcttttctttctttctttctttctttctttctttctttctttctttctttctttctytctctctttctttctttccttctttctctttctttctttctttctttctttctttctttctttctttctttctttctttctttctttcttttccttcttt

SEQ ID NO: 12457 - DNA, 201 bp, Homo sapiens
catttcttcccttcttttccttttcttttctcttttcttttcttttctttctttctttctttctttctttctttctttctttctttctttctttctctctytctttctttctttccttctttctctttctttctttctttctttctttctttctttctttctttctttctttctttctttctttcttttccttctttcttt

SEQ ID NO: 12458 - DNA, 201 bp, Homo sapiens
tttccttttcttttctcttttcttttcttttctttctttctttctttctttctttctttctttctttctttctttctttctctctctctttctttctttcyttctttctctttctttctttctttctttctttctttctttctttctttctttctttctttctttctttcttttccttctttcttttttctacctcttctt

SEQ ID NO: 12459 - DNA, 201 bp, Homo sapiens
tccagaaagatatgataaattaaaagacgagctacagacttggagaaaacattggcaatgcacccagcacacaaaggattggtattctaaattgtataatkaccccctacatgtgatcaagagaaagaaaaataacccaatgaaaaatgagcaaaggatatgaataagcaaatgacagatgccaaaaccaaaatggatagt

SEQ ID NO: 12460 - DNA, 201 bp, Homo sapiens
tctccttaagcagttacacacagctctgcaaatgttagagtgacatttggactgggcttgcgtactcagcttgcccgctcttctgggcttccccgggggtstgccaagctccagcacattggtattagccttgcaggcctcacctcccagagctagcaataacatttaccagctacagttttctccattttcaaatatttc

SEQ ID NO: 12461 - DNA, 201 bp, Homo sapiens
tgggcttgcgtactcagcttgcccgctcttctgggcttccccgggggtctgccaagctccagcacattggtattagccttgcaggcctcacctcccagagstagcaataacatttaccagctacagttttctccattttcaaatatttcctctggcccacatgccagtgatccagctcctccatagagtagaacctgaaag

SEQ ID NO: 12462 - DNA, 201 bp, Homo sapiens
gcccgctcttctgggcttccccgggggtctgccaagctccagcacattggtattagccttgcaggcctcacctcccagagctagcaataacatttaccagmtacagttttctccattttcaaatatttcctctggcccacatgccagtgatccagctcctccatagagtagaacctgaaaggagtggtttaaagaaaggag

SEQ ID NO: 12463 - DNA, 201 bp, Homo sapiens
agcactttgggaggccaaggcaggagaatcacttgagtccaggtgttagagaccagccttggcaacatggcaaaaccctgtctttacaaaaacaaacaaamaaacaaacaaacaaaaaaaaaagtagccaggtgtggtggtgctcctgtagtcctagctacttgggaggctgaggtgagagaattatttgagcccaggaat

SEQ ID NO: 12464 - DNA, 201 bp, Homo sapiens
gacacaatgattaaataaaattaattacttatatcctctagaaatagaaatgggcttactatgacaaatacagatatataccatttgggactaagaaaaawtttatgaagaaaggtatgtgaaatatttttaatagccaaaaatagaggaactctggaatgggtgggaaaggagtgagcttagcagaccttctctgtgaaa

SEQ ID NO: 12465 - DNA, 201 bp, Homo sapiens
tgaaaatagaacaatagagattatgcaatctgaatagaagaaataaaaattttgtatatttataatatataactttaatgaatggcgtgtttgtatatgcrtgcacatacaaacacaagaacttccatcatgaagcattatggatgtgctttggtgcttggaagcatgggtgtgctccaggcatagctctatgacaatttg

SEQ ID NO: 12466 - DNA, 201 bp, Homo sapiens
agatatacctaatgttaaatgacgagtcaatgggtgcagcacaccaacatggcacatgtatacatatgtaactaacctgcacgttgtgcacatgtaccctraaacttaaagtataataataataaaaaaagtcttggttttcttgtctgcaagtaggaataatagaatcacactatagtgttaatcgaggtaacaaattgt

SEQ ID NO: 12467 - DNA, 201 bp, Homo sapiens
tgtcctggtgggaaggtggggtttttgaatccataccaatcttatctgctgtcaggtcaactggacacacttggaaaatgcctacatcataaacctaaagwctctgggacacaaaggactgttttgagcagtgacttctttagttatgtcttttttttttcttctagttttcagtgtttacagtaccgtgctctttttctt

SEQ ID NO: 12468 - DNA, 201 bp, Homo sapiens
gtcaggagaccagcctggccaacatggtgaaacctcatctctactaaaatacaaaaattacctgggcttggtggtgcgtgcctgtgatcccagctactcgrgaggctgaggcaggagaatcgcttgaacacaggaggtggaggttgcagtgagccgagatctcaccattgcactcaaacctgggcaataaagtgagattct

SEQ ID NO: 12469 - DNA, 201 bp, Homo sapiens
catctttcatttatttttccccatctagactgtatcaggataaactgtaactccagtaagttttccctcaagtttcattttgttctttaaaaaaaaaaaamaaaactgactttattttgtttactgttttatgagctgttttttatttgaattattttttcttttaacaatggagtgggggggacctggggctaagaagat

SEQ ID NO: 12470 - DNA, 201 bp, Homo sapiens
aaagcaaaaagaaccagggctgttttctggagaatttctggaggaaatgtcctgttcctatggctgtagttccataaggctggcagtaacctaagaggcaygcggttctgaaaacaggtatgaacttctcgttggtgtcatgagtgcgcaagtgaaagtatggaaaatgactttttgtctttgaccttgtctgattgtgcc

SEQ ID NO: 12471 - DNA, 201 bp, Homo sapiens
cttcttagacacagaggagaaaggaagtagtgtgctgtacaaaaatatattgaccttaagacacttaagtgccacaatagagttatttgtgtcagagaatwgctttgatgatcttgtgtattccctatataagctgatacctttgattcatcatagaggtgcacagtaatctcagagatgtatgaaaataacatcacaagg

SEQ ID NO: 12472 - DNA, 201 bp, Homo sapiens
acttaagtgccacaatagagttatttgtgtcagagaattgctttgatgatcttgtgtattccctatataagctgatacctttgattcatcatagaggtgcmcagtaatctcagagatgtatgaaaataacatcacaaggatatgatatctgcaaattttatctcccaagactactagtgtttgagtctttctcctcttgga

SEQ ID NO: 12473 - DNA, 201 bp, Homo sapiens
aaaataacatcacaaggatatgatatctgcaaattttatctcccaagactactagtgtttgagtctttctcctcttggacttgcttggataatttgtttcyttcttttttttttttttttttttttgccttttcccttagcttctctgccttaagtttctaagcagactccatttccagtgctttggaaaaattaacagca

SEQ ID NO: 12474 - DNA, 201 bp, Homo sapiens
taacatcacaaggatatgatatctgcaaattttatctcccaagactactagtgtttgagtctttctcctcttggacttgcttggataatttgtttctttcytttttttttttttttttttttgccttttcccttagcttctctgccttaagtttctaagcagactccatttccagtgctttggaaaaattaacagcatgtg

SEQ ID NO: 12475 - DNA, 201 bp, Homo sapiens
gttttatatttcttgtaacatatagaacacttcaagtgtaacaatatttatcgtatcaataacagccagattttagtatgatagtgggatgcttcctaaayatataatattaaacacttcttaataaatattaattcagattggtttattttaaaatagttaataagattatacatggaacaaaaggcaaaatagtaaaaa

SEQ ID NO: 12476 - DNA, 201 bp, Homo sapiens
catgactttgattatccatcctcctacatatctgatagaaaacacaaggagtaggaatctcatggttaacatttcaaaggcatgaaaattgaatactaagygaagatacaacttcattctttcccctcttcatatcttcctggaccctttttctcctttgtcacagcaaaataatataggctactaagtctatgcacaagg

SEQ ID NO: 12477 - DNA, 201 bp, Homo sapiens
aaagagggagagagagtctggttgtggcctcaggtgattggctaaagacaataaagaaatgggtcaccggcttctttttttttttttttttttttttccaragctggtttctgttgctccttaggaaagaatcctggttaaaggtgaataaggaaggggtatactgaggcatgaatatactaaggcatatctaccctccct

SEQ ID NO: 12478 - DNA, 201 bp, Homo sapiens
ggtactccttggccaataggggattctgttcattcagtcaagggacttgagattttatttttagttatctattctttatttgtttccatgagtatcttcaraaccaacctctggactcctcatgatttggggaaatgcactattcatcattgtatcttcaccatctagcacggtgctaatcatatagaaggcattagtgaa

SEQ ID NO: 12479 - DNA, 201 bp, Homo sapiens
aggaccgaaaaaaaaaaaaaaatacaaaagaacattccagaaataattacctattcaccatctttagtacaatgctgtacaaataattaatttttggttcrttattctctattcactttttcctaacatatggacgcatatatatgggtccagtgaatcccattcaaagagaatagatggtgggaaaactattggatgcca

SEQ ID NO: 12480 - DNA, 201 bp, Homo sapiens
ggatatgataaaggtacttgtcagcctagattttgttacaaattctcaatttatgtttgattctgaataaaattttattaaagatgtctaaatgcagcatytctgctaacataggatttccaaaattttaatttgtcaggaaaatgaagagtaagagattacattgtgtaacatagggcatttttttcctgcctcgtctta

SEQ ID NO: 12481 - DNA, 201 bp, Homo sapiens
attcctacatttttcacaggcagtaatccagagaatctgatatggtttggctgtatcccccacccaaatctcacctcaaattgtaatccctgttatccctrtgtgtcaagggcaggaccaggtggaggtaattaaatcacaggggggcggtttcccccatgctgttctcatcatagtgagttctcacaaaatctgatggtt

SEQ ID NO: 12482 - DNA, 201 bp, Homo sapiens
cctttctctttatcagaatcagggaagaaaaaagccaaatggtgactaatttatcaccaggttcataactaagttaccaaaagactgaaactaatcaggtytgattttcaaaataagcaataacatttaaagcatatttgaatatacagatgtttggatcactgatatcctaagaattctatagtctctgctgattttaaa

SEQ ID NO: 12483 - DNA, 201 bp, Homo sapiens
aatctcagcactttgggaggccgaggtgggtggatcacctgaggtcaggagtttgagaccagcctgaccaacatggagaaaccccatctctactaaaaatmcaaaaaattagccaggcatgttggtgcatgcctgtaatcccagctactcaggagcctaaggcaggagaatcacttgaacctgggaggaggaggttgtggt

SEQ ID NO: 12484 - DNA, 201 bp, Homo sapiens
aaattaatttatcaagccagattgtcatcttttcttaaaaaattacatgatatgaaattcacagctttcctattcaagtgagtttttcttatgtccagctrgaatcccctttgggttaatataagtctttagtgtacgaatttgaatctttgcctgaggtgctacactgttggttctcttaaaaatttgtggcattattta

SEQ ID NO: 12485 - DNA, 201 bp, Homo sapiens
cttttgcttggcatttctccttcctgctgtcatgtgaagaaggatgtgtttgcttccccttccaccatgattgtaagtttcctgaggcctccccagtcatrtgaaactgtaagtcagttaaacctcttgctttataaattacccagtcctgggtatttcttcatgtcaggctgagaatggactaatacagtaaattggcac

SEQ ID NO: 12486 - DNA, 201 bp, Homo sapiens
cctcttttctctttcattgctctgatctttagtcaatctttggttcagccagcttgttctccttctattgactaatctctctctgtatctttcataatggkggtgggagagtccatgccgaatctcctgttggttgaagaaggtgaaagtcaattggtaaagtcactgtgatttataatgttcaaactggggagggattga

SEQ ID NO: 12487 - DNA, 201 bp, Homo sapiens
gtgcagttccagaccaccacaataaagcagataccacaataaagcaagcatataaattgtttggtttcccagtgcatataaaagttatttttactctatartctattaagtatgcaatagaatgatgtctaaaataaaatgtacataccctaattataagtattgtgttgctaaaaattgctgatgataatctgagcatac

SEQ ID NO: 12488 - DNA, 201 bp, Homo sapiens
tttgatgtccactagggaaagtaaaacatattttttatttcagcataagaagcttatctcttccatcttgtaaaataatataataataatagaattagttraacatggtgattactattacgtattttatgattccaataattcaagcacagacactatcttgaatgcgtcctagtatattcagctccacaatgatgccta

SEQ ID NO: 12489 - DNA, 201 bp, Homo sapiens
gagtttctatatatggagtactgtgtggtttataaaacactggtatttaatatattttattactatataaatgaatgaactacgtttcccaaacatctttytacgtgtgaagcaaaaaaaaaaaaaaaaaaaaaaaaaaaccacacagaaaaaaaacaagcaagcaaacaaaaacagagggaacaagagtttagagaagtc

SEQ ID NO: 12490 - DNA, 201 bp, Homo sapiens
agcatgatttataatcctttgggtatatacccagtaatgggattgctgggtcaaatggtatttttagttctagattgaggaattgccacactgtcttccayaatggttgaactagtttacactcccaccaacagtgtaaaagcattcctatctctccacatcctctccagcatctgttatttcctgaatttttaatgatct

SEQ ID NO: 12491 - DNA, 201 bp, Homo sapiens
aaatctagctaatttaatcataatttaaatagctagatctaaccattttgttattgacacttcaaaacacacaaacacacataatgaaatggtcaaatctrgctaattaacaaatacattacctcacatagttatcatctttatggtgagaacatttcacatccactctctgagcatttttgaaaaatacagtatatcatc

SEQ ID NO: 12492 - DNA, 201 bp, Homo sapiens
ctcttgaaattatttctcctaactaactgaaaatatgtatgccttggaccaacatctccccactccccacccccaaccaccccagcttctggtacccaccsatcttcagctgtttgtaaatacctacggttgatgaggaaatgcatttgttgaaatatactgaagcctgtggattattgtaataatccttttatgctatca

SEQ ID NO: 12493 - DNA, 201 bp, Homo sapiens
tcattctcagcaaactatcacaaggagaaaaaaccaaacactgcatgttctcactcataggtgggaattgaacagtgagaacacatggacacaggaagggraacatcacacactgggcactgttgtggggtggggggagtggggagggatagcattaggagatatacctaatgctaaatgatgagttaatgggtgcagcac

SEQ ID NO: 12494 - DNA, 201 bp, Homo sapiens
tgtctcttgattcctaaagctggggtatagtagatcagctgcatgctacaaaactaaatgagaccacgtatgcaaagcaactggtacttctttatatatgktactttcattcccctatcacttccccaaaaagctgcattttttctggccaggaagaatatatattaaaaggaaaagtagtgacttcatttatatctatct

SEQ ID NO: 12495 - DNA, 201 bp, Homo sapiens
aagaatatatattaaaaggaaaagtagtgacttcatttatatctatctgctgcctgatatctttcagctccaaatttgtcaaattcactctactgccaagwtccttctgctcctcttccttctccccctctaccctccataaatttactctcctttaatttattcatccatttctatgtattcacttattaattcaattat

SEQ ID NO: 12496 - DNA, 201 bp, Homo sapiens
gaactttgattcatacgtctcagcagcaggaagctgccgggagctggttatcaagtgtgactcataggagagacacaataccagaagtagccttctctggmtagtaggatcaatcatgtcttacttttttctggaatctttcccttttcagtgaggctgttttcatctacccagtttgtcagagcaaaccctaggaatcaa

SEQ ID NO: 12497 - DNA, 201 bp, Homo sapiens
aataaaattgtaccctttttataccatatacaaacatcatctcaaaacatattaaagattcaaatgttagacctgaaactataaaactactagaagaaaaygtacaggaagtgctccattgcattgtttctgggcaaggatttcttggatgtgacttcaaaaccacaggcaacataaacaaatgagattgcatgaagccaa

SEQ ID NO: 12498 - DNA, 201 bp, Homo sapiens
aacttcagactgcatttgaatgtcctggaagcttgtaaaaacagatgtgtgcctccctgcaaaagtttctaattcaatgggtctggggtgagctccaagcrtttgcattcctgacacattcccaggttgtggtcgtctgagaactacacattgagaaccactggtatagtccacagcatgcgttttagagttactttacct

SEQ ID NO: 12499 - DNA, 201 bp, Homo sapiens
taggtatgtctttttctgtctttgacaagttcctgtctgtcacccaatgccaggcattattttctggtaaaaatcaggaaggattctttctagcattctgkgactgtttctggttttatcaagagcagattgtgtctcattctgggatgtggagtatcacactgtctgacttggggaatttgttgggatataatgaagcac

SEQ ID NO: 12500 - DNA, 201 bp, Homo sapiens
ttctgtctttgacaagttcctgtctgtcacccaatgccaggcattattttctggtaaaaatcaggaaggattctttctagcattctgtgactgtttctggktttatcaagagcagattgtgtctcattctgggatgtggagtatcacactgtctgacttggggaatttgttgggatataatgaagcactagaacttacatt

SEQ ID NO: 12501 - DNA, 201 bp, Homo sapiens
tcctgtctgtcacccaatgccaggcattattttctggtaaaaatcaggaaggattctttctagcattctgtgactgtttctggttttatcaagagcagatkgtgtctcattctgggatgtggagtatcacactgtctgacttggggaatttgttgggatataatgaagcactagaacttacattgggaaaatgtcagcttt

SEQ ID NO: 12502 - DNA, 201 bp, Homo sapiens
aggtgtgtgccacacaccacgtccagctaatttttgtatttttttagtagagacggggtttcaccttgttggccaggctggtctcgaattcctgaccttgkgatccgcctgcctcggcctcccaaagtgctgggattacaggtgtgagccactgcgcctggctgccttgaaaatttacaagtaggttcaaagcaaacatgg

SEQ ID NO: 12503 - DNA, 201 bp, Homo sapiens
agtttttgagcaagtgtgtgatatgcccaaagatatgccttagaaagattcctcctggcagagtgtgagaagcaggttgagagaaaatagtaagctttgtkgagagaagattgtaagcctttctgagagcagacaacacgtggctgcataaacagaccctagtgcaatgtctgatatatagtgcagattcaatgaatattt

SEQ ID NO: 12504 - DNA, 201 bp, Homo sapiens
tattatatttacagaatttgcctattttttgaaatcaacactttgttaatcaccagacccatgacaatctataagtagccactttacgtggcttatagatytaaagtgaatgttggttttcacacattcattcataactattatttttactgatatattaggcaaaatataagattcatttatgagtttgttcatcagcta

SEQ ID NO: 12505 - DNA, 201 bp, Homo sapiens
ttgttgctttcatcttctttgatgcccttgggggcttgattgtggtataaggtaggttcagtcaactcatttaagttcgcttttccaggagtcactggggmccaggaatgagtcctggtgcatggtaatcccatgcagagttcccagccatccctctgtcagcccagcacctgtgtcttcccacatccactgtcaatgcct

SEQ ID NO: 12506 - DNA, 201 bp, Homo sapiens
aacccagtctgtgggcctttcgtgtcagaatctagtgaaatgattttgacaccacacacggcaaatctgtgcatgtttttctgtaacaaagaactgagaawatcaggagtccttatcaaagggaacctttgatgaccctctggtggtcaccttttatagtgaaaatgtttggtaaatagagaaaaaggggccaggcatggt

SEQ ID NO: 12507 - DNA, 201 bp, Homo sapiens
tgcagggtaaagagggaaatactggatatggataaggctagggatggcttcaaggttgctttcttttcctttcccttcccttcccttcccttcccttcccwtcccttcccttcccttcccttcccttcccttcccttccctcccctcccctcccctcccctcccctcccctcccctcccctcccctcccctcccctcccct

SEQ ID NO: 12508 - DNA, 201 bp, Homo sapiens
gagggaaatactggatatggataaggctagggatggcttcaaggttgctttcttttcctttcccttcccttcccttcccttcccttcccttcccttccctycccttcccttcccttcccttcccttccctcccctcccctcccctcccctcccctcccctcccctcccctcccctcccctcccctcccctcccctcccctc

SEQ ID NO: 12509 - DNA, 201 bp, Homo sapiens
aaggttgctttcttttcctttcccttcccttcccttcccttcccttcccttcccttcccttcccttcccttcccttcccttcccttccctcccctcccctyccctcccctcccctcccctcccctcccctcccctcccctcccctcccctcccctcccctccccttcccttcccttctagatggatttccgctcttgttgc

SEQ ID NO: 12510 - DNA, 201 bp, Homo sapiens
ccttcccttcccttcccttcccttcccttcccttccctcccctcccctcccctcccctcccctcccctcccctcccctcccctcccctcccctcccctccsctcccctccccttcccttcccttctagatggatttccgctcttgttgcctaggctggagtgcaatggctcgatcttgtctcaccgcaacctccgcttccc

SEQ ID NO: 12511 - DNA, 201 bp, Homo sapiens
attgatattaaggaatttgctcagggtcgcctggcttgttaaggtaaactttgaggttgcaggtgcgggtctgggaccttaaacatcatcatgtcacctakctacagcaagagccagcagaacaatactcttcagcctggttttgatatggaagatgctcttcagcttcatgctggcttgaatttcctttgcagtgaaggg

SEQ ID NO: 12512 - DNA, 201 bp, Homo sapiens
atatatatatcatagcacattcttagcctacccacctcccactaccccaaaaagcaggacaacattttccatatattctattgaagttttttttttttttwaaacttgttggcacagaagcctatatctgtagatattttaaaaactttacttatatctatttgaaatgtgttaaaaagccatatattctttttttttctt

SEQ ID NO: 12513 - DNA, 201 bp, Homo sapiens
gtgttaaaaagccatatattctttttttttcttttgataaaaggaaaagcaacaccctaccagatgttgggaggaatagtaagcaagtgattcaatcagawttctcctatggggacatagactctctcggtcaatgtcacagaatgaaatagtctcagattcacccagcagtgagttattccatctggttgtggcaattag

SEQ ID NO: 12514 - DNA, 201 bp, Homo sapiens
ggcccattatagaacatttagcagcattcttagcctctacatagtagatgccagtagtagcccccccaacataattgtcacaataaaaaaatctctaaacwttgccaaatgtcttttggagagggccacaattgttcccagttgagaatcacttcttcaggatagactgttgttaaaccattgattcagattcccagggaa

SEQ ID NO: 12515 - DNA, 201 bp, Homo sapiens
cactcagcagccgagcatcctgctgacccccagaaccctgccttgacacctgctcacaaacccctcctctccaccctcaagggcaaggtgtaatttagctrcagccttttcccaaatgcctgtagcttctacaattcaatcttttttatttgtaagtatctttgcagttttctactttcaaaagactcttagtgatttcta

SEQ ID NO: 12516 - DNA, 201 bp, Homo sapiens
ctattgacttcccttcccctttctgcctttcttttgaaaatggcccatctggattaagtttctatcaagatctctttctataagcaggatttttctcaggyatgtaatggaaaccttttacttctgttgaatggtaatcctaaggggaggtcagggaatggacttttcagttaactgctcagaggcaattgtttgttttac

SEQ ID NO: 12517 - DNA, 201 bp, Homo sapiens
ggcaagatcttctcctttacaaagctctcagctgattaggaatctcataaattgtcaaatgtcactgtttcagctaacaatgtttctaccataaacagaastgactcaaaggggcaaaaagtaaataaagtacatgacatgggagcatactctcacctgagccttagagaggaaactgacatctgtcaattcacttgttct

SEQ ID NO: 12518 - DNA, 201 bp, Homo sapiens
cccacttcaaaaaccccagggtcacttaattaaaatgactgattcctggagcctcaacatgtgccttctaaatcagacagtctatgaatgtgagactaaarccaaagtttgtactgagttctcctgtgactcttatgctccctcatgtttaagattctaccctgagtagaggccacttcaaaaatagaaactttttaatag

SEQ ID NO: 12519 - DNA, 201 bp, Homo sapiens
agtttgtactgagttctcctgtgactcttatgctccctcatgtttaagattctaccctgagtagaggccacttcaaaaatagaaactttttaatagttctstgtttacaaggtcaattctgttaagccataaaccatcccatttggaattagtactataattatggttcttatttcttacacacacacacacacacacaca

SEQ ID NO: 12520 - DNA, 201 bp, Homo sapiens
aattctgttaagccataaaccatcccatttggaattagtactataattatggttcttatttcttacacacacacacacacacacacacacaggttttttgraaaaaaaacatgttaagagaagacatttaaaagtttaaagaacttagatgttttattttgtgagaagaacaattttggggcaagtcgcttaactgtctga

SEQ ID NO: 12521 - DNA, 201 bp, Homo sapiens
atttaaaagtttaaagaacttagatgttttattttgtgagaagaacaattttggggcaagtcgcttaactgtctgagccccgttgtaccatctgggaaatrggaaaagtggcatctgcccttgctccgcacttgggatgggagagtcaaatgagaaagactgaaagcaggtgtaaaatctaaagtactaggaaaaacaagg

SEQ ID NO: 12522 - DNA, 201 bp, Homo sapiens
actgattgccttaaatttatatatgatcttgttctaatgtcctttctaaaaataagaaaaaaatattccacaagtaaaacgagagtatgatagatacttcmccatggtgctggtgtatgtagacttgcgtgagggggaggacatggaatggtatgttctccattcatctctagttttatttcctagatgagttatgggtga

SEQ ID NO: 12523 - DNA, 201 bp, Homo sapiens
tcagacctgttctttcacataatatattgaatgtccattgaatacagggaacattacttacaatttatagagtatttatctgggaaaaactgttgagaacrttattttttctccacatcccagagtcaacaagcagagaccgaaaggcataaaaatgtggaatgaaaagatagagaagagataagcagtttattctctcct

SEQ ID NO: 12524 - DNA, 201 bp, Homo sapiens
atgtatacctgaatgaataaaagctcttagagtgacagaaatgtaaacaaatacttctaacgctaagaaaagtttgttacatgttctaacaaagatttaascaaaatgttgtggctacaaagaaaaagatgggtgaagaagaatggacaaacactaggggaacatgagaaagttcctggaagaatattgtcatatatgaat

SEQ ID NO: 12525 - DNA, 201 bp, Homo sapiens
tgaattgtggtatcacttagtaagtacatacttaaagagaagaataggaggggagggaatgttagaagaatagtgaacaactaaaaaaatgtgagagatarcctggagagaaaagcaaaaggacaaggcaacacaggaaaaagcaaagtggagaaacagatatgcctagcaagaggaaaccaaagttagcccggtagggta

SEQ ID NO: 12526 - DNA, 201 bp, Homo sapiens
ccttacatgcagctggttctctaaatattccaacgattcctatcattttctgtaggagtacctgcaaaactggaaggctaggctgatggctttttctccaytaagcagtaaacacgttaagcaagcttgagccaggttctggaggaggtcatcttgcaaggataaaaaacattgcatttattggatgaatacttaatgcac

SEQ ID NO: 12527 - DNA, 201 bp, Homo sapiens
ggatgttcacagctgctgactgatcagggtggtggctgctgaaggttggggtggctatggcaatttcttaaaataggccgggcgcggtggctcacgcctgkaatcccagcactttgggaggccgagacgggcggatcacgaggttaggagatcgagaccatcctggctaacacggtgaaaccccgtctctactaaaaatac

SEQ ID NO: 12528 - DNA, 201 bp, Homo sapiens
gttggggtggctatggcaatttcttaaaataggccgggcgcggtggctcacgcctgtaatcccagcactttgggaggccgagacgggcggatcacgaggtyaggagatcgagaccatcctggctaacacggtgaaaccccgtctctactaaaaatacaaaaattagccgggcatggtggcgcgtgcctgtagtcccagcta

SEQ ID NO: 12529 - DNA, 201 bp, Homo sapiens
gagatcgcgccactgcactccagcctgggcgacagagcgaaactccgtctcaaaaaaaaaaaaaaaaaaaaaaaaaaaaaaaaaaaaaaaaaaaaaaaaawaataataataataataataataatatgatggggtgtgctgcattgactgattcttctgtttacaaagaaagatttatctgtactatgtgatgctgtttga

SEQ ID NO: 12530 - DNA, 201 bp, Homo sapiens
gggcgacagagcgaaactccgtctcaaaaaaaaaaaaaaaaaaaaaaaaaaaaaaaaaaaaaaaaaaaaaaaaaaaataataataataataataataataygatggggtgtgctgcattgactgattcttctgtttacaaagaaagatttatctgtactatgtgatgctgtttgatagcattttacccaaagcaaaatttt

SEQ ID NO: 12531 - DNA, 201 bp, Homo sapiens
aataataataataataataatatgatggggtgtgctgcattgactgattcttctgtttacaaagaaagatttatctgtactatgtgatgctgtttgatagyattttacccaaagcaaaattttcaaaattggagctaatcctgttaagcccagcagctgcttcatcaactaactttatataatattctaaattatttgttg

SEQ ID NO: 12532 - DNA, 201 bp, Homo sapiens
atgaggctggagaaatgagtaggaagcagatcaaaggccttgaaatgtcaagaactttgtaccttatgggtactgaagaagtgaaatgtttaaagaagccraattatatgatttcttttgacttcaaaatggaaaatacatgtcgatactgggggagaaattaggaggttcttgccataatacaggtggcatatgatggta

SEQ ID NO: 12533 - DNA, 201 bp, Homo sapiens
ctaattggagaaagtcatagggaaacatattttaatttcaataaaatctgatgctccaaaaattgaaaacataacttaccattcatctctgaatgtatccrtgcattttttttttcattcaagttacatttttaaatgatttgcaagttctatagactgggtaacagtgtacataacacttaacaactaactaaaatcagt

SEQ ID NO: 12534 - DNA, 201 bp, Homo sapiens
aaatgtgccacttcatattctacgactgaaaatggcactataaacaaaatggtttaggaaccagtgtagagagcaggagccaaagatggaatccagagtcmcagcatgagggatgagtaaggaagatgactaaactggtagattttagaatgagctatagcagtatcaccaaaaccaagagtggagagaacttcaagagga

SEQ ID NO: 12535 - DNA, 201 bp, Homo sapiens
ctgatggttttatgaacgtgtggcatttcccctgcttacacttctctctcctgctaccatgtgagaaggtccaagattgctttccattcaccttacgccgkgattgtaactttcctgaggcttccccagccatgtggatctgtgagtcaattaaacctttttcttttataaattacccagtttcaggtagtatcttcatag

SEQ ID NO: 12536 - DNA, 201 bp, Homo sapiens
tctctctcctgctaccatgtgagaaggtccaagattgctttccattcaccttacgccgtgattgtaactttcctgaggcttccccagccatgtggatctgygagtcaattaaacctttttcttttataaattacccagtttcaggtagtatcttcatagcagtgtgaaaatgaactaatacagtatgtaaaaatggaagtc

SEQ ID NO: 12537 - DNA, 201 bp, Homo sapiens
taactttcctgaggcttccccagccatgtggatctgtgagtcaattaaacctttttcttttataaattacccagtttcaggtagtatcttcatagcagtgkgaaaatgaactaatacagtatgtaaaaatggaagtcctgtatatacctgtctctctcaggattggcctcaaggaaccttaccaagtagatgacatttctc

SEQ ID NO: 12538 - DNA, 201 bp, Homo sapiens
ccccagccatgtggatctgtgagtcaattaaacctttttcttttataaattacccagtttcaggtagtatcttcatagcagtgtgaaaatgaactaatacmgtatgtaaaaatggaagtcctgtatatacctgtctctctcaggattggcctcaaggaaccttaccaagtagatgacatttctcacttgttcctctcactt

SEQ ID NO: 12539 - DNA, 201 bp, Homo sapiens
tcttttataaattacccagtttcaggtagtatcttcatagcagtgtgaaaatgaactaatacagtatgtaaaaatggaagtcctgtatatacctgtctctytcaggattggcctcaaggaaccttaccaagtagatgacatttctcacttgttcctctcacttgttcctctcacttcctgttgtagtatcatcttctattt

SEQ ID NO: 12540 - DNA, 201 bp, Homo sapiens
ggcttttgatccctggaattaattacatgcaaagattttcattgcttggagcagcaagcagctggttcctacgggacccaggctgaactctcttgccaatytccctctcatgcttgtccctccctccacacctacaccctttctttctttcattatgctcaatgggttcaatctaatgagggaaattgtaattaaacattt

SEQ ID NO: 12541 - DNA, 201 bp, Homo sapiens
atttcaccacatcatcacaggcatttctatggtgacgaagcgatgtgccatgaacaaagttatgccattttttaatacaagccgaggaaagagaaaaaaaycaggagcaagccactgcttcagggattggcaacctctttatgtttgctcaagatagagcgaaaaactcctaaggttttaccattaaagaaccaaataaaa

SEQ ID NO: 12542 - DNA, 201 bp, Homo sapiens
aactagcatattaacaaatatatatgggtaattatataaaattatttatacatatataattacccatatatatttttcataattacccatatatatgtatrtgtatatatatataattacccatatatatgtatgtgtgtatatatatataattacccatatatatgtgtgtgtgtgtgtgtgtgtgtgtatataattacc

SEQ ID NO: 12543 - DNA, 201 bp, Homo sapiens
attatttatacatatataattacccatatatatttttcataattacccatatatatgtatatgtatatatatataattacccatatatatgtatgtgtgtrtatatatataattacccatatatatgtgtgtgtgtgtgtgtgtgtgtgtatataattacccagaattaaacacctttaggtgtaattagagtacattaaa

SEQ ID NO: 12544 - DNA, 201 bp, Homo sapiens
tatatttttcataattacccatatatatgtatatgtatatatatataattacccatatatatgtatgtgtgtatatatatataattacccatatatatgtrtgtgtgtgtgtgtgtgtgtgtatataattacccagaattaaacacctttaggtgtaattagagtacattaaaatttggcatactttcctttagttctttt

SEQ ID NO: 12545 - DNA, 201 bp, Homo sapiens
atagtttcagtagaaatgtgtactagctcttctttgtacctctggtagaattcagctgtgaatctatctggtcctgggcttttttagttggtaggctattytctactgcctcaatttcagaacgtggtctattcagggattcagtatttttcctggttcaaatttacctttcttataaggaaggcaatcatgttggatttg

SEQ ID NO: 12546 - DNA, 201 bp, Homo sapiens
aagagaaaagcaatatgataatttgtaagtgagctgcttataataagcaggatatgacagtcaacatttttcctttttacctttccttccatctctacctsttttctttgttatagactttgagttttgtatgtgtcaggtttcattcatttgggaaaccaatgtcacatcaaattaggaaggatgttatgaccctctaat

SEQ ID NO: 12547 - DNA, 201 bp, Homo sapiens
tccttccatctctacctcttttctttgttatagactttgagttttgtatgtgtcaggtttcattcatttgggaaaccaatgtcacatcaaattaggaaggrtgttatgaccctctaattggcctttgcattgtacacaagcctcctatgtttgttcgggatagcaccacgcatccttttaaattggtagtttgactgtcag

SEQ ID NO: 12548 - DNA, 201 bp, Homo sapiens
agaaatcagtggtttcagctggaataaaaaagtaatactatggtatagcataacggagataatacaatttttgtggttttaaaacagagaaaaaagtcccycttttaatgcaaaatcacctgtaaccttgaatgtatcaaccagtgtgacttagctgataatttaggcctatttcatagagctgttatgagaactaagtaa

SEQ ID NO: 12549 - DNA, 201 bp, Homo sapiens
gatttgaatttaatgttcaagagaggggaaggcataaatatataaacatatatgtttcatacatatgtgtatacatatatatgtttcatacatatatatayacatatatacacatacttatatatacatacataaatatatttatatatccacttaaaacatatacaaaactacctatacatatatacatctatatatcac

SEQ ID NO: 12550 - DNA, 201 bp, Homo sapiens
tcgacccccacccctaagctcaagcgatcctcccacctcagcctcctgagtagctgagactacaggcctgtaccaccatgcctggttaatttatttatttwtttttttgtagagatgggggcctctatattgcccaggctggtctcaaactcctggccttaagtgttcctcatgcctcagcctcctaaaatgttgggatta

SEQ ID NO: 12551 - DNA, 201 bp, Homo sapiens
gctgagggtattattgtaaaggtgattgtttaagtcagtgggtgacggtgtcaggataattatagccaggagatatatgatcataaagacctagttagtaycccaggagaccccaagacagggcttctgcccatacttttgcaatcacacattctgaagtaaggtggcaccatttaccaagtaggaacaaaagtgaatgat

SEQ ID NO: 12552 - DNA, 201 bp, Homo sapiens
attaaaaaaatgagcctttttaaacaagaaattcctgctcatacatttggcttctgagagagagaaagagagagagagagagagagagagagagagtgtgwgtgtgtgtgtgtgtgtgtgtgtgtgtgtgtgaaatggggaaaaatatcaatgcatcaaaatggacaggtcattttgttgaatgtaactgaactcctaagc

SEQ ID NO: 12553 - DNA, 201 bp, Homo sapiens
ctgctgagacagccactttactcctgcttaattttctccctaatggtagcagtagggacttgggtatctacagtgagcttttaccaatttaacttgctgcygctataggccgttataaattattattcttatttagcacttgaatctataatttctttctttccctcatgttctataaaatatagacttagacctaagtta

SEQ ID NO: 12554 - DNA, 201 bp, Homo sapiens
ggggtttcactgtgttgcccaggctggtctctaactcctgagctcaggcaatccgctcaccttggcctcccaaagtgctaggattacaggcatgagccacygtgcccggcttccgcctctcttttttttaatgagcaatcataagttattatcaactagcatgcaggtaataattttcttatcttgttacttgtgttccac

SEQ ID NO: 12555 - DNA, 201 bp, Homo sapiens
cttagctcttcaaaggcttccaggtttttagattttccttctaagcctcaaatcctgttggtcatcaccctaaataatctatcacttatcacctgcaacakgctcaactgagataggtcttgtagaaatgaagcatagcctgaagttgagaacagaagaaacaggaggagaaaaagcaccagaagcaaatttattctcata

SEQ ID NO: 12556 - DNA, 201 bp, Homo sapiens
aaacctgccctgaagatcaaataaatgatatacatacgaattcctaataagtgctcagcaggttgtttgggcttatattagtctcctacagctgcctctcrggaagggataccccaacaaagtgtttgttaatgcttgccacctttagagaagtctcctgggatgctgcctaaacctacactgtaagcaaagtggaataac

SEQ ID NO: 12557 - DNA, 201 bp, Homo sapiens
atgctttaaaaaacctatttacttagcagtttcattttgtttgcagcctcattgcattttcttctctaattagcagatacatgcatcatctcttggagatraagcaaatatttttcttttcctcattgggtagtttcccaggaaagaagctcacggcctcactctggctccgggtttgctgtgtgctttcccacacattct

SEQ ID NO: 12558 - DNA, 201 bp, Homo sapiens
ttattaaattgtgttgagtatttagttttctgtcttattagaatggaagttccatgtcaataggacatgtggaaacatccacatatttcccttcctctggyactctacatggcaaaagtgggcagtagtctttgtatactacaggcacacatgaatgaattcatagacgaatggatgaatgagttaatgaggctatgagta

SEQ ID NO: 12559 - DNA, 201 bp, Homo sapiens
gatgaataaagggtcctgggaattcactatttttgcaagtcttctttcaatgagaaattattatatttatttatttatttatttatttatttatttatttwtttattttttgagacagagtctcgatcagtcgcccaggctggagtgcagtggtgtgatcttggctcactgcaaactgcacctcccaggttcatgccattc

SEQ ID NO: 12560 - DNA, 201 bp, Homo sapiens
tgggaattcactatttttgcaagtcttctttcaatgagaaattattatatttatttatttatttatttatttatttatttatttatttattttttgagacrgagtctcgatcagtcgcccaggctggagtgcagtggtgtgatcttggctcactgcaaactgcacctcccaggttcatgccattctcctgcctcagcctcc

SEQ ID NO: 12561 - DNA, 201 bp, Homo sapiens
ggagtgcagtggtgtgatcttggctcactgcaaactgcacctcccaggttcatgccattctcctgcctcagcctcccaaatagctgggactacaggcaccygccaccacacctggctaattttttgttcttttagtagagatggggtttcaccgtgttagccaggatggtcttgatctcctgacctcgtggtctgcccgcc

SEQ ID NO: 12562 - DNA, 201 bp, Homo sapiens
tgcctttcccaaaaagtctaaatgttttcctataatttgctgtctctccacaagtaatacatttttaaaagccatacttggtgagattatatgatccttgktcattattaaatattgccttttatttaacactattaaaaagatatattcttataaacagcttatttaaagtcaggaaccatctggaagtttcatctccca

SEQ ID NO: 12563 - DNA, 201 bp, Homo sapiens
tcaaatggccagcgagatctcttttaaatgggctccttattctttcagcactttatttgatatttgtggccacatacttgtattttgcaataaaaaaaaakttagattctttgcaattattttcttccgctaagcagaaaatcaacaaaattccagagaaccttgtgcaaatgagtgttgattgtggccatggtgcacctg

SEQ ID NO: 12564 - DNA, 201 bp, Homo sapiens
aagtaatcttattgtatcacatttctacttcattgcattgctctctaggggggaaattaacagcagaagacttgtcacttgagttctattcatgaccactytactctgagcattacagatggaatgcagcaaagaggagatacaattctaggggaatatgggcccatagatctttcaaaacaaagaagaaaagctttctca

SEQ ID NO: 12565 - DNA, 201 bp, Homo sapiens
atcttattgtatcacatttctacttcattgcattgctctctaggggggaaattaacagcagaagacttgtcacttgagttctattcatgaccactctactytgagcattacagatggaatgcagcaaagaggagatacaattctaggggaatatgggcccatagatctttcaaaacaaagaagaaaagctttctcacaatt

SEQ ID NO: 12566 - DNA, 201 bp, Homo sapiens
ggggggaaattaacagcagaagacttgtcacttgagttctattcatgaccactctactctgagcattacagatggaatgcagcaaagaggagatacaattytaggggaatatgggcccatagatctttcaaaacaaagaagaaaagctttctcacaattgctatagcaaataatgctttccactgctttagagtcatcact

SEQ ID NO: 12567 - DNA, 201 bp, Homo sapiens
acaccatgccacaaactttgtgccttataataccttggctgaatatcttctcagaggatgatcattcacttttacctttgtttgccaacttattccactgyggctctttttgtcttgcaatgcattctgtgtactggtgaagaagttttgaccacgaatagctgacaaatatgtgcaggtggtcatgcacagaagcagaaa

SEQ ID NO: 12568 - DNA, 201 bp, Homo sapiens
tttgtttgagttcattgtagattctggatattagccctttgtcagatgagtaggttgcgaaaattttctcccattttgtgggttgcccgttcactctgatsgtagtttcttttgctgtgcagaagctctttagtttaattagatcccatttgtcaattttggctttggttgccattgcttttggtgttttagacatgaagt

SEQ ID NO: 12569 - DNA, 201 bp, Homo sapiens
agattgtgtatgtgtttgagtatgtatgtatgctttaagccttgttccaagattggtttatattagaaactaaacaaatacagcccagcacggtggctcaygcctgtaatcccagcactttgggaggccgaggcgggtggatcacgaggtcaggggatcgagactatcctggctaacatggtgaaatcctgtctctactaa

SEQ ID NO: 12570 - DNA, 201 bp, Homo sapiens
tcaaaaaaaagaaaaaaaaaaaaaaggaaagaaaaaagaaactgaacaaatacgttatttactgaaggagtaaatatgtgtgacaaccagtggtgtcctcrttccgtatctccatcttcagagaatgcttgtgtgccttcaaatttatgacattttcctctcaccccttagtggtgaagaaactgaaatattgaccccatc

SEQ ID NO: 12571 - DNA, 201 bp, Homo sapiens
gcatatgtttttttctctgatattagggtataggacaggacgaggaataattaaagtccctccaaagattaggtcagaaagggaccataaaagcttttccwttaggaagctggctttggcgtttcattgtcattggagaaggcccatctgtacctatggcacgtgttatgctaggaaaatacctcctgaatccttttgtag

SEQ ID NO: 12572 - DNA, 201 bp, Homo sapiens
taggatgagaggtgttattgcatatttttacaagtatcagacatgtatgttctgaaaggcactagaatcattgaaaataagtcactgtgaagtgcaatgaytcttgaagataggggatagcagaagtgtgaaactttgtaggctaatcattatggccaatgcctaattaggatttatagtaccaaggcctgaccaaagtca

SEQ ID NO: 12573 - DNA, 201 bp, Homo sapiens
ggcaaaaagatagaataatgtttacctgatgtttatagtagtagaaaacacttcattgttagaaatagccaagaaggcacttacgttgtgggacactcatycgtcccgttgacaaaagttggattcattttatcttgcagaaattgcaaactagcatcccctcagacaaaatctagccctgataatacgtatttggacaac

SEQ ID NO: 12574 - DNA, 201 bp, Homo sapiens
ccaccatatccaaatgagaagtacagaagctattaccttaaaagtaagcagtgagaatcctaacatctttttttccatccccacattctcctcaatatgtkccctgtcctttgatgcataagagggtgaaaacctcacatgagtattttatgcactaccattttacaagtgtttcagtaaatattacttcatgtaattctc

SEQ ID NO: 12575 - DNA, 201 bp, Homo sapiens
ttttttttaagcaaaagtgttctcacacagaacacaggcaagcatgtctaacatgttccattctaagtcttgcccttgcatgtggttgaaaatgactatgsactatccacatcacaaattatgggttccagtgtgtatatggacacttctgaattcactcaaaatttttcttactgatccctattgccagatgggggagat

SEQ ID NO: 12576 - DNA, 201 bp, Homo sapiens
ttaaaaatgatttacaaatggccatcacaatgcaactggggatcaggaagagaatgttctatttgctccaatattaaaaacgcatgcccttctacagttcmttctgcagctgcctttgatttcagtactggtttactccctttttagaaattatttttttgatgaatatcatgttaaaatagttcctcctaaataatgtat

SEQ ID NO: 12577 - DNA, 201 bp, Homo sapiens
ctacctgccttttcttttctttctttctttccttgttttttttttttttttaccttcaggacttatgattctcagagaaaagagatggagaaaccagcccrtaacttatctatctgagctgaaacagaatcaatgacaatagtggcataagtatccaatgattttgagctaggccttgtgagtctctgactgtaaggtcac

SEQ ID NO: 12578 - DNA, 201 bp, Homo sapiens
cagggaaaaaaattccaaatgacaatttgtcttaaatgtagacagtgctttaaaatatatgcctgatcataagagtggatatagtatttaagtgtgtcagwactttcttgctcttctaccttcctcctttttggttattgttgaaaatatatggggaaaaaatggcaaaagaaataggccctacatctgaattttaagttc

SEQ ID NO: 12579 - DNA, 201 bp, Homo sapiens
aaacatacatattttgacttcagtaccataccagatactggaaaccaagtgataagatgactttactctgggatgtgaatgtcattgagtcagcagctttmtaccaaatcattaatctctgcccaggtccaaattgcttcagtgattttcctaccactcagcattttccttggtgaaggacccttccaatacaagtcttct

SEQ ID NO: 12580 - DNA, 201 bp, Homo sapiens
atactggaaaccaagtgataagatgactttactctgggatgtgaatgtcattgagtcagcagctttctaccaaatcattaatctctgcccaggtccaaatwgcttcagtgattttcctaccactcagcattttccttggtgaaggacccttccaatacaagtcttctggcttttctttctactagagggaaggctttctct

SEQ ID NO: 12581 - DNA, 201 bp, Homo sapiens
caacggcatcctgtttcttcacctgtttttcttttgcttacctgacaagctcttgcattcataaaagtcgaaaggattccagcttaacgtttcaatcccayaaagttgacttccatagcgtagcctggaacaccttgtctgtgaatagatatggaatcctcaaatggttttgaagccactaccagcaacaggtctgagatc

SEQ ID NO: 12582 - DNA, 201 bp, Homo sapiens
aggcatggccagtagccagagcaggagtgcctcagaaattgatgatagatgaagacaatttatgtagcagttcgtctaatggcagttctgcagggaggcakccttttgaaggtgatggctcaggttggcctacatgttcctgcccaattttaaaggtgtcataagccagtgtaattggggatctgtctggcttctgacttc

SEQ ID NO: 12583 - DNA, 201 bp, Homo sapiens
atattcctagaataagcagatgaaaatttaactatgatgcacagaagttaaatgtcagtaattccattcaactaggtcagtggaattggggcaggaacttkcttcattgtagcagtgaagctgttagctggtttacttagaaaccttgaatctgaggaatcatctccagagaacacctgatataagctacagttttcttga

SEQ ID NO: 12584 - DNA, 201 bp, Homo sapiens
aatggcagatgactgtggaaaaataatttggtgaaaacttataaaaggcccggaatgctgagatagaaccttgggttctattcagtatatattttgagaascactgatggtcactatggagaagaaagacgtgtgctatataatagaacaagaattgagaggtcattgactgggggagtttcctagacccagagaagggta

SEQ ID NO: 12585 - DNA, 201 bp, Homo sapiens
tgtttatcctcaggggacagaaagaacatatggcaactatctctcaagtaataatccttcaattttggaaatacgtattatataagatttttcctctctarccttttattctttgagctaaataatactaagaaatttaggctttctttatggtcatttcttcccaggacaatggcacagactgagtcaaattcagttcct

SEQ ID NO: 12586 - DNA, 201 bp, Homo sapiens
tatacacaacagacaagcaagataatatatatacctccaggttttgtggcatcaatagatttgataaacatactttgtgtcttcattagagcagtagatamatgaattagggctgtacagagtataaatccctgcggcacacccctacatatgccccatctagaatttctcaaatatccaggccacatctttctgtcctag

SEQ ID NO: 12587 - DNA, 201 bp, Homo sapiens
gataatatatatacctccaggttttgtggcatcaatagatttgataaacatactttgtgtcttcattagagcagtagataaatgaattagggctgtacagwgtataaatccctgcggcacacccctacatatgccccatctagaatttctcaaatatccaggccacatctttctgtcctagttacaatgttaattgccaat

SEQ ID NO: 12588 - DNA, 201 bp, Homo sapiens
aggctagttgtatggattaaatactatatacatgtaaaattattagcagatagtaggtgcttaattataattgtagacatttgtcaagaatgactcatttrgccaatggagtgttggcaaatgtttacttaataattaattggctttctgagagaaaaagctctggtttggagcatttgatgatttccctggtataaacac

SEQ ID NO: 12589 - DNA, 201 bp, Homo sapiens
atagtgtacctttataatatttcattgagaagtgtattaggcactttatcttgctaatgtaagatggttcactttaaagtgctctgtgtttgaaacattgyctttcttcacctttctaaagaacgctctaagatgatatatggcaaccaatcaatattacttttttcatttgtgtagcttatttaactacaactatttaat

SEQ ID NO: 12590 - DNA, 201 bp, Homo sapiens
ttggtggaaagatttactaaataaagcagagagacttttccaaattgtatttattatctttaaaggctttcccctgaaggtacactgggatactaagaagmcctgaatagcttaagatctctacaaaaggattccacataccggtttgggacttctaagggaaaatgcaaagattcacaacttttaatagacagtgatttt

SEQ ID NO: 12591 - DNA, 201 bp, Homo sapiens
atctgtaaactgagattaagatctgcttttctgtttaaagactattgcctacatcagagaaatcatccttcagcacttgaaagactttgaaaacagaggcytcctaggcagataatattttgtttactatggttggttttcttttttccttttgaatagactttattttgtagagaagttttaggttcatagtaaaattga

SEQ ID NO: 12592 - DNA, 201 bp, Homo sapiens
ccatcacacatgatagcttcccccatcaggagcattccatgcctgagtggtacatttcttacaattgatgaaacagtattgacacgtcatcacccaaagtmcatagtttacactaggattcactcttggtgttgtacattatcttcatgtgtcaccatcataatatcctacagaatagtttcattgccctaaaagttctct

SEQ ID NO: 12593 - DNA, 201 bp, Homo sapiens
tttacttagtaacatgcatttaagtgtcttccatatctttttttaatatatacatatatattttttattatactttaagttctgggatacatgtgcagaaygtgcaggtttgttacataggtatacacgtgccatggtggtttgctgcacccatcaacccgtcacctacattaggtatttctcctaatgctatccctcccc

SEQ ID NO: 12594 - DNA, 201 bp, Homo sapiens
tgttcctgtattagtttgctgagaatgatggtttccagcttcatccatgtccctgcaaaggacatgaactcatccttttttatggctgcattgtattccayggtgtatatgtgccacattttctttatctagtctatcattgatgggcatttaggttggctccaagtctttgctattgtgaacagtgctgcaataaacata

SEQ ID NO: 12595 - DNA, 201 bp, Homo sapiens
agagtttttatggttttaggtcttacgtttaagtctttaatctatcttgagttaatttttgtataaggtgtaaggaaggggtccagtttcagttttctgcrtatggctagccagttttcccaacaccatttgttaaatagggaaatcctttccccattgcttgtttttgtcaggtttgtcaaagatcagatggttttagat

SEQ ID NO: 12596 - DNA, 201 bp, Homo sapiens
gaggctactgtattcctagcccatggtgcctttcttccgtcttcaaagcctgcattcttctgcttctttgtccttttttaaagactcatgtgattagatcrggcccacccagataatccaggattatctccctttcttcaggttggctgctgaacaacctcaattccacctgcaacctaattcccttttaccatgtagcct

SEQ ID NO: 12597 - DNA, 201 bp, Homo sapiens
ttcaaagcctgcattcttctgcttctttgtccttttttaaagactcatgtgattagatcaggcccacccagataatccaggattatctccctttcttcagrttggctgctgaacaacctcaattccacctgcaacctaattcccttttaccatgtagcctaacatattcacagctctagggattaggatgtggacgtcttt

SEQ ID NO: 12598 - DNA, 201 bp, Homo sapiens
ccacccagataatccaggattatctccctttcttcaggttggctgctgaacaacctcaattccacctgcaacctaattcccttttaccatgtagcctaacrtattcacagctctagggattaggatgtggacgtctttcaggagccatgatccttccttccacacattatctgcagctaagcaacatgactccccatcacg

SEQ ID NO: 12599 - DNA, 201 bp, Homo sapiens
caggattatctccctttcttcaggttggctgctgaacaacctcaattccacctgcaacctaattcccttttaccatgtagcctaacatattcacagctctrgggattaggatgtggacgtctttcaggagccatgatccttccttccacacattatctgcagctaagcaacatgactccccatcacgacagagtagaagga

SEQ ID NO: 12600 - DNA, 201 bp, Homo sapiens
ctgcaacctaattcccttttaccatgtagcctaacatattcacagctctagggattaggatgtggacgtctttcaggagccatgatccttccttccacacrttatctgcagctaagcaacatgactccccatcacgacagagtagaaggagaaactgaactgtgagaggggaaacagctttatcaaaacatagcaaatgtc

SEQ ID NO: 12601 - DNA, 201 bp, Homo sapiens
ttgtttcatctcatgtatttattacactgttcacatatcaccttctattttcatgccccttgtaaacagcctaagaggcacattactggtaaagcctcagrgtaaacaggcattgcctcccattttgatttcagctccatttaatgactttttatacccaatgtggacacatactcatttttagttttccaatgcagattt

SEQ ID NO: 12602 - DNA, 201 bp, Homo sapiens
catttttagttttccaatgcagatttcagctatattttggctttattcctcttttttcatcctttttttcttttttttttttttttttgagacagagtctygctcttttgctcagtctggagtgcagtgacatgatctcggctcactgcaacctccaactcccaggttcaagcaattctcctttctcaagtaatcctcctg

SEQ ID NO: 12603 - DNA, 201 bp, Homo sapiens
gcgtgctccaagttcatcccgatttctttaatctagccttgttaaaacacattttaaggtcagtttttaaggcacaaaatgtaggatgagtgagttgatakgtagatatctattagcttgaaattgtattcaaaacagaacctcattcttaaaagtttaaaaatctatatcaattacccagcctcaaatatagttttcttc

SEQ ID NO: 12604 - DNA, 201 bp, Homo sapiens
acttatgtggaatccaaaacaatcaaatttatagaggcagagaatagaatagtggttaccagaagtagtgggtagggggaatggagagatgttggtcaaayggtacaaaattttagttagaaggaattgatgataagtatttaagaaaatggatatattaattagtttgagttaatcattctatactgtacagatataaca

SEQ ID NO: 12605 - DNA, 201 bp, Homo sapiens
tgtggaatccaaaacaatcaaatttatagaggcagagaatagaatagtggttaccagaagtagtgggtagggggaatggagagatgttggtcaaacggtamaaaattttagttagaaggaattgatgataagtatttaagaaaatggatatattaattagtttgagttaatcattctatactgtacagatataacatcact

SEQ ID NO: 12606 - DNA, 201 bp, Homo sapiens
aataaactcaatgcacaccagtgagagatcatgcccttttcttctgacaactttgtggcatctttggctgccctttttatgtgcttgtctttgtgctcccytacatcaatctcataaaacatcctttttttcatgcttgacatattgatatcatcccaccgcagataaaacacagagcagtgtaatatggacaggtgttgg

SEQ ID NO: 12607 - DNA, 201 bp, Homo sapiens
atgttgccacactctatgcaccatgctttgcatacttcatgtcattgactcctcagaatccagagagacagggagagaccatgggaagagaaagggagagmccatgggaagagaaggagagagagaagagaggagtagggagagagagagaagacagaggaaaggaaaaagaagagagagaaaaaagcgagatgagagaga

SEQ ID NO: 12608 - DNA, 201 bp, Homo sapiens
tgtccattttgcatatatggctttctaaagatccatttggaggagatcagatgttaaaagagaggatgtttgttgggggggtggtggtgggaggtgggtakggatagtactttagaaactgtttcagatctaagagggaattaacaggatttcagagggtgcgagaaaagtgggataatgttaagtattacattgaaagca

SEQ ID NO: 12609 - DNA, 201 bp, Homo sapiens
ttttgcatatatggctttctaaagatccatttggaggagatcagatgttaaaagagaggatgtttgttgggggggtggtggtgggaggtgggtagggatastactttagaaactgtttcagatctaagagggaattaacaggatttcagagggtgcgagaaaagtgggataatgttaagtattacattgaaagcagcgaat

SEQ ID NO: 12610 - DNA, 201 bp, Homo sapiens
atatggctttctaaagatccatttggaggagatcagatgttaaaagagaggatgtttgttgggggggtggtggtgggaggtgggtagggatagtactttakaaactgtttcagatctaagagggaattaacaggatttcagagggtgcgagaaaagtgggataatgttaagtattacattgaaagcagcgaatgagacctt

SEQ ID NO: 12611 - DNA, 201 bp, Homo sapiens
tgtttaaagtgtgtgtgtgtgtatgtgtgtctgtgtgcacatgtgtgtgtgcatgcatacatgtgtgtgacagaaagagacagaaagaaaggctgcctgamtgattataggtttataaggttcacttcttagttcatctctgaaaacaagagattttggctgctgtcttatttgtccttaaataatttgggtgatccacct

SEQ ID NO: 12612 - DNA, 201 bp, Homo sapiens
ggtttcttctgagatctcctctctccttggcttgcaaatggctgccttctctgtgtgtttacatgatgtgtgtgtgtgtgtgtgtgtgtgtgtgtgtgtgygcgcgtgcatgtatgtccccaaactccgagtgtttctttgccttcttataaggacaccagtatattagattagtgcctcacccttatgacctcacttaac

SEQ ID NO: 12613 - DNA, 201 bp, Homo sapiens
tgcttgaacctgggaggcggagattgcagtgagcagagatcacgccactgcattccagccagggcggcaatgcaagactctgtggccaaaaaaaataaaawaaaaaaaaaaaaaatgggtgggagggagggtgtttactccctgccctggagatttgtataaacaggaaaagaagactgttttcttgtttagtcttttaaa

SEQ ID NO: 12614 - DNA, 201 bp, Homo sapiens
actccgtctcaaaaaaaaaaaaaaaaaagaggctaagatcttggccacgttttcacagcagctaacaagcagaatcaggatttgaacctaggccgtggagyaccagagcccattctaaatctgaatgcactctcaaagtgtcttgcagggaggtgagcccagtctgtctctctcagacttcaagaccatttgcagtggtcc

SEQ ID NO: 12615 - DNA, 201 bp, Homo sapiens
tatgtaaatatcattttttatcaaagtgcaaggtagtttagtgattacagatatataaatagtaaaatatatttgtttaccaagctttaattacataagcracttttgtatattttttccttctttttttccctctctctcttaaaggtcattggacctttaagaaatccaatgtgtctgggcatggtggctcacacctgt

SEQ ID NO: 12616 - DNA, 201 bp, Homo sapiens
aaatgtctgagaccaaggtgtcagcaggtttagttctttctgacatctctctccttggcttgcagatggctgttttctcactgtgtcctcatagggtctcmccttgatctacatgcatgcatccctggtgtctttgtgtgtccaaattctcccttcttataagaacatccatcagattggattagggtcctccctaaaagc

SEQ ID NO: 12617 - DNA, 201 bp, Homo sapiens
cgtcaggcttcaacttcaatgttatcccctcaagagcccttccttaatgacccagtctaaaaagcactcttttttagaaggatcaagattatatgaaaaawtttaaaaaaataaaaaataaaaagcactctttcaaatgtctctccagcataccaccttgttttgttttcactgtagcttgaatatctctgttacagttcc

SEQ ID NO: 12618 - DNA, 201 bp, Homo sapiens
agggggttaggacttcaacatatgaatgttgaaatgaagtaatttggctcataataccatctttgtcctttgtatgtcttgagaatttccttttacactgkcttacctattacttatgtcatttctccattcttaacctctctttgcctcaagttcccaaagctattgtgcagccaactttaagagttaactgcctgcctt

SEQ ID NO: 12619 - DNA, 201 bp, Homo sapiens
gtcagggagttccctttccgagtcaaagaaaggggtgacggacgcacctggaaaatcgggtcactcccacccgaatattgcgcttttcagaccggcttaaraaacggcgcaccacgagactatatcccacacctggctcagagggtcctacgcccacggaatctcgctgattgctagcacagcagtctgagatcaaactgc

SEQ ID NO: 12620 - DNA, 201 bp, Homo sapiens
ggagttccctttccgagtcaaagaaaggggtgacggacgcacctggaaaatcgggtcactcccacccgaatattgcgcttttcagaccggcttaagaaacrgcgcaccacgagactatatcccacacctggctcagagggtcctacgcccacggaatctcgctgattgctagcacagcagtctgagatcaaactgcaaggc

SEQ ID NO: 12621 - DNA, 201 bp, Homo sapiens
tttccgagtcaaagaaaggggtgacggacgcacctggaaaatcgggtcactcccacccgaatattgcgcttttcagaccggcttaagaaacggcgcaccasgagactatatcccacacctggctcagagggtcctacgcccacggaatctcgctgattgctagcacagcagtctgagatcaaactgcaaggcggcaacgag

SEQ ID NO: 12622 - DNA, 201 bp, Homo sapiens
aaaatcgggtcactcccacccgaatattgcgcttttcagaccggcttaagaaacggcgcaccacgagactatatcccacacctggctcagagggtcctacrcccacggaatctcgctgattgctagcacagcagtctgagatcaaactgcaaggcggcaacgaggctgggggaggggcgcccgccattgcccaggcttgct

SEQ ID NO: 12623 - DNA, 201 bp, Homo sapiens
ctcccacccgaatattgcgcttttcagaccggcttaagaaacggcgcaccacgagactatatcccacacctggctcagagggtcctacgcccacggaatckcgctgattgctagcacagcagtctgagatcaaactgcaaggcggcaacgaggctgggggaggggcgcccgccattgcccaggcttgcttaggtaaacaaa

SEQ ID NO: 12624 - DNA, 201 bp, Homo sapiens
gcaaggcggcaacgaggctgggggaggggcgcccgccattgcccaggcttgcttaggtaaacaaagcagccgggaagctcgaactgggtggagcccaccayagctcaaggaggcctgcctgcctctgtaggctccacctctgggggcagggcacagacaaacaaaaagacagcagtaacctctgcagacttaagtgtccct

SEQ ID NO: 12625 - DNA, 201 bp, Homo sapiens
attttaacattttaataattgatacagttatctgggtgcatgccagttgacaacttgccctgcatattgataattttaccatgcagactccactcctcagrtaactcttgttctattacactggactttatcatcatgtaatctgtcctgtccctctctctctctctctctctctctctctctctattgaattctgggggt

SEQ ID NO: 12626 - DNA, 201 bp, Homo sapiens
ctgtgtgactctactggctgcatacccatgaagcttcacctgggttttgcaagccatatggtctctgtctcaagtatttagctgttgtaccatgaagtgcrgctataaatgatatgtaaacaaatggacgtgactgtgttccagtaaaactttatttacaaaaaacaggtagcagccagaatctggtctgtgggccattgt

SEQ ID NO: 12627 - DNA, 201 bp, Homo sapiens
aaaattctatgattctttcacattaaatgcaactccttttcaacatatgtgtatacttggccctttattgaacctttttataagctgccaattggaaatamacagtcatggtagatatgacaatgagcaagtcacttaataactatcagcctcagtttcctaatctacaaaaggaggctattaagagcacctacctcacag

SEQ ID NO: 12628 - DNA, 201 bp, Homo sapiens
ccctctgccttatcctcatacccttaaagatgtgacttaaaagagaaaaaattatgttgttaatttcatcaactagggcaaaggggaaaaatgttcatttygatgcaggaagttaatgggagatgggaggaagctacggttacaattcccataatacattaatgtatatttaatataccaccttgatttgtggcctcaagt

SEQ ID NO: 12629 - DNA, 201 bp, Homo sapiens
tatatcacttttacatatgtaatataagttgaacatctcattagaataatgtgacttttttaaaatttatttttgcttcctagagttcataaatcttcagrtggtaagtaggggttctttagctattcataatgcaacttgcttaggttaattagtagagaccctttcccttcacagctgaatatgagtgcccctacttac

SEQ ID NO: 12630 - DNA, 201 bp, Homo sapiens
ttatttctttctttgtatttgccatctcaccacagaagagttttattggccgggcgcggtggctcacgcctgtaatcccagcactttgggaggccgaggcrggtggatcatgaggtcaggagatcgagaccatcctggctaacaaggtgaaaccccgtctctactaaaaatataaaaaattagccgggcgcggtggcgggc

SEQ ID NO: 12631 - DNA, 201 bp, Homo sapiens
tggcgcattcttggctcactgcaagctctgcctcctgggttcatgcctttctcctgcctcagcctcccaagtagctgggactacaggcgtccaccaccacrcctagcttattttttgtatttttagtagagacagggttttactgtgttagccaggatggtctcgatctcctgacctcgtgatccaccagcctcagcctcc

SEQ ID NO: 12632 - DNA, 201 bp, Homo sapiens
gtgaatatatgtacatatatgtattatatatggtatatggtatatatgtgtatatatgcaagatatatatgagtatatatacatgtgggtgtgtgtgtgtrtgtatgtatatatatatatatatatatatatatatatatatatatatatatatatatacacatacatatgactccaaaaacaattcctctacaaattgtg

SEQ ID NO: 12633 - DNA, 201 bp, Homo sapiens
atatgtacatatatgtattatatatggtatatggtatatatgtgtatatatgcaagatatatatgagtatatatacatgtgggtgtgtgtgtgtgtgtatrtatatatatatatatatatatatatatatatatatatatatatatatatatacacatacatatgactccaaaaacaattcctctacaaattgtgtgtcac

SEQ ID NO: 12634 - DNA, 201 bp, Homo sapiens
gtgtatatatgcaagatatatatgagtatatatacatgtgggtgtgtgtgtgtgtgtatgtatatatatatatatatatatatatatatatatatatatayatatatatatacacatacatatgactccaaaaacaattcctctacaaattgtgtgtcacttccttgacccattacctccccaatgtatatatcatgtgaa

SEQ ID NO: 12635 - DNA, 201 bp, Homo sapiens
tgtttttccaacaaaaaataggatgagttcacctgtgaagcatcctgaagggaaacaccggtgcactgggcagggaacaggagacctagatatacttcttyttttttttttttttttttggtagatatatttatttatttatttatttttattttattattattatactttaagttttagggtacatgtgcacagtgtgca

SEQ ID NO: 12636 - DNA, 201 bp, Homo sapiens
acccagtaatgggatggctgggtcaaatggtaacaacaggtgctggagaggatgtggagaaataggaacacttttacactgttggtgggactgtaaactasttcaaccattgtggaagtcagtgtggcgattcctcagggatctagaactagacctagatatacttctaacataatctgtgactgtgtgcaggtcatgcta

SEQ ID NO: 12637 - DNA, 201 bp, Homo sapiens
ccttctctgtgcctcagttttctcctctgcaaaatggaacaatagaatccttttcattgagttattctgaggattaaatgagtgaatataggtaaagcacrtaggacatccctggtatatagcagtcaatcccttgtaaaatgttagctgcagtgggtgcaactgactgcggccagttgtcaccacctgtgacatttacca

SEQ ID NO: 12638 - DNA, 201 bp, Homo sapiens
accatcttaccccaggagagatcaaaagacattcacagattatgttaacccaaagttttggcctcatttctcaaggaaggggctacatcttttagaccacrggcatttttccccagttttgaaactgtgaaggtgtttaggacctgagagattattaataacaggtttcaatgcctgacactcttggacttaaatgttcac

SEQ ID NO: 12639 - DNA, 201 bp, Homo sapiens
acattgtgcaggttagttacatatgtatacatgtgccatgctggtgtgctgcacccactaactcgtcatctagcattaggtatatctcccaatgctatccytccccccgcccccaccccaccacagtccccagagtgtgatattccccttcctgtgtccatgtgatctcattgttcaattcccacctatgagtgagaatat

SEQ ID NO: 12640 - DNA, 201 bp, Homo sapiens
attgtgcaggttagttacatatgtatacatgtgccatgctggtgtgctgcacccactaactcgtcatctagcattaggtatatctcccaatgctatccttycccccgcccccaccccaccacagtccccagagtgtgatattccccttcctgtgtccatgtgatctcattgttcaattcccacctatgagtgagaatatgt

SEQ ID NO: 12641 - DNA, 201 bp, Homo sapiens
caggttagttacatatgtatacatgtgccatgctggtgtgctgcacccactaactcgtcatctagcattaggtatatctcccaatgctatccttccccccscccccaccccaccacagtccccagagtgtgatattccccttcctgtgtccatgtgatctcattgttcaattcccacctatgagtgagaatatgtggtgtt

SEQ ID NO: 12642 - DNA, 201 bp, Homo sapiens
ctttgagtgttttttgttaagtggctaatgcagtttgcatatttgtcccactaaatctcaagttaaatgtaatcctcagtgttggaggtggggcctggtgrgaggtgttagagtcatgggctgagcactcagacttgggcaccatccttgtgacagtgagtgagttctcacaaggtttggctgtttaaaagtgtgtggcca

SEQ ID NO: 12643 - DNA, 201 bp, Homo sapiens
ttcaactcccacttatgagtgagaacatgtggtatttggttttctgttcttgtgttagtttgctgagaatgatgatttccagcttcatccgtgtccctgcraagtacacgaactcatccttttttatggctgcaaaatattccatggtgtatataccacattttctttatccagtctgtcatcagtaggcatttgggtttg

SEQ ID NO: 12644 - DNA, 201 bp, Homo sapiens
caggagaatggcgtgaacccaggaggcagagcttgcagtgagcccagattgctgccactgcactccagcctgggtgacagggcgagactgtctcaaaaaamcaaaaacaaaaacaaaagttatagttcagaatatttattgcatacaactcagcaaacaaagttgacctagatacaagagtattattggaatttgttagtg

SEQ ID NO: 12645 - DNA, 201 bp, Homo sapiens
ggctcaagtgatcctcccaccttggcctcccaaagtgctgggattacaggcgtgagccacttcacccagcctttttttctgtgtctaaaattcagttactytctcattcacttaacagtttagaaaatactaactatacaacatgtactacgctagatgattttttaacttaaaaatgtgcaatgcacatgcatattcata

SEQ ID NO: 12646 - DNA, 201 bp, Homo sapiens
ttctatgtcagagtttgcaagcatgtggcttataaactcaagatggctggtacaatgttgttcaatatttaatggaggggtattaccaagatctagttttstaggttttcttgagaaattagaaaatctggcaacactaagtttgtaataataccagggacaactagccaaactgccctattttgttgaatcatgtgctgt

SEQ ID NO: 12647 - DNA, 201 bp, Homo sapiens
acagcagtcaataaaaataaggtaacacaaagcagctctcttgaaaacaaaatcagagcctatactcttaagaagttcatagccgtcacaaaagggccctygtggcagtagaagctaaatggccaagaatgctggaaatggggctgcaagtcataaatggagaaagtctaaactaagagggtaaacagcaggtgacagtaa

SEQ ID NO: 12648 - DNA, 201 bp, Homo sapiens
aagaacaagcattgcaggccccagatatttagagactccagtgacatttgggcttttcctgaactttagtgtgcaatgtcattttaaaaagtattttaggrgaaatgataaattatagccagtttcataaaagaggtatacattatatttttaaaagactttatatgaactgaatcatttgactttaagtttgggtgtaaa

SEQ ID NO: 12649 - DNA, 201 bp, Homo sapiens
gtaagtccagacccgagtgataagatggatggctgtctagattgagcatgcaattctaatacttcagttccacattcttttttttttttttttttttgagrcggaatcttgctctgtcacccaggctggaatgcagtggcacaatctcggctcactgcaacctccgcctcccaggttcaagcaattctcctgcctcagcct

SEQ ID NO: 12650 - DNA, 201 bp, Homo sapiens
taggaatagtctttcactttccattttgtactctgggtcttctctgattatatatctcttttggttttcctttccaagctccatctttatcccaacctatwgggtatacatctgatcactgctttgctaacacgataatacttgagactaattaacaataccttagtgatactgcattctcaaataggaaaatttcaaatg

SEQ ID NO: 12651 - DNA, 201 bp, Homo sapiens
ttgtataagaaactcaaattatccaggtgttgaaatgcatgtctactttcttttcagacaatggaatcatttataaaacatatagttatttaaaacacagrcacacatacagagactatcatatgggattgtgagagattgctaattaacacatacaaattaagacaaatattcattaaaacaaatattaattcctcaaag

SEQ ID NO: 12652 - DNA, 201 bp, Homo sapiens
tagtgtaccagatgaaaagcagaaactttaggtagccgtctgaatgtgtcaaatgggaatatcagaataactcactaaatttcctttttcaactttcctckcaaggtttgtctttttatgtggtaaatgttggtgagttccatttttaagttttactcttcccattctacttcagtctccttagcaaacacacacacaaac

SEQ ID NO: 12653 - DNA, 201 bp, Homo sapiens
ccatgtctgcctagtaccttcacttggtcaaatacctcttttggtggaaacaacacaaattatgtaggttgtatatacaggatgaactcggtttaaagatragacatgaaattcagtggaaatattctttaaattctaaacagagaaatcaaaacaaaggtatattcatactgcatgtgggtataagttttttcttacata

SEQ ID NO: 12654 - DNA, 201 bp, Homo sapiens
ctcataatttaatgatctctgcaatctctaagctctgctgggaaatgagctccagcataacacgggttctgggtctgtagtggcatcgctgactgaaagayaggtcatttttaaaatagtggtatgacctttggctgtgatttcctcataataaacataatatgatttttgtgccaattttctgttaattatgggcttctc

SEQ ID NO: 12655 - DNA, 201 bp, Homo sapiens
aagtatgaggatcatataaatcaggcatttaaatcaaagcactggaaataagcaactgctttttatgtgtattgtttttccagagaatattcaatacttakctaccccttcattgttcttattaaaaaaggtatttcaaggctgtgaaataaaaggaggaaaagaagacaaatgtgtatgttccaaacttctcctttcctc

SEQ ID NO: 12656 - DNA, 201 bp, Homo sapiens
cgatagatcactcacttaattagctatatatatatatacacacacatacatatattcacatatatatatacacacacacacaaccaatattgtattattgkattttagtacttttattaagccattttacctgtaattatttgatggggtaaataataaatgaattctagtctattgtattttttaactgaaccttttttg

SEQ ID NO: 12657 - DNA, 201 bp, Homo sapiens
attaagatacttttataacttttacaatctgtaaaaggtggttctgtttgttgaatggtttgttttcttgtactaaagaaaattactgaagagagaaagarctttggggccattaatgaaagtggaagggattgagcataaggcagaagatgctatttctccttacagtttgcctagaagagaaacctcctgggaaaaaga

SEQ ID NO: 12658 - DNA, 201 bp, Homo sapiens
actaaatggttatgaaattatctagccctttattaagtgcaaaaggtagtacttaggttactaaacttttttgaaaataattccgctggctgacttttcayggctaaaaacccatattcttatctgtggagtgtatctttttgtaatcacatctgtgtttgctgtttttttaattgtccaggcagtatgttagccattttg

SEQ ID NO: 12659 - DNA, 201 bp, Homo sapiens
tgggggtggttaatgagtattaaaaaaaaaatagaaggaatgaataaaacttatctggtagcacaacagggtgactgtagtcgataataactcatctgtasattttaaagtaaagagtataattggattgtttgcaactcaatggataaatgtttgaggggatggatactgcattcttcatgatgtgattattgcacattg

SEQ ID NO: 12660 - DNA, 201 bp, Homo sapiens
agtgaagtacctttttttcttatttgagcctgctctgcattgagggagagtttgacacacctctttagggttctgagaatagttaacagctctaagaaagrgatttttgttcataagaaaaaacaagagaaactggaagcagttctcattcatattctctctctcgccacaccccccaccccacctcctcccgcctctccc

SEQ ID NO: 12661 - DNA, 201 bp, Homo sapiens
agaatagttaacagctctaagaaagagatttttgttcataagaaaaaacaagagaaactggaagcagttctcattcatattctctctctcgccacaccccycaccccacctcctcccgcctctccctctccctcttcctctctctccctctcttcagtatctaatgtaaacccaggctttctttatgttctgtgcagttgg

SEQ ID NO: 12662 - DNA, 201 bp, Homo sapiens
agttctttagtatttcagtgatttggttatcactcaacagtgcacacatttcttctataaaatttgatagttacttatctatctctgatttttccctctgkgttttattatatctagtttaatttttcccctttgttgatttctgttttgtatatcttgttgcgggatatacatggaagggagacgagtttccaaagataa

SEQ ID NO: 12663 - DNA, 201 bp, Homo sapiens
agtgtggaaaatgaaccacctcttttgactctttgcaagatttgtgatgtcctactgggatgcctgggcccaggcacattcaccttgattctacatcagasacttctgtgtcttctttctcatagtatgggttattgggttgagcaaatactttgtcatcagtgtgtcttatggagtaattgagagccttggatttgaact

SEQ ID NO: 12664 - DNA, 201 bp, Homo sapiens
atgaactgcatgaccttgagcaaatcactgaaactctctacagtccagattcgtaatctattaaatggggctaataatacctcatgcatatggctgccaaygggagttagtgaaataatgtacatgaaatatttaacactaaacttggtgcctaatgtatcttcagtaaatgataactattgtcatagtcatcattgcttt

SEQ ID NO: 12665 - DNA, 201 bp, Homo sapiens
cttgaactcaggaggcggaggctgcagtgagccaagatcccaccactgctctacagcctggccaatagaggaaggctctgtctcaaaaaaatatatatatwttatatatatgtgtgtgtgtgtgtgcatgtatgtatatatatatgtgtgtatatatgtatatatgtgtatatatgtatatatgaaaagagcagaatttaa

SEQ ID NO: 12666 - DNA, 201 bp, Homo sapiens
ttgaactcaggaggcggaggctgcagtgagccaagatcccaccactgctctacagcctggccaatagaggaaggctctgtctcaaaaaaatatatatatawtatatatatgtgtgtgtgtgtgtgcatgtatgtatatatatatgtgtgtatatatgtatatatgtgtatatatgtatatatgaaaagagcagaatttaaa

SEQ ID NO: 12667 - DNA, 201 bp, Homo sapiens
ttcaatagtactttcacattctgtagctatatgggcttggatacaaattgtaatgtcagtctgtcaggagagtggatggcagtgcataattacaagttctygttcagcacttcaggagctaatcagagcaaggatgtgaatctgtaatttgcaaatgtgcaaagacagaggttactatggcactaacgactctgctgataa

SEQ ID NO: 12668 - DNA, 201 bp, Homo sapiens
tcgtaaagcaatatatagagcaaattaatacataaaatacagagaaatatagaaaattaatatactacatcatgcaacctgcttctaaacaagtgtttctytcataggactgaatcaggaaagattaaataaggagttgagtagaaacatatatagatatgtagagatagagatataggcaatgttttctttttttttatt

SEQ ID NO: 12669 - DNA, 201 bp, Homo sapiens
tggtatgtgaaaatggaatttcagtgtagttttattttctttttcttatgatgagtgagattgtacatctgtttatatgtttaggaactttttagaaatcrtttgtatgaactttctattgatattttttgaccacttttgtagtagtttgctgcttttgtttttaattgatttctactagagagactaatctccatgata

SEQ ID NO: 12670 - DNA, 201 bp, Homo sapiens
ttccttttagcattgcacttgatttgtgaagtagtgttgactgctagattcccatcattaacattaagttttattgccttaaatctctgtcttatgttcamtataaatgttttaagtcaacataatgctagcaagaggtgctgggttaacagactacagttggcatatgattctcatttggggcagggaattgtgcagggt

SEQ ID NO: 12671 - DNA, 201 bp, Homo sapiens
ggagtgcaatggcgtgatctcggctcactgcaacctccacctcctgggttcaagcaattctcctgcctcagcctcccgagtagctgggattacaggcatgygccaccacgcccagctaattttgtatttttagtagagacggggtttcttcatgttggtcaggctggtctcaacctcgcaacctcaggtgatctgcctgcc

SEQ ID NO: 12672 - DNA, 201 bp, Homo sapiens
aaacctatcattggcagcaacccaggcaagcatttatttctatatcttgctgatggggttgatggggttagcaattgctatagtctccctagtaggggatwtaggagacagatgaaaaactgttagactatttacgtatttaaccaaaaggttccattttggggtattcatcctatggaaatagtcatgaaagtaggtaaa

SEQ ID NO: 12673 - DNA, 201 bp, Homo sapiens
tcagctttctctctgtgcttgttttctctgctctctctgtttggatttgaagaaaaagaggttttttgttttttttttttcctttttcttttgtctctatyttatttattttttaagtagactgtcaaaattttagctgtgattgaagaaaagaaataagacaaataaaattagtgggaaaccaaggagggggaaatggga

SEQ ID NO: 12674 - DNA, 201 bp, Homo sapiens
gtagactgtcaaaattttagctgtgattgaagaaaagaaataagacaaataaaattagtgggaaaccaaggagggggaaatgggattgccacttcctcttktacagagtcagcagttttaatacctgtaaacaaaaagttctttgctggaactctttttagaatggaaaatgggatgaataggtacagcattatcaaacca

SEQ ID NO: 12675 - DNA, 201 bp, Homo sapiens
aagcttttcttttcttatttttaagttttgtttattttttttctctcctctctccaattggtataggaacatttattttggatttccagtagcaggcattmtacctttttgtaataaattatattaatacctgttatacattgagcacatgctatataccaggcattctatatactttatcatctttaaccctcagagcaa

SEQ ID NO: 12676 - DNA, 201 bp, Homo sapiens
catcactctgatctctggctgtctttacattgccttctctgtgtttctccttttctgcctgtatcttctcttcttctaaagacacttgccaggccaggagyggtggctcaaacctgtaatcccagcactttgggaggccaaggcaggcagaccacctgagtttgagaccagcctggccactgtggtgaaaccctgtctcta

SEQ ID NO: 12677 - DNA, 201 bp, Homo sapiens
cagtgtccctgcaaaggacatgaagtcattcttttttatggctgcataatattccatggtgtatatgtgccacattttctttatccagtctatcattgatrgacatttgggtttgttccaagtctttgctattgtgaacagtgctacaataaacatacatgtgcatgtgtctttatagtagaatgatttataatcctttgg

SEQ ID NO: 12678 - DNA, 201 bp, Homo sapiens
tgacaaatatttttcaaacacattgaaatgagtttgatcaccacctgggcattcacagtagtccagaggtcccctgcactgtgagtgtgactaaagctcakgaaagtcagaaaggccagccaaggaaggaagatgctggcaagactcggaaagtgcaggagtgtatgagattgaatcacctggacaggggcacccaaacaa

SEQ ID NO: 12679 - DNA, 201 bp, Homo sapiens
gatgaaacaggcattccaggaaaagggaatagcaagttcagagacttggtatagtcctaaattatgtttgtcttcatttcagctagtgctatttcattgtygctggagataacacacacttggattccgttacgtattttcaccttgccaacttgctttgtttgcagaccataatttctgagtttatctctacagcaggtt

SEQ ID NO: 12680 - DNA, 201 bp, Homo sapiens
ttgtctgcattgaaaatctagtgcagccatctttatcaatgatcttagctagaacttctgaatagcttgctgcagcttctccattagcatgtgctacttcmccttgcacttttatgtatggaggtgacttctttccttaaacctcatgaacaaacttctgctaagcttcctacttttttttcctacagcttcctcactctt

SEQ ID NO: 12681 - DNA, 201 bp, Homo sapiens
ttgtctttctccagctgttgaatacaactcataatgctattcaataaaaccagaaagaaaatgagagtacaagggaaagaagagatgtcagaaagagagamcaagagaacatacgagtctgccttctcttggaatagacagcaaagccatattgtgatgttgactatatcatgcagtaatggtgaacaaatgtagcaagaa

SEQ ID NO: 12682 - DNA, 201 bp, Homo sapiens
tgctaattactcacaacccagataatacttcgtttaatgattttatcccatttgttatcccctataacattcatctgcataaattagtttcttgtcaaccyttcagaaagggtttaatgacagttcatggtgtttacttattttctaaaagtagtctaagtgagtcattataaattgaacattcaagttaaatttgtctga

SEQ ID NO: 12683 - DNA, 201 bp, Homo sapiens
ataaaagtactttgaagtcccactgatttccatgtaaatatcatacaaatttggatttgctttaacattataattccatcagcttagaagttaaaatttasaaaagctgtagttcattagtttaagtcacttcaaaacttaccttgcttagttttcagatagactcccatcctatacttctaggactgtacaaataaaaaa

SEQ ID NO: 12684 - DNA, 201 bp, Homo sapiens
aataacaaccttgctaacatatgactaaaataggaactggcagctgggggtgatgagagaaatgaaggcagtcagctacacactgactgccggggagcatyctgcacctcagataagggagcttccgcaatgaatgcctgggcctttggctttgtttcaagtcttttgatctagcggagtccataggatcatttttcccgt

SEQ ID NO: 12685 - DNA, 201 bp, Homo sapiens
tgcattcacaatctgcactgttattataccaactctaggtgaaggatgcatgatccaaaggtccagagtttgaaagcttgcagtctgcaaaactgccctcrcttctgatttgaattgcaagttcaggggtttctccaaatcactttcagatttgataatttgctcataggacttacaggactaactgaaagctgttggact

SEQ ID NO: 12686 - DNA, 201 bp, Homo sapiens
aacgggaaggcagctataaatagcatggtccattttatctgtttctttggtgtgtaggaagagcattgctaagattctcccttgaagttcagttaactcaraatgtgttctgcttttgttattctgctttggcttaaaaaaaagtctcctgatgctgttcaaagtggggaaaagaaaacaaaaacaaacaggagtcactct

SEQ ID NO: 12687 - DNA, 201 bp, Homo sapiens
agcctgggcaacatggcgaaacccaatctctacaaaaaatataaaaattagccaggcatgctgacatgtgcctgcagtcctagctattcgggaggctgacrtaggaggattgcttgagcctgggaggttgaggctacagtgagctgtgatcatgcccctgcaccccagcctgggtgacagagcaaaactctgtctcgaaac

SEQ ID NO: 12688 - DNA, 201 bp, Homo sapiens
ccttgccttccaccatgattgtgaggcctccccagcgatgtggaactgtaagtccattaaacctttctttcttttgttaaaaaaaaaaaaaaaaaaaaaarattatgatagtgctagtcaatactgagttgactgtcaaaaataagcacactttacattagccagttacttctgggacactgttgaagagtatgtcacatg

SEQ ID NO: 12689 - DNA, 201 bp, Homo sapiens
aaaataagccatcaagtactttaactttctggtatttcaaaagtaaaaacatatactaatcacttgtttttatttcacttatttgacactacacatctgtyttagtacaaactcatgtttatgcaatgagatttattagactgatagttcatatcttagccccttttcatagagaatcattgaaaaaaaaactgttcactg

SEQ ID NO: 12690 - DNA, 201 bp, Homo sapiens
ctggctaacacggtgaagccctgtctctactaaaaatacaaaaaaattagccgggcgtggtggcgggcgcctgtagtcccaggtactcgggaggctgaggygggagaatggcgtgaacccgggaggcagagcttgcagtgagccaagatggcgccactgcactccagcctgcactacggagcgagactccgtctcaaaaaa

SEQ ID NO: 12691 - DNA, 201 bp, Homo sapiens
ctggagtgcagtggtgcagtcttggctcactgtaacctcccttctcccctcttgggctcaagccaacctcccaccttagcctcctgagtagctggaactayaggcatgtgccaccatgcccggctaattttttgtcaagacggggtctcactatgttgcccaggctggtctagaactcctagactgaagtgatccaccagc

SEQ ID NO: 12692 - DNA, 201 bp, Homo sapiens
atccttaagggaaaggatgaggaaaggaagacaagagagaaactagcatttgttgactggctactacgtgccagccacagcactagctactaaacctgtgkcactttatttaaatatgaaggtcagaaagcatttctcatgttcctggtatctcctgcactgcctagtataatatttcatacttacaggtgcttcatcaat

SEQ ID NO: 12693 - DNA, 201 bp, Homo sapiens
acagcactagctactaaacctgtgtcactttatttaaatatgaaggtcagaaagcatttctcatgttcctggtatctcctgcactgcctagtataatattwcatacttacaggtgcttcatcaatatttgtgttggttgacttagcaatttaaactgcttctaaatagagttacgtgagtttttccccaaagactcatgcc

SEQ ID NO: 12694 - DNA, 201 bp, Homo sapiens
ttcatacccagcagtatgaagaagtgaaggatgagttgggaatacagaacttgatcattgagagtcatactagtcacaccaaggaagttagagttaatcarttgacaacggggagctcttgaaaagaactgacaaggtcagatttgcattttagaaatattgttgtggaaacagaaggattgattagaaggaagccagaac

SEQ ID NO: 12695 - DNA, 201 bp, Homo sapiens
agacaccaaagagccacgttattgtcccctcacagggagctctagaaatacatgacctaaattgtttcttctaagcatattatcagttccattttcaaggkatcaacatgatatctttccattggttcacaggaagaccaaagagtgacaagagaaaaatgtttccatttgtagtttttctacagactcatggtataggtc

SEQ ID NO: 12696 - DNA, 201 bp, Homo sapiens
atacatgacctaaattgtttcttctaagcatattatcagttccattttcaaggtatcaacatgatatctttccattggttcacaggaagaccaaagagtgmcaagagaaaaatgtttccatttgtagtttttctacagactcatggtataggtcagcttttttattgtaaatatttaagatgtacatttaaggtgtctcca

SEQ ID NO: 12697 - DNA, 201 bp, Homo sapiens
aggaagaccaaagagtgacaagagaaaaatgtttccatttgtagtttttctacagactcatggtataggtcagcttttttattgtaaatatttaagatgtmcatttaaggtgtctccatatatgtatatatatatatatgtatacatagtgaaattactagtagagtcaagaaaattaacatatccatcatctcagttacc

SEQ ID NO: 12698 - DNA, 201 bp, Homo sapiens
tgttactatgtatttgactgtttattagtgtcgacttaggagtgagatcaaactctttcactctctctttctttcccgtttttttttttgtttgtttttgkttttttttaaacaagatctcacactgttgcccaggctggagtacagtcacatgattccagctcactgcagcctcaacttcccaggctccagggattctgt

SEQ ID NO: 12699 - DNA, 201 bp, Homo sapiens
tattagaaaataaaagaagattaaaataaaaaaaggtttccttttaatcaatctattaataaaaagataagtactgagattccgttgacataaaagtaatkgaaagtttataggcaaattcttgaaatagaaaggcactttttttcctcataagaggacagtttagaggatttaaaaagcaatcaaaggtctcatgtttta

SEQ ID NO: 12700 - DNA, 201 bp, Homo sapiens
gtgagtgggaaaggaacaggatggtagagtttggattggggaacagactttgagcactgaacagcaggcagcattgctgttggcagagtaacggagaaggygctgaggcttacccatgccatcatggcaaaaaatagcacggaaacagctggtgagctgtcagaatgatcttaaggaggaaatgtgaaatgtttctgcttg

SEQ ID NO: 12701 - DNA, 201 bp, Homo sapiens
gcaagtttatttaaatctagtctttcttatgagtctgcctaacagtgatagattttgttgttgagccacagtttatgaaaagtgcattaaaacctcgagcygacccatctctctgaagcagcagttgggccattacattttggcaggcacttcagatgtgtgtatgattttatgatcaggtctgcttaattcatcccaact

SEQ ID NO: 12702 - DNA, 201 bp, Homo sapiens
atcaaatgaggaagcagaaaggtaggattgattgtaatgtgtgcacagaggagtgaagcctgattacctgtactactcattgccagaccttcaagaatcgygtgccaagtgccaggtgcagaagttgcaaaactgtttgggagatcaaagagaaaatatcaacctggctttcaagtcttttcagggtgctttcttagaaaa

SEQ ID NO: 12703 - DNA, 201 bp, Homo sapiens
tactcatattgtggtttaactatgtggttgtcttctccaccctgacaatagatacatctattgtccatcagcccaatttacaacttttgcatctcttctgwtttctatcctctgctaatgacacttattaactactgcctttccactggactttgcatttagttttatatatatatatatataaccttacttctgctttta

SEQ ID NO: 12704 - DNA, 201 bp, Homo sapiens
ccttccactttctccaacactagattgcaaatttctacagggtgaagcttatgttttcatcccttaacacccagcttaaatgtcacctcacatactgactratgctttttatctcagttctaaaacattattaatgtacatcacataatttaactccattttgaaaattagttcttgttccagtatcttatctcttaaaat

SEQ ID NO: 12705 - DNA, 201 bp, Homo sapiens
cagattttgtatccacaggggtcctggaatcaatccccttgatggatacagagggaagactcactctcactctctcttgatatatatatatatatatatayatatatatatatatatatatatgcacacatacacacacacacacacacatatatatacacacacatacacacacacgtatgtatatttacatgtatttat

SEQ ID NO: 12706 - DNA, 201 bp, Homo sapiens
gtggtgcaatctcagcttacagcaacttccgcctcctaggctcaagcaattctcctgcctcagcctcccaaagttctgggattacatgtgtgagccaccaygcccacccttctctataatttaaatgttatctctctttataacattttcataagaggatccacaattctattttcccattcacttataaagaacaaaaat

SEQ ID NO: 12707 - DNA, 201 bp, Homo sapiens
atttttttccttttaagaaaaggaaagccattaaaaattctcttttgctaattctagaaaatttaagcttcatgaaaaaataatctaataaaaataaaaascttccatttctgacccctaaatgatttacaagatttcaaatctgttgaagcctgactgctttggtttcttgcaagtggaattggatccaggaagttctgt

SEQ ID NO: 12708 - DNA, 201 bp, Homo sapiens
aattctcttttgctaattctagaaaatttaagcttcatgaaaaaataatctaataaaaataaaaaccttccatttctgacccctaaatgatttacaagatktcaaatctgttgaagcctgactgctttggtttcttgcaagtggaattggatccaggaagttctgtgggttcatacccttagtatgacacagggacacatc

SEQ ID NO: 12709 - DNA, 201 bp, Homo sapiens
ctaaagctaagaccttttttttttttttttttgcatgtctttttttctctgataatcccagagtttatataacctcaaactataagcttgatgaattttaragttcattgtaatgcttttggtttaggtgacaaaactgatgcctacaaagataaactgatttgctgaaggtaatggacctagtctttattggagttgtaa

SEQ ID NO: 12710 - DNA, 201 bp, Homo sapiens
ttgttagcttgaactcgataaatgtgtgttcaccctatcagttgtcattcatgctgacttcttcctctactctcttcactctgattctgttttcatttaaraaaatttcagaagtagtgaagctaggagagttaatgagtagccacgttgaccctagtaggatcttacccattggagaaaagccctgttttaaaacgatgc

SEQ ID NO: 12711 - DNA, 201 bp, Homo sapiens
gcttattgtgaggagggtctacttttggtctccccatttcatgtgggttctggttgtggatttttttctctcttgccctgccaggctgtcaaaataaagaycaaatttgccagactcacaagatgtcttcagggcaaaagtgattttcatacttgtctggattcctgtttcctttcacttttagactagtctttccttact

SEQ ID NO: 12712 - DNA, 201 bp, Homo sapiens
acgttagctttgtctttcacacatctgcttatcttctctagcttcatgtggttgaaagcagaagatatgacatacgtagcatggaaaatgtgatgtgggtraaaggaggtttctttctttttattctcagaaatgtctttttcacaatgaaaccagcaatatttattgtttttcctggttatgtaaataatacatgctcac

SEQ ID NO: 12713 - DNA, 201 bp, Homo sapiens
cctccattgcaagagggaatcattagtctcttcctttagaacaagttcatccaaccccaggtctgcaggctgcacacagcccaggatggctttgaatgcartccaacacaaattcttaaactttcttaaaacattatgagatttttgtgtgtgtgaattttttttctaagcacagcagaaatcattagccttagtgtattt

SEQ ID NO: 12714 - DNA, 201 bp, Homo sapiens
tcctagattctttcatctactgtctctgtcatgcctccagctgacaaatgaaaaaacagaatgtggaagataaggttttgcaggccagatctggaagtagstatatcacttctgctcatattctattggctagaactcagtcatgagctcattctcaactgcagggaaagccgggacatgttgaccggctatgagtccagt

SEQ ID NO: 12715 - DNA, 201 bp, Homo sapiens
agaatattgtcgttagaatttgatgtactgaagtttgttcataaatctaacaaatgtttactgagtatctattatatgccaggcactcttcttggctctgragatgtagcagtgaacaaaacagatacaaatttctaccaagaatcttatgtttgagagggtaccccgaatgaaagaggagcaaccaagagtggagaaaag

SEQ ID NO: 12716 - DNA, 201 bp, Homo sapiens
atggagcgtggaaataaattttacttgcaggcgcaacaccagattgtggccagggttgtctggggttaaacgtgggtgccctggtgggattttatttctawcatgtacatgttttataaaatgggatgtaaaaaattggagatggccgggcacagcggcttacgcctgtaatcccagcactttgggaggccgaggtgggag

SEQ ID NO: 12717 - DNA, 201 bp, Homo sapiens
caggattctgtctcaaaaaaaaaaaaaaaaaatcaaatcattaaaccaaatgaaaatgtaacatattaaaatttgtgaaactcagccaaagcaatgctgaraaagacagttatgtagctaaatacatacattagaaaagaggaaaagtctcaaatcaataatcaaactcacatcttaaaagctaaatacatacattagaaa

SEQ ID NO: 12718 - DNA, 201 bp, Homo sapiens
atttaatacaaggcaggttgtaagtttaagtgagtatagttggagtaaaaatagaagaaattatatctgttcttaaattaaactccagggctgtgttttgygaaccaattaactaaaacttggagtcatcctgttaggctttgctgagcagtggagggacttgtggggaaatgtggttgcaaaggagacaggagggaagct

SEQ ID NO: 12719 - DNA, 201 bp, Homo sapiens
ataaacatatgagtgagtgccagtgtctttttaatataatgatttcttctcctttgggtagatacccagtagtgggactgttgaatcgaatggtaattctrtctttagttctttgagaaatctccatactattttccatagaggttgtattaatttacattcctacagtgtataagcattccctttcctccataccttgtt

SEQ ID NO: 12720 - DNA, 201 bp, Homo sapiens
tctattcctagcattttttgttgagttgatgatcatggtcgtataatgtctgatatctatgaagtccagtcttctgtcattgctctttttttttcatttawttttttttgagacggagtctctctctgtcgcccagcctggatgcagtggcgagatctcagctcactgcaagctccccgtcctgggttcatgccattctcc

SEQ ID NO: 12721 - DNA, 201 bp, Homo sapiens
tttctgactcttagaagccagttgccatgtaagtaatgtgactaccaaaaaatgaccacactgtgagaagcccaagtgtggtggagaggccttggggaaasagataacccatgaggcaagaaagaggcccaggaggtcccaggcatgggaatgaagaaaccagcttgcacatcctgcccaggctacaatggactgtaacca

SEQ ID NO: 12722 - DNA, 201 bp, Homo sapiens
ccacgatctgtgttaaggtttctgtggatgtgtgtgtgtgtctacttaaagaaatggcagtctatccctcttacatcctcagatattcacagagcccctcrgtgacattttttggcctaggctttttaacattctagagtagaagagttgactggtaggaacatttctaagtgctcttttgcaccataaagcaagaggagt

SEQ ID NO: 12723 - DNA, 201 bp, Homo sapiens
agctgccagatgtcaatttgaaatttaatttaattggttccttgagttttcggttccccatcatcctgctccacctttcgcttagcgtggccatcctggarttcaagatgtagttaaaaggcaagatggtgtgatggatagactgtaggttttggtggcaggcagaattggtttgaaagcctaatagctacatcatcgaag

SEQ ID NO: 12724 - DNA, 201 bp, Homo sapiens
gtacacaaagttagagttgtgagatttctctttattaattctcttttttctcttagccacatccactaaaaaaggtacttttatttcatgtcctgtatgarttgtatgtaacgtctggctctgtcaccattcctttgtgttctcattccatagctaactttccttaagaagtgttgtaatagcatatatttcagtgttcac

SEQ ID NO: 12725 - DNA, 201 bp, Homo sapiens
ttatgtgtctaattgctatagtcagatatacaaggtgacaaattctgtaagtacagttggtcctccataactgctggttctgcatctgcagattcaactawcaaaaaaattgaaaataattttaaaaaacaataaaaaaccaatataacaatagaaaataatacaaataaaaatacatataacagctatttgcatagcatg

SEQ ID NO: 12726 - DNA, 201 bp, Homo sapiens
ccagcctgggcgacagagcgagactccgtctcaaaaaaaaaaaaaaaaaaaaaaaagaattgacccatttacaatagtataggcagggtaagtctgttgtmagggaagccaataaaggatggagaagcacctttttacccattacctctcttaggcttgaagggggaaagggagtgaatatttattggaacaaagagccag

SEQ ID NO: 12727 - DNA, 201 bp, Homo sapiens
tgccccagcagacccctacatcagtgcctagaaaacaaggaaaagcagacagactcctcagtttacattttctaaagaatcattgacttatgagggattgkgtatcactttgaaaagagttatttgacctttgtgacccaggcatcccatgaaaatagggtgggttgaggaagaaggcttcatgctaccagccatcctctc

SEQ ID NO: 12728 - DNA, 201 bp, Homo sapiens
ttattcagaactcagttggttgtttatatggtattcagcaagatacttcccccccacctccaacttcttataacacaatttcaaagcaccaatcgtcttcmtcttttaaagtaacaccatgactgattgccttaaatttatatatgatcttgttctaatgtcctttctaaaaataagaaaaaaatattccacaagtaaaac

SEQ ID NO: 12729 - DNA, 201 bp, Homo sapiens
attaattcaataactatttactgatctgaacaaagtggacaaaaaaccctgtctctgtggaattttcttccaggcatgaggggcttgggaatgggtaacargtaagtaaattatgtaacttgtttgacagtgctaagtgctacaaagagaaactaggtagataaaagaaatagggacttgggaggttgaaattttataaaa

SEQ ID NO: 12730 - DNA, 201 bp, Homo sapiens
ggtgtgaagcccagatctagaccaagcctgtctgctcttggtaagcctctttctttttttcattttttctaatactgtttgatgtatttcctgttattttyatttactgttttctacttatccaatagtaacatggccatgcctatactttattactttgtaaacaagtacctaagtaacagctaaactaaaacatacatg

SEQ ID NO: 12731 - DNA, 201 bp, Homo sapiens
cagaagattgagaatttttttggagctgttcctgattagatgttagaagattttggttatcaccaatccttttcagagaaaaattttataaacttacaagkatccattgcacgtgctttacatttgttttatatcaatatgactgtaaactttatagagatctttttaatacatgaataggacatcttatttttaaggcag

SEQ ID NO: 12732 - DNA, 201 bp, Homo sapiens
aaataggtcagtggaagactgggtcaaatctgagattccactttgaccttttgatctttatctgaaagaagtcagatgatttcccttttctggtacaagcytgtaagttagcacaacattttatttccctggactatgtgaagtatatagtagatatttaggacagagagaaacctatggtggggagtaaaatttaactag

SEQ ID NO: 12733 - DNA, 201 bp, Homo sapiens
atatatatatgtatgtgtatttatgtgtgtgtatatgtacatatgttcacatacatttatgtatatgtatgtatatatgaatcataatttgctgataagckttagacactattattataaatttcccttaatacacaaatttctcaatatcttagaagaaaattttcaagtatatgagagctcttctttctatcagcatag

SEQ ID NO: 12734 - DNA, 201 bp, Homo sapiens
actattttttagacatcatgtcaaagactgaagtgaaagccaccctcttgtgatcaactgaggtcagaagttggcaaatttttttgttgggggtggggggstaaagggccagataataaatatttttggcttttcacaccagaaagatctccattgccactagtcaattctgcatttataactgagaagcaaccacagaca

SEQ ID NO: 12735 - DNA, 201 bp, Homo sapiens
atatatattcatatgtgtgtgtattatatgcatatgtgcatatacatgtgtgtaatgaaaaaagaaaacagccctgaagaatcctcaagaaactgtcagaygtccttgtcctttaaaagctccagttgcccttcttgtctaaacacatcagtgcagtgtgaatcctgcattattcatgaacacataaggtctgtatttgta

SEQ ID NO: 12736 - DNA, 201 bp, Homo sapiens
ccgaattaattattccctgagaaatggggcccctcagtgtaatatctcatctcaatcatttttttctttagttttgcagatagcacctgccatttctaaakatgtgtctttaattcatcttaaccacttcggattatgacatcctaaaattgccatatatttttatatttccatacttttgctcaggatcttctttggtta

SEQ ID NO: 12737 - DNA, 201 bp, Homo sapiens
cttgttcttaagaaagttgtcctcagtctactactctattgcctctggctggaaaaactcgggtaggtgcaaggtgtccaccagcattttctcctgggatygggctgctgccagctctggcactttgcctgggactgtagccttgtctggactcccctttccctctgcgtgggagtgcttccttatcaatcatttgccctc

SEQ ID NO: 12738 - DNA, 201 bp, Homo sapiens
gccgagtttgtgccactgtactccagcctgggcgacagaatgagactccttcgccaaaaaaaaaaaaaaaaaaagaaagaaaaaagtaatggcagtagtascaggagtagtagtagtaacagataaaacctatcattggcagcaacccaggcaagcatttatttctatatcttgctgatggggttgatggggttagcaatt

SEQ ID NO: 12739 - DNA, 201 bp, Homo sapiens
aagaatcttttagaactgttagtcaagaacttcataggtggtttatataaaatttattgtcacttgctaactgcatggctttcggcatttcttaacctttytaaacttcaatcttttcattcatggaacgtagataattattgtacctgtatgacagggtcaatgaaaggttaaatgagtgaagatacataaagtagttag

SEQ ID NO: 12740 - DNA, 201 bp, Homo sapiens
tcttgaatgcatccactcttccctaaggaaatgccatcaactcatcatccccataccatgcaaatgccttttacagctgcagagcaggtgtgggcagatgmatacagcagcatatgaacacatgtttaccctccttggccacactttgtcttactctatgttttctaggaacacattttggggtggaaatgcctttattcc

SEQ ID NO: 12741 - DNA, 201 bp, Homo sapiens
tgcttttagttcttcattgagcatgacatacttcaaatactcaaacctatttccttcttgtaggaatagctaggcatttcctcccacggtccaaggtgagrctgaagataagtagaatctccacacttatttgtttactttggtccagactatagagtcaggttaaaagccatctggggaaatagccagtagccaatgctt

SEQ ID NO: 12742 - DNA, 201 bp, Homo sapiens
ctgagtcattgaacaagcgctacaggatagcacaatactaggtacacaaagtaggcgagcacaggctccctacctttgaaaagtttataagttcattaacrgtattatgtttccatgcactggagcattagaggaaaaatgccacgataacatctaaacaagagtgcagtgggccctgagaagtatgatgattctgtttcc

SEQ ID NO: 12743 - DNA, 201 bp, Homo sapiens
tgtatggttgcagagtttgatttctttatacggtagggtggtttctgtactcctagtgacacagttaaacagagaatattttaaaatcttaggaatttaargaagcttagagataattaatccaatctcctcaccctttcattttcttgaaacagagagagcttgaggaatgggtaagtgtgacctagatgtcagctgcag

SEQ ID NO: 12744 - DNA, 201 bp, Homo sapiens
ggtctgtttcttaggtgtgtagggcagtgtatatctgagtataggtacaatttgcacaagtacatattaataggcttatactggtgtattgtgtttttatrtgtagttgccatttgtaggtgtactgaaaataatagattccagggtgacatgtatcagaattaagcagatcctctgcttcaatattagaaaagcaatgct

SEQ ID NO: 12745 - DNA, 201 bp, Homo sapiens
ataacataagccaatgactactaagtgagaatcaaacccagaatctgtgcccctaacccctactctatactgtctttcccggatacaagggtgacctccaygtttaagccttctagctacctctctacactgacctgtcataagttccagcctaccaccttgcattctctgtagcatatgtctctgtaaatgccccactaa

SEQ ID NO: 12746 - DNA, 201 bp, Homo sapiens
caacccctatcttggagaattagcagcaggatctctctcttctgagtctctggaaatcatcatcatcatcagtccagcaattcgatccattctcagtgctstgtaaagcttgcataaaagccaaaatcctgtatgtaaatcctatatgattatcctgagtgttagctcataattgctgttaggtgattatttgaagctttg

SEQ ID NO: 12747 - DNA, 201 bp, Homo sapiens
gatgctggatagacagtctggcagatagacactgctaaggttttgatccttacctgctagccatccccctccttcgtctacctcttacctttgccatttcrttctgtcaatcagaattgagtccagagattcaggtcactcactgcttcttgggccaggggccaggtgataatgtgtctctattcctaaagttggaataat

SEQ ID NO: 12748 - DNA, 201 bp, Homo sapiens
ggattgcatacatgcttctggcagaactggctttactaccattattcctgtgtggcagaagaggaccatgaacctaagaaatttgccaaaaatattttaartgacaagtggcaaagctgggattcaaacccaggctaccttactcccatgcctgttctcaaaacttctaaagcatttaaaaaaaaaaaaacaacaaaaggg

SEQ ID NO: 12749 - DNA, 201 bp, Homo sapiens
gcctggactctggagtcagactgcctaggtttaaatttcttctacttgctgagttagcataggtgggttatataatctgtctgttcttcaattttctcacstataaaatgggcgataatattaatacataatttgtagggtgttagaaggattcaatgagttaatatttgtgatatgcttaaaaaagtgcctagcacatag

SEQ ID NO: 12750 - DNA, 201 bp, Homo sapiens
ttggtgccttcttggggggtcttcctaccacccattctttttttcttccattttcttttttcctgacatatggtggtagaaatcttaaggaaataaaactragcacagcattccttgtgtgaaatactgccttgcctgtaaaatctcattaatgtagcctaggcagtggctaatagcctggactctggagtcagactgcct

SEQ ID NO: 12751 - DNA, 201 bp, Homo sapiens
caatgggccattatcagctttcaacagaacactttggtgccttcttggggggtcttcctaccacccattctttttttcttccattttcttttttcctgacrtatggtggtagaaatcttaaggaaataaaactgagcacagcattccttgtgtgaaatactgccttgcctgtaaaatctcattaatgtagcctaggcagtg

SEQ ID NO: 12752 - DNA, 201 bp, Homo sapiens
cagcacagtggcaggcgatcttgggaaggaggccaacccaaatcttcaaccatctgttaatggggtaataggttatgttgtagcatgagtgagttgtcttrattgggcagaaacttcagatatggttgccgatgcggaaggagactgagcaactgtgcatcggttgtgaatgtgcaacttgggggatggggttcatggaaa

SEQ ID NO: 12753 - DNA, 201 bp, Homo sapiens
ttttgtgtcccaccctctgcgtggtgcctactggaacactgtccctgcctgctcacccaagttgtgtggtcccctggcccaactgagctgaccagtagatrtgagtgtaggtaggaagaagtacagggacttagttatgaattctgtctagagccaggagaaggaggcaagaaggtgaagaaagagaaaggagatgtgtca

SEQ ID NO: 12754 - DNA, 201 bp, Homo sapiens
tcaggatacctgctcagagggatgtgaggacagctatgatgaataaaaagaatactgctgaccatggtgagaacagctacagaggagtgggtgaaggccaygatcaatgggttgcaagtgaacaagaagtgaagaaaatgcagagactgctccactcaagaagcagctgtggccaagaggaggccaggtggtgagaagaga

SEQ ID NO: 12755 - DNA, 201 bp, Homo sapiens
tccaattctgtgtaaactctggaattctatttaaaattgcagattttaaatgtagggaccaagacaggatgtaggttgtgtcaacttgggaatgctgaatractgaactgtcatgacatttacaatccagatgtcatggcaagctgggagacaagacagcttggttgataattagatggcagatgtccatgcagtctcacg

SEQ ID NO: 12756 - DNA, 201 bp, Homo sapiens
aaccatagatttcattaaaggagagtaaaaacccaggctttggatacagacagacttgagaaacagctctaagatttgggcaaggctggtcttgaactccygacctctctattcatcctctctatgcctcagtttcctatttgttaaatggggatgatatttagcttgcatgactgtcatatggatgagatgacagcatgt

SEQ ID NO: 12757 - DNA, 201 bp, Homo sapiens
ttggagggcagcatagaatgaaagttttagaacatctatttatatttattttaatcgtattcctttatatttttgttatagtctgtttcatagcacatttwgtgtataaatataataatacatgtctacgtgttaaaaatgaatgaaaatacctacattgggagtgggctgaatccacagaaagttttactgatggtggtt

SEQ ID NO: 12758 - DNA, 201 bp, Homo sapiens
ctgcgtgacagcatgtaatttgggcaatgcctgattgaggccaagtaaggtatctaccatattgaatatttggttttcttgaactcacccaagaaagctgratattctgtgtggaaacaggttacacccaaaaaatatacttgagggtgctgtgataaatgatggtaacttttctgtttgtacctcatttacaattttcac

SEQ ID NO: 12759 - DNA, 201 bp, Homo sapiens
caagagcatcactgtgaaacttgttagaaatgcagattctcaggcctcaccccagacttttgaattctaaactctgagggcctaagccccccaggtgattytgatacaccctaaagtgtaatgaccgctttttaagtctgtagtccaaagtctgtgacagttaggggggtaaagtacattgagtggtctaggctgagtagc

SEQ ID NO: 12760 - DNA, 201 bp, Homo sapiens
catgaaagggagtctattgccacacagtttgaaaaagccgggaggtgcctggcttgatccagagtctcaaaggacagcacagatgattctcttcatttggyaattgtcttctgggttgctagtcctctgatccctctgattttcttatagcctctagggactcaaagctttcttcttacccctccagcagtccttgcttgc

SEQ ID NO: 12761 - DNA, 201 bp, Homo sapiens
agtttccaatggttccccatacacttttggaaacagagctttgtggcatatggaaggaatttctaccccctgcgtatgagcaaacccatctggtttagttrgtttggccaggtcttagaaatacattgacaaacacgtgtatgtcaggggtaacttgtagtcttgctgcttatattgctcctggggggaataagaaattca

SEQ ID NO: 12762 - DNA, 201 bp, Homo sapiens
aggtaggctgttggaataaccaggatatgagttgctaatcgttcatttattaatcttcatggaattaaatacagaaaggatgaatacagaggagatcctgygctggacacattctctgtgttagttcatttattcgtcaccatatccccttgattaaagtgatgatgagtctttccattttgtaacttggagagactgagg

SEQ ID NO: 12763 - DNA, 201 bp, Homo sapiens
tgtttgtaaatacctacggttgatgaggaaatgcatttgttgaaatatactgaagcctgtggattattgtaataatccttttatgctatcaaagatttacygctctttgagcttaccttagttgggtcttgtaaattgagtgttatttgagaacagaacacaggagggcaccagaggacaagaaaacgacaaccaaaaaaa

SEQ ID NO: 12764 - DNA, 201 bp, Homo sapiens
ggcctgtaagtaatagaccaatgtcagtggaggagacatgtagatgttaagaatgaactaagtttgtaaggtaaaaagccaggcttcctatatgcctcagyagatggtctgataaggacgctgagagagagtatcatgaaatagaagtgaagtggattaacaagaaaatccatgttcctggcacactaaggtgataagtaa

SEQ ID NO: 12765 - DNA, 201 bp, Homo sapiens
gaagtttcatcttctttttttttttttttttctgagacagagtcttgatctttcacccaggttggattgcagtggtgtgattatagctcactgcagccttratgtcctgggctcaagagatcctcccgcctcagtctcctgagtagttgggactataggctcatgccaccacagctggttattttctttgtagagataggg

SEQ ID NO: 12766 - DNA, 201 bp, Homo sapiens
atcattcagcttcatattggaggccttcaggctttgatttatttaggaaacattggtgaacaatgggatcatgatctgcaacatgacagatgtaggaagtycatgtcccctaaaggaggttttctggagactcctaacaattaagagaatctgttctgtttctaagttgacagcaaattattgaattctgagtatccagaa

SEQ ID NO: 12767 - DNA, 201 bp, Homo sapiens
tgatgtcatcagcagcttaatagagcattagatgagaatgtctgagcattactatgctgactttgtaaaattgtaatccaaaagcaaagaatcttgacagmttagacagttggtttgatcttattattaatgaacagaagatatatcttaggctattttaaaagtgaatttataataagatttctacttcctatgttagct

SEQ ID NO: 12768 - DNA, 201 bp, Homo sapiens
gtttgcaggggtacatgtgcaggtttgttgcatagctaaatatgtgttatgggagtttgttgtcagattatttcatcacccaggtattaagcctagtaccyattagttatacagtaatttcttaatacatattataacatttgttaattgtataagttaaaaattttattactataatatttgttaattttataaattttg

SEQ ID NO: 12769 - DNA, 201 bp, Homo sapiens
tcaactggtgagtttccagctgctggtgtgcacaaacagaagctgaaggaccaatggcaggagaattacaaggcaagtttatgaatcagatggatatttgsaccagatgacacccaggggccctccaacctagaggtctggtagttctaaaaattccatgatgtcccacaagagctaactgagatgtggggataataatga

SEQ ID NO: 12770 - DNA, 201 bp, Homo sapiens
aaaaatgatgcatgatgttatctgagaaaatagtaaagtcacattatggtgtgaccacatgggagcagacaccaattacaatgctatgccccccagatctrtgtggtttttttgattctttatttctcagctttttatctgtgtgcagctgtctgttgttgttctttttcccgttttttctcagtagttttggtcccatat

SEQ ID NO: 12771 - DNA, 201 bp, Homo sapiens
aataaatgtcagtgccagtcacaggttcttctcccatagagctaaatgtttctcgggtgggcctgttaaacagtgtccttttataacattagaaagacacrtgatttttttcccctaacttttgccctatgttttggataatttttattaatttatattcagtttcatttttcttttttaccttgaatacctctttcatac

SEQ ID NO: 12772 - DNA, 201 bp, Homo sapiens
tgagatcatcctggattgtacaggtgggccctaaatccagtgaaaactatctttgtaagagacagatgaggagaagacgtagagacttgtgaaacagaagsccatgtgaagacagaggcagagattggagggatataaccagaaagaatgcccataggcagcagaaattggaagaggtaagaattggattgttgcctaaag

SEQ ID NO: 12773 - DNA, 201 bp, Homo sapiens
ttatagctcagatacattagtagaaataataacattagtaactagcatttctgaatagtagtaggtactgtgttaaccatctaacatataaaaaatacttratatgcattattttaatatttgcattgatggtttgaggtagggtattttattattctcattttccagagtttaagaaatttgaccaaattcctagcacta

SEQ ID NO: 12774 - DNA, 201 bp, Homo sapiens
gtcaaacaaccagaaaggacagtgcaaatggccctcaaagcttgagcttagcaactgctcccctgttcttagtcttgccactgtgtggaatttaggacttmtatatgcagatagtttgttacttgcaaaccattagaccaagcttgtcctacccacagcacacagggcgcatgcagcccaggacagctttgagtgtggccc

SEQ ID NO: 12775 - DNA, 201 bp, Homo sapiens
atcataaagcgtaatggtatcagttcaggagaaaggtcccactgctcctgtgttctacgtcagtggctgcagggccacagcaggcagagataaccaagcaygctttcactgccctgatcaccattcccccattaataatttgcttggccctttccttcctactgcctgaagaaaatcaatgtttggcagctctaggttgaa

SEQ ID NO: 12776 - DNA, 201 bp, Homo sapiens
acatcttcgtcttcctgtggagcatttgtcttttcatagcagaggacaatctctgtgactttcttatatcactgagaccatcttgtacagtttatttcaamagcaagagtgttctttttcgttccatgccaccagtgacaatacgaaaccagatctaactgaaacttcactcaacacattcccgacccgccaccccaaccc

SEQ ID NO: 12777 - DNA, 201 bp, Homo sapiens
tgtttcatctagtattcattccttagagagcacggatataatagtctgacaatgctttttattaatgttttcacttagctgcagattgagcatttactgtrtgctaagcactgaggatgcaagagtaagcaagaacagagatggcccttgtgggcctagtgggggacactgtcatgtaattaagtgacctccaaataaatg

SEQ ID NO: 12778 - DNA, 201 bp, Homo sapiens
atttttagaattaaaattatggcaaggaaggacctgtgtttcatctagtattcattccttagagagcacggatataatagtctgacaatgctttttattartgttttcacttagctgcagattgagcatttactgtatgctaagcactgaggatgcaagagtaagcaagaacagagatggcccttgtgggcctagtggggg

SEQ ID NO: 12779 - DNA, 201 bp, Homo sapiens
aaatgccattacgtaacttcctttgtcagaccaattggtgaaataattctttgtgtgctttttttttttttttttttacggccgtccaattttcaaattayatgtggattttctgagtcaggcattgcacaaatgctgatttgttagcttgaactcgataaatgtgtgttcaccctatcagttgtcattcatgctgacttc

SEQ ID NO: 12780 - DNA, 201 bp, Homo sapiens
tatataaatttacatataacggatgcataaagatttgctttcttattctaagaatgttcttatttgataacatctatgcatagtccagaagattgacatgraaaactgataatgtacttaggtattaccaatcctataacccaatttgtgaaaaggtcaggcactcctactaaagaacaaacgtttgtatttgtagcattt

SEQ ID NO: 12781 - DNA, 201 bp, Homo sapiens
aagtttaaaatttctgcttggaacccaggaacacagatggaacacgaagtggctttcaccagagtcttgggaatatgcttgatcctttaaccccagcttcrggtgttgtgtacatacttaatgcctgaacagttctcatctgtacatctgctggttagatgaaaagatgcagttgcagacaagtaatttaaaactttacat

SEQ ID NO: 12782 - DNA, 201 bp, Homo sapiens
tcagacacacagtgttttttattcttttgtttcttaaattcctttaaatatagccctttcataaatttggcaggatgtgctctcagtaaaatttctggttkagtaaactcttggtgacattatcaaattaaacagcaatcccttccaaattcccctaaagctaagaccttttttttttttttttttgcatgtctttttttc

SEQ ID NO: 12783 - DNA, 201 bp, Homo sapiens
ctgaactgaagagaacctgccctcatttaaaggcatccaaatgaaacattttaaaaacgctaaaataaagagaccccatgaaggtcaaacaaggcataatsagacacacagtgttttttattcttttgtttcttaaattcctttaaatatagccctttcataaatttggcaggatgtgctctcagtaaaatttctggttga

SEQ ID NO: 12784 - DNA, 201 bp, Homo sapiens
tgaaatagaccagaccagatgcaatctgcagtcatgggaactctgaactgaagagaacctgccctcatttaaaggcatccaaatgaaacattttaaaaacrctaaaataaagagaccccatgaaggtcaaacaaggcataatcagacacacagtgttttttattcttttgtttcttaaattcctttaaatatagccctttc

SEQ ID NO: 12785 - DNA, 201 bp, Homo sapiens
aaacactctgtccccaggggccagctgcataatatgaatagatgaaatagaccagaccagatgcaatctgcagtcatgggaactctgaactgaagagaacmtgccctcatttaaaggcatccaaatgaaacattttaaaaacgctaaaataaagagaccccatgaaggtcaaacaaggcataatcagacacacagtgtttt

SEQ ID NO: 12786 - DNA, 201 bp, Homo sapiens
tgcagtaaattcatatttcattgtcctttttctctttgaatccaagaagaaaaacggatgagctggagagcattcaaataacccctaggaaaaggataccytcatgagattatggaagccaaatagcaattaagatcattagtaaattcacatttgtaatctaaaatgtgggaatgaattctgaaattcagagaaaataat

SEQ ID NO: 12787 - DNA, 201 bp, Homo sapiens
acaaaatctatatttttaacaaatttgttttagaatttttatttctttattttgagactgggtaacaagactggctaacttttgtatttttggtagagacrgggtttcgccatgttggccaggctggtctcaaactcctgggctcaagtgatccatccacttcagtctcccaaagtgctgggattacaagcataagccact

SEQ ID NO: 12788 - DNA, 201 bp, Homo sapiens
agctacatatgacctaatgtccagcaggcaattgcagtccctgattatttcctatcaacttttcccagttgtctgttttgagacttactataagttaaacrtttatatgtatataatagagaacagatatcatcgaatttctgtgtatgtttaatagaattaatagctggagttgggccaggatcttatttctgtgaagac

SEQ ID NO: 12789 - DNA, 201 bp, Homo sapiens
ggataagttttctgtgccacatactaagttttgggatgtactaacatgcactcttttcttgtgtttacatcttcttgagcttgcatctctttcttagaggraaggcatgagggaggaaaataagaagaaagaaagggaaaaagggagggaaaaaagtagatttggtctttggagcttcagttaaatttcccttataatggt

SEQ ID NO: 12790 - DNA, 201 bp, Homo sapiens
aaaagatagccttgtatttctagaagttgtattttatattcacttcattgcatttgattgttctggataagttttctgtgccacatactaagttttgggakgtactaacatgcactcttttcttgtgtttacatcttcttgagcttgcatctctttcttagagggaaggcatgagggaggaaaataagaagaaagaaaggg

SEQ ID NO: 12791 - DNA, 201 bp, Homo sapiens
tgacttctggggttgagtgggcccatctgggtttctgaacttctcaatttaatagcacctgaagacattccctacctagagattttttatataaatcatasagctttatgggaacccatcctcccacatttctctgtgggaggttggtatttccttctaggcatgaatagggataaattctcaatcgaaagctgacctcct

SEQ ID NO: 12792 - DNA, 201 bp, Homo sapiens
tagtatgaccttggacatgacctttcaggaccttgatttcttcttatgtgagatgaaggattaaaatccaacagtttgttaaatcactctcaactttttakatactattaagtttaggatcccgtggagaggcctatcatccgagagaccatcctatcatcaaaaggtgaatatcaggtcaaagcaaaagaaaccacatta

SEQ ID NO: 12793 - DNA, 201 bp, Homo sapiens
aacgtgaaaatttgattcttcttcctatttttctcatgccttcctttggtctttctttctgcttggtggaaactgtggagttcagtggaagttttcctgcrgtctaattagcccctctgtttaattttgtaataaaaacgctgaaccagaagctggagataatgtgcccaattcaattcacagatgtcaatttctttttaa

SEQ ID NO: 12794 - DNA, 201 bp, Homo sapiens
ttttttttttttttttttaccctctctctgaaatatccttatcagtggacctcaaagtagcacttacaactcaggtctcttgaaccacatgctgctgcccyctatagttcttgcttttgtaaagttgtggttatttgccgattagctgccctgtgttggcatcctgactttggtatgatttgatgagctaagctattacta

SEQ ID NO: 12795 - DNA, 201 bp, Homo sapiens
tattctcaagaattgattagtcagatctctctgggaaagtagctgtagtcaggagtagaggggtagtttaaatcttgtagcccaggaaacctgccttgccyttcctgatgcttgggtcagtcttgaacaggcaaagagcactttgtggagtgaatgatggcaactggaatgaaggagactcatcatctctagccagtgtaa

SEQ ID NO: 12796 - DNA, 201 bp, Homo sapiens
tatgaaccagttgggcttcaatactttcacctcaaagtattctgttcttcacaatattataattccacagtgcatgtgcttgttgcacacgtctccaggarttgaaatacttgatattagagccagtggtccaaatgaaaatgaccagaagaggccaaatgtataatgttctcaatcccttatcaaaaatagatgggaata

SEQ ID NO: 12797 - DNA, 201 bp, Homo sapiens
ttgaggccatgttgcagttctcacaaacaaatcaatttgaattaatttgccaagtagaattaacgaggcattgtatgaattcaagacatactacaactackgcatcccctgaggttatttcttctctgggaaaattttgattcttgtaccacattttaatagtgtatatctgacctttgaatcttgcactaaatgatacat

SEQ ID NO: 12798 - DNA, 201 bp, Homo sapiens
gctgtggtcactgtccaccaagggtcaactctgagattccacacagatatgtttgccctcatttgccctcacaacctaatacccaggttgcccactccacytttccaatgtcttccaagagcactccagtttgcatcatctacagagctcaaattcacatggttgacagatacaaattcacatgcaaatgtactattattt

SEQ ID NO: 12799 - DNA, 201 bp, Homo sapiens
tgataccttcaacacagtcaaaataaacacattcatcgtaccttattttacttagtgtcatctccccagtggttccaaggtagaagtattaatctccctcrtttacagatgagtaaaccaaggttcagggaggttgagcacatttgctgtggtcactgtccaccaagggtcaactctgagattccacacagatatgtttgc

SEQ ID NO: 12800 - DNA, 201 bp, Homo sapiens
ctcaatcagtcccaattcttttgattctaaatctcaaattcttctagaacacaaagtagacattttcctctcccctgcttttcctgccacagccacacttsagcttctcaaggggaggggactgggtcattgtcatgaggtgatcatggactttgaaagatcttcaagctctacagccgtggtcttgtcagtttgggtgat

SEQ ID NO: 12801 - DNA, 201 bp, Homo sapiens
gtaaaacctgaagaatcttttagaactgttagtcaagaacttcataggtggtttatataaaatttattgtcacttgctaactgcatggctttcggcatttyttaacctttctaaacttcaatcttttcattcatggaacgtagataattattgtacctgtatgacagggtcaatgaaaggttaaatgagtgaagatacata

SEQ ID NO: 12802 - DNA, 201 bp, Homo sapiens
gccaaaagcatctgttattataaatataataattactaatcagcacccaactatgccgggcacttttgtagttacacatttgaataagatgcaaccctcartttcaaagaggtaagtgtcaatacaaagataaagatgtgaagaatagatagataccattttgtggtattgtttctacaagaaagatgtaaatacaatgga

SEQ ID NO: 12803 - DNA, 201 bp, Homo sapiens
taaatcattatgtagtgattagaggaagaggaataaagggtaatgtgagattttagaaataggtgctttgaatagataaagagatattgcaaggatagatraactcactatcgtctttgcagtatagtatcgttggtgcagaggatttgggatagaaatccagtctgggggccgagatgtgatcattatgtgcaatatcat

SEQ ID NO: 12804 - DNA, 201 bp, Homo sapiens
aaataaatattatatacttttggttctacatacttttaaatgaagatggtccatgaagtaagttatgatcaaaactaatgcaagggcttacagcctaagargaaagtccagaatttagagaatggtgacctgtcttttcttggcaactaatattatgaacatcaatttctcatcactttgtggcttcaagaaattctccca

SEQ ID NO: 12805 - DNA, 201 bp, Homo sapiens
gtggtctatctgactaccatagcttcgtagatcaaaatattgttatggtcatataaatgactataatgtgggtgttttagaattgcacttttgtttatgcrtaactggtcccaactcaaatctgcttcatcattttttagtcaaaggatagtttttcatgtcagtagtacctcaaactccgcttgtgaacttaacacccag

SEQ ID NO: 12806 - DNA, 201 bp, Homo sapiens
gaaaagaaaacaaaaacaaacaggagtcactctcagtcattttagcatatggacagaaggaacacagaatgaaatagagttggggaggggtgtgcacggtrtaagaaaaaaaaatgtgggcctaatcctttccgataacttttttttctgaaaacaactattaataaatcttatttccaagtctgtagaatattggttctc

SEQ ID NO: 12807 - DNA, 201 bp, Homo sapiens
tttttagttttgctgcatcattttttgaatttacctttctcccctcttttgcctattcattattcaaaaccagatcaaacactctttctgtgaagtcagtracttactccttcagaaatgtaggtacattgaaattggtaaacattatcacactttgtacatacttttacagtgactatgtatatgtgtgtgtttgcaaaa

SEQ ID NO: 12808 - DNA, 201 bp, Homo sapiens
ctttatcaattacccggtctcagatatgtctttattagcaccatgagaacagacaaatacactgtttatcatattcttgacagcaataaaacaattgcttwctgtcagctcttaacaatctttagtataattaagatagtctatttggattctttttcagagccttctatttttcagtcttttgaatgtactcttattgct

SEQ ID NO: 12809 - DNA, 201 bp, Homo sapiens
tatttaacaataacaacaacaaaaatcaaagtgcttgtttatcattgggactcaacttttgcagagtttttgccttaatttttttctctctaaagcagaakttcccatcactttagattcctttccgtgtcaatgatggcttttaatcccaatttccatcattacccctcagtgaaatgattgcttccatgtttgagtata

SEQ ID NO: 12810 - DNA, 201 bp, Homo sapiens
taaacacaaagtagaataagtaggccagaatatgattgtattctatcaacaatgttatatttgcttagaaatctcttatatttcttcctccaaatatgcgygcatgcacccacacacacacacacacacatacatatatacatatatgtatatctgcaattgtctaaaggtagatggtatagcataaaggttaagagtgta

SEQ ID NO: 12811 - DNA, 201 bp, Homo sapiens
aagtatgatagaattcctccttagttatacacattactgttattttgctagtaagtggctttgtatccacaatcaggacactcttatgaactgtttacatytgctattgactgatctcgttgcgtttcctcatgctttcatcaaaaggtagcagttggcagggccattcactggagaatgaggaacacgcataattagatt

SEQ ID NO: 12812 - DNA, 201 bp, Homo sapiens
tcattcctggagctgagaaaaagggtctatgttttgctttattttatttctttcatttagtttggtaggctatgtaatttgattcaagtatgatagaattyctccttagttatacacattactgttattttgctagtaagtggctttgtatccacaatcaggacactcttatgaactgtttacatctgctattgactgatc

SEQ ID NO: 12813 - DNA, 201 bp, Homo sapiens
acagcaaagccatattgtgatgttgactatatcatgcagtaatggtgaacaaatgtagcaagaagtaaaagacagagctatttaaatatatctgtgggcarttgcacaaatctgccacttttgtaggtatactgatgtttcctcattcctggagctgagaaaaagggtctatgttttgctttattttatttctttcattta

SEQ ID NO: 12814 - DNA, 201 bp, Homo sapiens
ttttttcagagatgtgtcttcaacactgaatgcaacagtgacacttgacaaatatttttcaaacacattgaaatgagtttgatcaccacctgggcattcasagtagtccagaggtcccctgcactgtgagtgtgactaaagctcaggaaagtcagaaaggccagccaaggaaggaagatgctggcaagactcggaaagtgc

SEQ ID NO: 12815 - DNA, 201 bp, Homo sapiens
ttgctgcctccttgtttgtgtctttcattaaactgtaagctccacacatgcagggactgtatttattttttcagagatgtgtcttcaacactgaatgcaasagtgacacttgacaaatatttttcaaacacattgaaatgagtttgatcaccacctgggcattcacagtagtccagaggtcccctgcactgtgagtgtgac

SEQ ID NO: 12816 - DNA, 201 bp, Homo sapiens
catgttgggccgtatctattttaaagacaagaggagctaactgcaaagttccttgtctggtaagctgtttcatctgatagttgtaatagcattttctcccrtctcactgtagggcctaaccccacaagcatccttgtgaagaaagaccccacagtcctctttttaagctttctccctccctttcctggggtgccttatcta

SEQ ID NO: 12817 - DNA, 201 bp, Homo sapiens
tcttttggggagacactatttaacccactacaaggtataaagatgagctataggcctgatgaggtaggaaagaggcagggcaaggtctcccagacactcaygtacctgacaaggtgagtctcaagagacacaagaaaaccttggaactgtaattgtgaaattgacatctatctctggaaaatgactattactcctaatgcc

SEQ ID NO: 12818 - DNA, 201 bp, Homo sapiens
gccattggattcagagcccacctagataatccaggatgatctcatctagacagcctttactaattccatcttgcaaagactcttttttcaaataatgacayattcatacattccatatcttttggggagacactatttaacccactacaaggtataaagatgagctataggcctgatgaggtaggaaagaggcagggcaag

SEQ ID NO: 12819 - DNA, 201 bp, Homo sapiens
ctccaaatgagcagaagctcaaccagctttgctgaaatgtgtttgatgagaggatggtgtgttttacttttgtgacatctttccccagaggtggttgcctraagagttgaactttagagaacaaaaagaaagaaatgtaggatccatttatggtctctcctagaatcatgccgtatgttggactctatatggaaagggagg

SEQ ID NO: 12820 - DNA, 201 bp, Homo sapiens
gaaactgtcaaaagtgtcttctagagctatttttgaggtctcttttattccttcattcctgatctgaaattcattaaggctaagagtgccccttaaattaygttctgctgtatcctggaggaacacctgaagaagttaataataaaccctagagattaggcaagtggaaagaattatgaaataaaacaaagcaaagaaatt

SEQ ID NO: 12821 - DNA, 201 bp, Homo sapiens
ctctgtggaccatgcaaataatatcattttcgatgtgttccatgatgcgaaaaagttagagaagtaccataggtctttgtatcaggcaccaatataaccamccctacactccagatcttctttccccatactcatttctccactctcctccaagtcctgcctcaaacgagttattattttcacataaaactgagaaggaac

SEQ ID NO: 12822 - DNA, 201 bp, Homo sapiens
aaatgttatgttcaggtttggcaaataccaataaggtcagagaaaaagcaatatgaatcagtattaagaaaattataagatagtgtatgtctaggtcatgwtctttagtatcatcaataaaaccactaaggatgcctcactatagctgtgagatgggttcggaccatgatatccagtttaatactatttgggagcagaagt

SEQ ID NO: 12823 - DNA, 201 bp, Homo sapiens
tagtcatgaaagtaggtaaagatttagttccagagatgtttattatagtttcttgtgaacattcttatttgaaaagaagataagtgcccaataatatcagwttgattacagtacactcaagcggttagcacagatattcatcatagctgtacttgataacagttgttactattatcatgttcttgtgtgagaggtaaaggg

SEQ ID NO: 12824 - DNA, 201 bp, Homo sapiens
tctctaagcaattcccttaccaccagctatctaatgctgtcagaggaccaactatttgctgttaacagtaatgctcatttgaagctattcagcctagattktctttgtattaggtaactgtttaataaattaattccaaacagtacctcccatctctctcagtctgaccattgagcgctcttagtcaatctttgcaaactt

SEQ ID NO: 12825 - DNA, 201 bp, Homo sapiens
gccatgcctagtcagagttctgaattcaggttctcaaagcaggaacagggagatgcagcagctgcagttgggaactcttctttctttctacattttttttktctttttgaaagtccacatctctatcaatccagaatcctaattacatatgatataaagggccctcaaaagacccattacccctgttaaagtatgtaaatt

SEQ ID NO: 12826 - DNA, 201 bp, Homo sapiens
ttcagggacagacgtcagagggaactgtataactacattagcctcacagatagtaccgacagccagacctgtcatttcctggcctgcgatgacacctctgsagcctagaatcacttaaagatatttagataggccctgttgatacgaccaagctaaccttcatcctgaaatcaattcatactcaggatgacaggaaatgag

SEQ ID NO: 12827 - DNA, 201 bp, Homo sapiens
aatcctgaaatgtgcgttctaaaaaaaaaaaaaagctccatctgagaacccattaaacctctagtttaaatacccaggcattcttaaaaatcgaatttgcmttgtctttgctgcagtgtcttctcaggtaaccaatgcagccatgtcagattgatacatcatgttgttaagacccccatctgtctctagggtagtagaaaa

SEQ ID NO: 12828 - DNA, 201 bp, Homo sapiens
caagactcaatatctggccagacttttagatgataatcacaagaagcaataacatttttctgaaacaaaacaagtggcaaatgatactgtgaaatctctgrcactggttacccaatatccacacataccccacttagctctagattagaaaataaagaatgagattcagcccagaggcagccatgcgcacaggtgcacaat

SEQ ID NO: 12829 - DNA, 201 bp, Homo sapiens
ctgcaggaggagaactgctttaatgtgaattgcattagaaagctcccctccacttttccttccccagtgtttgtctactgaatagcagggtgaaagcgtckgttgctctcatcgcctcacaatcaggccaattgggcataactgctttctggtagaattcatctcataataaattgcattcatggaagatgcctagtatgt

SEQ ID NO: 12830 - DNA, 201 bp, Homo sapiens
tgccccatgatgtgcccactgttcttttgctaatgtgttcatcctcagtgccttcattaccagtttctttcatttgacatgcaaagatcttttttcttggytcatcccagagaagtggccgggcaagtgttctcctgagaaaatgttgatgactctggcacacagaccacatacaatttgctgcttcctcacattcacact

SEQ ID NO: 12831 - DNA, 201 bp, Homo sapiens
ctgtgtagctctttagcccctgtttctattataaaaattaaaatttttaaaaggcacctgggaatctataggagagagtcagtggttaagtgagttgcctratatctggcaattaatgtttgagccagggactaaaatccagatatttttgattcctaaagtgtgattaaaatatgtctcaaccatgacatattaaactat

SEQ ID NO: 12832 - DNA, 201 bp, Homo sapiens
taaattttgaaataataaatgactataagcttttcataaagtatatacctgtattattaatgttcttatgctaacatatctggttattaaaaaatggtgcwtatgcactaataaccaatcagtatacagagagctgtcaagtcactcatctgtaagtgctaccagctggggttaataagcagaactgtgacatgtgaatat

SEQ ID NO: 12833 - DNA, 201 bp, Homo sapiens
aaaatatatattttttgtatggaggttacttcttattgaagtgtgttagatctggccaggcatgctggctcacacctataatgtcagcactttgggaggcygaggtgggaggatcacttgaactcaagagttggagaccagcctgggcaacatagtgagatgctgtctctaaaacaaaaatttttataattagccaggcat

SEQ ID NO: 12834 - DNA, 201 bp, Homo sapiens
acaattaagagatccttttgaagtgcccatgtttaagttttatttgtttggttttgtatttttttctaaatattctttcagatcaaaccaagtctaaactkgttactatttgacttaatgaaaggcctgacatgaaggaaggatgtaaataattttgagagaaaatacttttgaaatgttaaaacatttcttttgagcaat

SEQ ID NO: 12835 - DNA, 201 bp, Homo sapiens
gatgttggaaaattctatagtttgcacccgaaagcgtttgaaacattcctttgtataaacacattttcttgattgtgtggtcaatctgctggacagatccrctatgaattcagacagatctgggtttgaatcctggctctgctaccgtttaatgactttaacaatcttatttcatcatgcctccaaaaactgggagaaaat

SEQ ID NO: 12836 - DNA, 201 bp, Homo sapiens
ggtgtgcccaagataaacaagagtcacagaaatcctctgtggcttatgttctccctgaagaggttttcaggaggctcagttttatacatttccttgggggraaaatgtgtgtaggaagagttggggggtaggcagaagaatgattgctctcatattgtctttgttccatacctgagaaaataaggattattagtgtgaagt

SEQ ID NO: 12837 - DNA, 201 bp, Homo sapiens
tgaaaacccaaagttgattttttcatgctttcagtaattacattgaagttgtcccaaaggcagaagaaagaaaaagaaatcaagtctccaaaatttctctrtcctttagaaagaaactccaccttaatttttggtgaggagtaacagatctcacttgggtggtagttacattttgtgatgtgagggtgtcagctttttctc

SEQ ID NO: 12838 - DNA, 201 bp, Homo sapiens
agagattctatgtcagtcagtccaaaaaagatagaaatttagtacagaaaaccaaccaactatggaaatgaatagtaagatagtaactaaatatgtatagrtgtgtgtatatgtatgtgtctgtgtgcatatatatatatatatatatgcacacacacataggcatgaagtgccaaactatttttaaaagtatgaacttgg

SEQ ID NO: 12839 - DNA, 201 bp, Homo sapiens
gaagaagatatccagagaacattgtgaatatatacttagtttctccaacctggacagaccaggagcctttatgtcaagatcctgcacggataattcccctyaggtggagagctggtggtttttccaagcacccagccacaactgccactgcattctatttctttaatgctcaatcagtgcccctggccatttgatgatcat

SEQ ID NO: 12840 - DNA, 201 bp, Homo sapiens
catgagcatagccctgcttcatttcaacttagcctatctttatggccttcaggtctcctctcatctggaattgagttctgtagattttgtcctgtatgccyataatccactaaatagtgttcccattgttttcaaatataattcacaggggtaaagatagaaaatgtattttttagggctttttctaacaattatattttc

SEQ ID NO: 12841 - DNA, 201 bp, Homo sapiens
tcgtctcacctaggtccaggcatgagcatagccctgcttcatttcaacttagcctatctttatggccttcaggtctcctctcatctggaattgagttctgyagattttgtcctgtatgcccataatccactaaatagtgttcccattgttttcaaatataattcacaggggtaaagatagaaaatgtattttttagggctt

SEQ ID NO: 12842 - DNA, 201 bp, Homo sapiens
tccattaagaagataataatttctttttcctgacatggccttgtatttttaacttcttgctccacccatactcaaatgcaggttgatttattctcctttaygctaggtgacttccccctgtgtatactctctttcagaagtatttctttctatctccctaaaatcaaaaccaatgttcaccttaggttgtgtagaaaagtc

SEQ ID NO: 12843 - DNA, 201 bp, Homo sapiens
tgcattttatctgcagtcaactagttagaaaccagaaacaactatcttgcatctcattatcttgttattttcacctttaaaatccctttgcagaataggtrcatagtattaatttgataactaaatgaaaacaaaatggagttcatcaaagtggatttgttttgaattggcttggagttactggcagtctatgatgacata

SEQ ID NO: 12844 - DNA, 201 bp, Homo sapiens
agaactgggaggacagcgatagaatgcttttgcattttatctgcagtcaactagttagaaaccagaaacaactatcttgcatctcattatcttgttatttkcacctttaaaatccctttgcagaataggtacatagtattaatttgataactaaatgaaaacaaaatggagttcatcaaagtggatttgttttgaattggc

SEQ ID NO: 12845 - DNA, 201 bp, Homo sapiens
tgagcattttgagaagaactgggaggacagcgatagaatgcttttgcattttatctgcagtcaactagttagaaaccagaaacaactatcttgcatctcaytatcttgttattttcacctttaaaatccctttgcagaataggtacatagtattaatttgataactaaatgaaaacaaaatggagttcatcaaagtggatt

SEQ ID NO: 12846 - DNA, 201 bp, Homo sapiens
cagggcctcaaggaagtcagcctctgagaatctgagatttccagactctgataatgggaatctcacctatttgtccacttttggggtagatctagacaccrtgatgtgtcagcagcctcttagttgctgagacaattgtcccagagtgcacagactaaatctaaatccctacaatatgttttcaatgaatttatgccacac

SEQ ID NO: 12847 - DNA, 201 bp, Homo sapiens
ttctgtttttatcttacttaactgtaaggtccttgagggcaaaaacagtcaagtctttctcattcatcctttgcaaacccagcaccctgattcccaacagrgtagaactcagcacatatttgatgaattagattgaatttaaatctatatatagttataggaataaatgcttggaggattttcctatctctgtttcaattc

SEQ ID NO: 12848 - DNA, 201 bp, Homo sapiens
ttgataactgtagccataactaagggaaatatattaagctcctcttctcaataaagattagatttaattacgaaaatatcatctatttatttgccatcttkttttacaataatatatcttgtatcttcatataaaagcagttacggcagccctctgcactgtattttcatagggttctgtttttatcttacttaactgtaa

SEQ ID NO: 12849 - DNA, 201 bp, Homo sapiens
tgaattctccacatttaaagtctccacttgtcacttgaattaacatagtattttagcatttaatttcctggggataccagatgttttattttgtgagtttsttttatttatgttatagttgtggtttaaacaactatatgttcatttaaaatgaaactcaaaaaagaggaaagaatggcacaactcaataaatatgtagtt

SEQ ID NO: 12850 - DNA, 201 bp, Homo sapiens
tataactttctcaattacttaggcaaatatattcttgaaaataaaaagttagaaaagagggaaagactgagaccctcaatgttaaataacattttataatratcacatgctgagtcaaaggcaaaagcaatttctaagtcgcctacttaattctctagaccatgcctgctatcttatatttatatcttaataaatgtacat

SEQ ID NO: 12851 - DNA, 201 bp, Homo sapiens
ggattggaattttggatcactcaaatgtgatccaaaacctctggacacccttaccctttctagatatattttttccccttaaagaactcaaaggagaacaragacctggaaaaatatctgtggatatctggaagtaagcactgtactagaggttatcttgtatttgtctctagtttttatgttcgattctcagaggcaggt

SEQ ID NO: 12852 - DNA, 201 bp, Homo sapiens
ctttgggggcaggacttaatttgacccttaacatgaagtgataaaaatattttttagacttgataattgtagctcttgtttgatggctgaagtatcaagargattatgagaacagacatgaggctatgaatatgttgaaggattggaattttggatcactcaaatgtgatccaaaacctctggacacccttaccctttcta

SEQ ID NO: 12853 - DNA, 201 bp, Homo sapiens
tatgatgaaaagaatttggtttcagaattaaaaagaaagcacacatttttgagttctcgctcaaaaacaattttgtgagggtaagttatttaacttctccrtgtctcagcttcctataaaactagaattatgagatctctcttataggtttgaaataggatgaaaattcctccctctttttttttcttataacctctctca

SEQ ID NO: 12854 - DNA, 201 bp, Homo sapiens
ggatagagcagcaacacaacagtgtccctagcggaagaagtaatgtctgtgatggtaagggaaaagagggtgaaagtgagaaaagagtgagagagaggctyggacaacttaaacaactggaaggccagcaggataatggttatggtagaggtggagagaaatatgaagttggaatgggatgggatcagggacacatcatgc

SEQ ID NO: 12855 - DNA, 201 bp, Homo sapiens
taaaacacttaggagagtctctgctatgtaataagtgttcccaatatatagattttatttcatctagttgaatttagagagtagcaagccactcccttccygccccacccccgaaaaaaaaaaaaaacacaccaccaccaacaacccacttttagtgtggcaccatatctaagaaggtattctccaagacttctttatgtg

SEQ ID NO: 12856 - DNA, 201 bp, Homo sapiens
ctttaatctctctaggccttagttttctggattttgaggcttaaatgagttattaattgtaaaacacttaggagagtctctgctatgtaataagtgttccyaatatatagattttatttcatctagttgaatttagagagtagcaagccactcccttcctgccccacccccgaaaaaaaaaaaaaacacaccaccaccaac

SEQ ID NO: 12857 - DNA, 201 bp, Homo sapiens
ctctagctcagcgacttctttactgtgtgaacattgatatgtttactttaatctctctaggccttagttttctggattttgaggcttaaatgagttattamttgtaaaacacttaggagagtctctgctatgtaataagtgttcccaatatatagattttatttcatctagttgaatttagagagtagcaagccactccct

SEQ ID NO: 12858 - DNA, 201 bp, Homo sapiens
ggtatcaaaagaagtctccaattaatttgtagccagtgtaaccatatagcatctatttgcttagttttcaataataataatactggttctgattaaataargcatattgtcaaacttattatttgcaaacatattactgttgtaactggtaattgctcagatctctttcggttcctgccccgacacccaaaagtcaagagg

SEQ ID NO: 12859 - DNA, 201 bp, Homo sapiens
tcttgttccagaccaagtgcagaaatctttacagagagaaagcattgggatggggatgaggctatgctcagccagtctgggagatctctaggggaaaatgwcataggaaaaaatagtgataaatatgcttaaaagaaggcaaggaagcaagcaaggaaggaagaaataaagaaaaagagagagaggaagaaagagagaatg

SEQ ID NO: 12860 - DNA, 201 bp, Homo sapiens
tggagtttcagggaaatgagaagagcatggagaggacttttgaattaatccattgatccacgagttaccatagcctccgtgctgcatacagaaggtaccaygaaggggtatagttcttttgctcttttctcactgcctgatccattctaaatgtaactcttgttccagaccaagtgcagaaatctttacagagagaaagca

SEQ ID NO: 12861 - DNA, 201 bp, Homo sapiens
gtgttcccccgataccttgtctcaaactgtatgccctactaaaagggcctccaccttttctttacattctaaaaggtccagatcaatttttccctctaccrtgaaatttattttcccttctcctggcatattgatctttccctgtgaacactttctgtaaacttgaaaggtctataaaatggtcctttttatatagtcttt

SEQ ID NO: 12862 - DNA, 201 bp, Homo sapiens
cttaaaatgtttggggccctaacatcagtgttcaaaatcccaaaatattattctcatcagcaaaatattgctcctacacacaaggtacctcttctcctttyttcacttgctaataataatggcaagtattaatataaggtatttgttgagcaattattaaatatgtcatctctaacacaacagtccaaaaagacaggccta

SEQ ID NO: 12863 - DNA, 201 bp, Homo sapiens
tggtccaaggtagtctctaaatccaattagagaaaatgaaattcaggaagcacatcactgtagattttggtacagtgacttgagtatataattgccatctytttctatgttagctcaggggtgggttttgtgccataaaccaaccatccaaccaccagtctacccacctacccacccaactaaccatcatttgggctatat

SEQ ID NO: 12864 - DNA, 201 bp, Homo sapiens
ctgctgttgagtttttctttccttcaaacatcgaaaaatgttgtgtagaatagaaccctcctgcatgcacccacacatgtgcaaaagggttgtcatttttrtggactttgtgaaaatagcagttttaaacatttcatacctatccttaacaacattgttggcttttaccatgtacatgacaactgttttgagtggcataca

SEQ ID NO: 12865 - DNA, 201 bp, Homo sapiens
acattttaaaacttagtctcatttagtgtgagttggccaagcctggatgttttcactttatttctttattctttgtgtgaccctggtgggttgatggaggsagtgggatgaatttcagtttcactcttataaacatagctgtgcaaagctgatattctttagagctgattgtcttgtataagagtgactcccttgtatggg

SEQ ID NO: 12866 - DNA, 201 bp, Homo sapiens
tacattttaaaacttagtctcatttagtgtgagttggccaagcctggatgttttcactttatttctttattctttgtgtgaccctggtgggttgatggagrcagtgggatgaatttcagtttcactcttataaacatagctgtgcaaagctgatattctttagagctgattgtcttgtataagagtgactcccttgtatgg

SEQ ID NO: 12867 - DNA, 201 bp, Homo sapiens
gtgcagctgtctgttgttgttctttttcccgttttttctcagtagttttggtcccatatgctctttcattctcttaaggtacactgaggagaaacaagtgragaagttggcaatatagagagaaaattatgtaatacgcattcatctaattacataagcatatgtctctgtatctgtcatgtgaaggatacgatgtctgga

SEQ ID NO: 12868 - DNA, 201 bp, Homo sapiens
cctgtcctgcttccacccttcatgaataaatacaaaatgccttgccacccagaagacgaaccctttgtagtcgtgcatctcttttgaacatgcgtctttargaccctgtgttctttcatttcagtattcttgcttttgtgaggcttacgttagaaactgtgaaatatgctgttattgcaatggtaatatgttttaccctgt

SEQ ID NO: 12869 - DNA, 201 bp, Homo sapiens
aagaaatggttcattttctctgataacctcgggaatgtcatgctgtgggggctgagagatgacaggatgagtgtcaaagtgtgggaagggccgtaatacaraggaaggaatataggctttggaatttcagctgaatcatttaatgtctggtgtcatcagtaaactgtcttagccttgttcagcttacatttacttttcttt

SEQ ID NO: 12870 - DNA, 201 bp, Homo sapiens
tccttacctacatagcatgtatagcaccaagctgtaaaaagtcattttgcaaaattttccatttaaaatgtatttctcatagtaatttttaaaaacttgayaaaataggattgaggagtgtgcggtcaaacaaaatgaaatggagttctttattgccaggcttattaggagactttaataagctaatgtacattgcaaatc

SEQ ID NO: 12871 - DNA, 201 bp, Homo sapiens
ccatgtcagtgtgattccacaaaatcattctgcttgctgtacttcaaaatccatcataagaaaataatttatcttacaatatgggaaaaatataatggaawgggttggagtgaggtagggaatgcattagcttattaaagtctcctaagaaacttacaggaggtaggccacaacacttgacctctccctcacaaaaacaaa

SEQ ID NO: 12872 - DNA, 201 bp, Homo sapiens
caggttatactcttcattatcctcctagaattagattttctgtttcataattagcaatagtctcccatatcctccatgccctttacccagcctcaccctaktcctctttcagtcctgagacaggacaactcagggatgtaaacatggagaaactgtgagaacaaaccagagaggaaggatttttcagacaggctgactagg

SEQ ID NO: 12873 - DNA, 201 bp, Homo sapiens
ttgtcgagttagccctgaagtggcaaggaccctatttcagtgctcatatttaaaaagcaccaccatcagcaaaaggggtgtagagaggaggcaccatttaraatcttggaaaatctgaaaaaacttgcttctaggccagagagtagagagaactgtgagattgtgtgctagccacagtagaccaatgttggattggagatg

SEQ ID NO: 12874 - DNA, 201 bp, Homo sapiens
tgtgctttttctgttctggtcttcacgtaatccgcttcacattctttttaaattcacctttcccaagattcatcattgcttacaggacaatgtccaattcyttagcattacatgcagtccatctatctttcctaccttagctctcacttcacagctcataatccctctcctccccaatgtacacaaacacacccacctttc

SEQ ID NO: 12875 - DNA, 201 bp, Homo sapiens
atgctcaaatccctgacaaaatggcatagtatttgcatgtaacctatgcccaccctctcacatactgtaaaatcatctctagattacttgtaataaataayacaatgaaaatgctatgtacacagttgttactgtttcgagaatattgacaaggaaaaagttctgcgtgtgtttagtacagaggcaaggttttgagaatat

SEQ ID NO: 12876 - DNA, 201 bp, Homo sapiens
aagcataaagccgcagggaagtggacagaggtcttaagggttggaaaaaggagtgggcacatttgtgaaatgtagcagagctatgggatttggactttgcratgtacttgtacagtaggactaaagcagacaagcatagaatgcatgccattaattcttagccttgaggcataccttctcaataattaggagaatgaaaag

SEQ ID NO: 12877 - DNA, 201 bp, Homo sapiens
taatgagattcagtccaactggaccgagcttgtgaataaaacaagatgctccagtctgtggttcaaacattttgaacttcccagaatataattaggtataraatatagttcttatctttctttgagaactttttgaattattgttatagtttctaaaatatcttttctattttgagggtaaggtcacaaaacagaaaaaaa

SEQ ID NO: 12878 - DNA, 201 bp, Homo sapiens
taaaacagaaagaagctttttagaagggaacaaaaaacactggggcttacttcaggagggatggtagaaggagaaagaggagcagaaaaaataactattgratactagggttattaccttggtgattaactgatctgtgcaacaaatcctatgataggagttcacctatacaacagacctgcacatgtacccttaaaccga

SEQ ID NO: 12879 - DNA, 201 bp, Homo sapiens
taaagaccctatcttcaaatatggtaagcctctgtggtattggggtttagatttcaacatacgagtgtttggagggacagaattcagcccacaacacctcrttaagcctggaagagaccgtaagaatattcgattaactggataagaagcacttaaacccaatttctaagaaaagagggataaaaaggtatactgtttcca

SEQ ID NO: 12880 - DNA, 201 bp, Homo sapiens
agcaatcagttcttactgtcagttagaaaaagctatcccagttattcaagagaaacacagtatagcttgagactatatgtctccataggcctttttgtaaraagtattcagtgatataatttcccctatagcagacctacaatgaactgcttagtttcatgtcactgctgctcatattgtcctttgctaaaagctgagaat

SEQ ID NO: 12881 - DNA, 201 bp, Homo sapiens
gagtgcttgaggagaaataaaagcagaggaggaataaaaggagatgaaggaggaggaaggggaggaggagaagttataaataaagattagcccctaattckaaaacattttttcttgatctaaatatatgaacaacgaagtccaaattatttaatgtttcccattgactataggatgaaatttaatactttagcctgatgt

SEQ ID NO: 12882 - DNA, 201 bp, Homo sapiens
aaataactggaatgcttgataattatataagaaacttaaatacttggcctattcatttatcctagagttttagggaacatcttggtctagcataggcattytcaaccatcatattgaaaaaaattgtggagcattatagcacaaatgattttacaaaataaaatgattgttaaaaattagaataggttcatagtagcctca

SEQ ID NO: 12883 - DNA, 201 bp, Homo sapiens
cattaaaatatttaacagtcttatgaaagactaaagaatcattttgagttcatctactaggcatggacaagccacttcaggaagtttaatatccttctttktgcctttgggtttaatctgtgctagtgataccccagccttgacagaattgctgccccaatggcccaggctgtgggattctgcacaggaaagaccacttca

SEQ ID NO: 12884 - DNA, 201 bp, Homo sapiens
tacagacatcttctttattccagctcaacagcccaaattcttttcaccttctgtaaagaagagtgactggaagagagactaagttaattgagataattaakaagtgagtgagagaataaatgaattatagaggaggaaccaaaagcacagagctggaagtggaacaggaggttctcagcaattttaaaagtgaaggcaccg

SEQ ID NO: 12885 - DNA, 201 bp, Homo sapiens
tatttattcatatggtacatgtgcttacaagcaggaagctattgtgtatatataagtgttatgtatttacgcatatggtacatgtgcctacaagcagaaasctattaatcctttcaagaacctttacaggcattattcatttaatattgataaaaccatttcaaatgagctgataatggtttggctgtgtccccacccaaa

SEQ ID NO: 12886 - DNA, 201 bp, Homo sapiens
aagtgattttcaaacatagttgatcataagaaccttgaaggggattatttgtttaaatgtagattcttctttcttttacattgtcgtaagtaatgtaatcmatgtggaatagggctgtaaacctattttaagggcttctgagatgctaatcagtcagatttgggaactatcagggaaaattttcaacccttttcatcatga

SEQ ID NO: 12887 - DNA, 201 bp, Homo sapiens
cgtgttacccccagtttattaacattagattgtactcttttgtcctccaattatacttccatgcacgactgtccactctttatcaaacctaagcataaaawtacccagatttccctgtgtcttcgggccttcatttctgaaggctcctgtgtataagttttatataaataaatatatgcttctttatgaatgaatataaat

SEQ ID NO: 12888 - DNA, 201 bp, Homo sapiens
aacccaccaatgacagggctatattgtaaatttatgatgaatgaacacagtttagcatttttagcacttgttggggaaaataagaagtctgcattcatttycttgattagactgcaaagtagtacagagaagctcataaaaaattcttcataatgaaatagtgttcctactgatagattaacctatcatagcttccaaaat

SEQ ID NO: 12889 - DNA, 201 bp, Homo sapiens
gttgtaggttttattttgctttacaatttgacagtattttaagattctgtatttattctctttttgagctgaattatgcaggactaaacagatatcttttstaaaaccttttatttccctgacagttaggagaaatatgaagtaggaaattctttggtaattgttggaggttggtatagtgcagtagataatgtcccttta

SEQ ID NO: 12890 - DNA, 201 bp, Homo sapiens
agcactgtgtcttccaggcctctggtaaacactgttgcatacattatttgtcttagttctcaaaataatcttgagaggtttgtactattctttccatcttwcagatgcagaagttgaggcacatgaagagaattcttaggatcctaaattttcataaatgccttcaggggaatttgacaatcaatctccattaggatcaca

SEQ ID NO: 12891 - DNA, 201 bp, Homo sapiens
accttcaggtccagttaaacctgctctgctattaattagtttttggttttgaggtgatttttccaagccgtcattattagtaataagagctacaatatcaytggatgaagaagaaaaatttctgaacagaagcatagctcccaaccatatgttttccataccagcatctatacaggcaccaaaaatcatggatgttcttat

SEQ ID NO: 12892 - DNA, 201 bp, Homo sapiens
ggttccatgctgggaagggcaagctgaaaaggccagagtccaccatctttcccaaattcccacttatacaatggtagtgtcactcgggtggaagtgggccrctatttgtgcaaccaactgggctgtaatggcacagaaattctgcccagggatagatgcagagtgtcacaataagagtttccactctgcctggagtcactg

SEQ ID NO: 12893 - DNA, 201 bp, Homo sapiens
atgggtaggcatagccaagaacattgggctcacttcttttatccagcccccgtttatagggtataagctctataccaattgtggcagaccaataataatgygtgtccaattgtctcttcctcagcttgcttataaggcagaggttccatgctgggaagggcaagctgaaaaggccagagtccaccatctttcccaaattcc

SEQ ID NO: 12894 - DNA, 201 bp, Homo sapiens
agcaaggtaaaagggaatgacatggcaatacaaatgcaaagcaacagaacaataaagttaaaaaaaggaaaaaaagcttagaaaagtcaaataattcgatytagagaaaaagcaaaagaacagaaaatttcccgtgagctacattctatggctcaatttgcattattgaatgactcaagaaaaattgaattcatgtcacaa

SEQ ID NO: 12895 - DNA, 201 bp, Homo sapiens
ccagcattttacagaagaggaaatggaagcttagagcagtgggtaacttacccaggttgaaattggcagagctgaggtccaaatcagagaaattcagcatygatggtgcaatagactctaggaagtggcctcatatatggtctagtcaatagaagaagccagaaaacgcttttcagagaatgagatctagtcttgtcacct

SEQ ID NO: 12896 - DNA, 201 bp, Homo sapiens
agtcagtccccacaaacctgattagaaaggaattacctccagcattttacagaagaggaaatggaagcttagagcagtgggtaacttacccaggttgaaaytggcagagctgaggtccaaatcagagaaattcagcatcgatggtgcaatagactctaggaagtggcctcatatatggtctagtcaatagaagaagccaga

SEQ ID NO: 12897 - DNA, 201 bp, Homo sapiens
aacttcctattgcccagtagcattttttttatgctctcagtgaataatgatgataatggcagctgagatttgaatggtaacttgggtctaagtactgcatrtgatacatttagtcagtccccacaaacctgattagaaaggaattacctccagcattttacagaagaggaaatggaagcttagagcagtgggtaacttacc

SEQ ID NO: 12898 - DNA, 201 bp, Homo sapiens
gattacaggtgtgagccatgtctcccggcctgatatcctgcagttttgagatacagttttgtgtgtttgccttggagaaaaagagaatttcagttgcccaygattcatacatttttatgtggcagcttccttgaaagggaacaaacgttgaagggattcatttggcaacattattcccattttatagatgtgggtttttag

SEQ ID NO: 12899 - DNA, 201 bp, Homo sapiens
aactccgtctcaaaaaaaaatgctgtgggcccacttcaggtaacatcacatttaccacctcgtcttattcctcaaaatagtcctagattgagtgtgttaartcacatatctcaaaagcaaagctaaatttatttttgaccataggaacatcttagggtaccactagacaaggaaatcatgattttgacgagtgtcagctga

SEQ ID NO: 12900 - DNA, 201 bp, Homo sapiens
atatgtactcttatctacatatgatgtactaaatgcttagcagtggttagcttatttaatctttgcaataactacataagatatgtgctattttcattctwaatttatatctgaggaattggggttaaggataggttaagtaacttgctcaaggtcacccaagaatacgttgaggtgatctctgggtcttccactcctgag

SEQ ID NO: 12901 - DNA, 201 bp, Homo sapiens
cgccatagttatatatcactcttgtaatatccattagaatgcaaacagctttgcttgattctctcctggtgatgagagatgggaactaattctacatttaratattggggattatatgatatgtgctggagtgacccatccaattaactttgtctcacagatatggacagatgaggcttattttagaaattagccattgtt

SEQ ID NO: 12902 - DNA, 201 bp, Homo sapiens
gagtcattttcaatgcttcgccatagttatatatcactcttgtaatatccattagaatgcaaacagctttgcttgattctctcctggtgatgagagatggkaactaattctacatttaaatattggggattatatgatatgtgctggagtgacccatccaattaactttgtctcacagatatggacagatgaggcttattt

SEQ ID NO: 12903 - DNA, 201 bp, Homo sapiens
agccatgggggcggagaggaagaaatcagctgtgggtgggaatggagtgggtagaaatattgaagaaggtttctaaaaagaggtgatgcctaaactgtgcytcaagtggcgaatagtagttatccaggtagagaatccaggcaagatttatccctggaatgataaattggaggacctgctgaacttttgtcaaggctggta

SEQ ID NO: 12904 - DNA, 201 bp, Homo sapiens
ttttttttttttgatgtggcaaaaacaaaacaactcagcagctaaacagatgaaaagccaagctgtgggctaaggtatgtatttgatgaagctctctcttytctagatctttagtgggaagagttttgccacttgacacatatttaccccgcaaacctacactggcaatgctaaggcagtgagcacagaacacaggcctga

SEQ ID NO: 12905 - DNA, 201 bp, Homo sapiens
agatgagatttattcctaccaaatttattatttgagtgaaactgaacagttccattctgataagtaagggaagaaccaggcatactatgttgctattctcyacgatctgtgttaaggtttctgtggatgtgtgtgtgtgtctacttaaagaaatggcagtctatccctcttacatcctcagatattcacagagcccctcag

SEQ ID NO: 12906 - DNA, 201 bp, Homo sapiens
tggattaatattttttctttatcacttggcatgttaaacttaattatatttcttgaaagacctctaaacagttataattagaaattatgataatagctgcrgttgccttacacatgttcattttactgcttgcttctttgtgaatgtgggctgtgattaataaataaccaccaacatcattaggacaagacctctccttgc

SEQ ID NO: 12907 - DNA, 201 bp, Homo sapiens
ttttcttctcattataggaccaaaagtgcccttagagatcaagtagcccagtgatccccagactttgcttgttggtcgcgataccctgggcagcatttgamagccaggccctgcctccagtggtggttctgaatcaaaagatcagtgtagaggcttggagtggcatttgtgtggggtgtgccagaatatatttattttaat

SEQ ID NO: 12908 - DNA, 201 bp, Homo sapiens
gggcaatcttgcctggcctaaaggttggactgtaggtagcacaggacttccgggtttggagatttagaggataagtctaggcttcacccaaataccaacartaagaacttgagtagttcctgggacctccctgagcctaagtataaaatgaggacagcaacacatatctatactgccatgctgttataagaaataaatgag

SEQ ID NO: 12909 - DNA, 201 bp, Homo sapiens
acttgattactcttagtttttacatttcagctcaggtgtcaactgctccaagaagcctttctcgagctcatgctccccttcaccaaactgccacaacaacstgtgtgaatcttgatcaccaagcttacagtgctgtttgagataattatctgctcaagtttctggtgttcccattagactgtcagtgcctcatcgatgtgc

SEQ ID NO: 12910 - DNA, 201 bp, Homo sapiens
agaaattcagagttatcccaggctgggtatttgcataccacaatgagaattgctacaactaatgttgcttgatggaagggcaggagctgaaattttacctkagccaccaattttctcaaaaccttggcctgagagagaattcaagttttacccagaagtatctacattttgttttttacaaaagggctcatgatagagctc

SEQ ID NO: 12911 - DNA, 201 bp, Homo sapiens
ctgagaaaaagaagtaaatcatccatagattttggcattttgttattatcacaaagtatgctagacatacacctcataagtgattttgacaaaaagatgtkctgcaagcacagtgcttgaggggtggtcacgattatggatatcactgtactaatctcagaaatcttagtgtatgtttttttttgtctttactggatagtt

SEQ ID NO: 12912 - DNA, 201 bp, Homo sapiens
tctatgtgggtctgcttcctgaacagctggtaaacagtggagaaagccatactcaaatgaatttcctttcaatttcagtgcgtcctttcactacaaaacarcccaatcaatgtcctgggttctgttcactcagactgagaaaaagaagtaaatcatccatagattttggcattttgttattatcacaaagtatgctagaca

SEQ ID NO: 12913 - DNA, 201 bp, Homo sapiens
aaatcaacacctacaccaaaccaggctaatataagacaaaacctacttaaggtccagatttttttgtcccagcatttaaaaacagtgccagcatggactgragtaaacacgctgcaatgatttctcagcttgggaaactgtcctttcttatatgtgagatgcctacagaggaagcagaaagatagtaatttctttcccttg

SEQ ID NO: 12914 - DNA, 201 bp, Homo sapiens
gcttggaaggggagatacttagagaaaaaatgactttcagtgctatagcaaaaaggaatttaaaacatttcaaaagcccccaacctcagtacattccaaarcaggataaaataaatacaaacaaaaaatcaacacctacaccaaaccaggctaatataagacaaaacctacttaaggtccagatttttttgtcccagcatt

SEQ ID NO: 12915 - DNA, 201 bp, Homo sapiens
ctgtttcctcatgagtcaaaactgggaataaataataataaccttttagggttgttttatctctatgattaaacaaaataatagatatgacatacattatrggtctatcacatgataaacgcttaagaacagagactccttttactttccagttatccaaggtatagagtatgagaggggcaggtggctgtgcagtggtac

SEQ ID NO: 12916 - DNA, 201 bp, Homo sapiens
ctgggtccccttggacctgctgctgccggtcggctgggaagagttataaagaagaaaggacattttcaagctaagctctcctggaaactggtaggatggcrtgagctggtccacaggccccagctgccagatgatgggaattgggatcagctgtgacctaattatgagtctcgtaaacctgcattgtgcccttcattttcc

SEQ ID NO: 12917 - DNA, 201 bp, Homo sapiens
ttttccattgctttttctgtgctgtctggagaatcactttccataccattgggtcttcttttccccagttaatataccagagcctttctgctcattcattstctacatttcatgcctctctgaagtattaatacctttctctttacactggttacagatgtatatgcaaagatcaagtggatagattgtgtttgctgagaa

SEQ ID NO: 12918 - DNA, 201 bp, Homo sapiens
agccatttattatttctcatgagtattaggttggctgtacacacctgctgatatggtttgggggcataatggggctgtctctcatctttggtcagttgcasgtgggcttgttggctttgctgatgtggctgagcttcctcacatctttgaagccttgtctgagatggtttggctttgctccatgtgttttcttcacctcca

SEQ ID NO: 12919 - DNA, 201 bp, Homo sapiens
aagtttcgtgctctgctacaggtataaaaccaaaacgagtttaaacattataaacaacacaagcacaataaaattaaatgaagcagtattaatttaatagrcccatttgtaatcaatatgaaaataaatctttgtggacgatgtgaatatagtactaactgctacagcccaggttattaaagtttggcctttcccatactc

SEQ ID NO: 12920 - DNA, 201 bp, Homo sapiens
gtcattcactggttcccattcctcccctaaagccctggctgatgattttcgcacgctttacttaataacttcctccctacctggagcccggtggaatccayaaagccataagcacacaccagcctggtaggttggggcaggtgggaaggagctctgggaggctggggcatcagaacttcaccctctctggtcagagctgtg

SEQ ID NO: 12921 - DNA, 201 bp, Homo sapiens
ctccaaggacaggtcattgtgtcattcactggttcccattcctcccctaaagccctggctgatgattttcgcacgctttacttaataacttcctccctacytggagcccggtggaatccacaaagccataagcacacaccagcctggtaggttggggcaggtgggaaggagctctgggaggctggggcatcagaacttcac

SEQ ID NO: 12922 - DNA, 201 bp, Homo sapiens
atttggaataaacatgttcagccctcaagtttgatgctgtttgcagaatctcatagtttcctgattacttcaaaaggaaaatcaggctgggaggagaaaamtgtttttaaaagccccaaggaggaaaagactgagggggaaggaggagcaaaagggtcaaggggaaggtaagggcaagtctaggagttccttaggaggcag

SEQ ID NO: 12923 - DNA, 201 bp, Homo sapiens
tttattgttatataaaatgtttatgtcatagacctattattttctatcaagtatttaagttttcctcttattattttgatgagcttttaattgattaataktattgttgcttggtattataaatacatactcatggcaaacacttttctttcaattttgcctcaattttgtttatgatgttctttgaggggcagaaatact

SEQ ID NO: 12924 - DNA, 201 bp, Homo sapiens
gactaataaagaagaaaagacagaaattgccaatatcaaaaatgaaataaaggatatcgctatagacattgtagacaatgaaaggcaataaaagaatactkcaaagcaaccctacacacaaaagtttgataacttagaagaaacagatcacattctgaaaaaaaaaatctaccgcaacttggtaatataaaatagataata

SEQ ID NO: 12925 - DNA, 201 bp, Homo sapiens
agaacaggattctgtctcaaaaaaaaaaaaaaaaaatcaaatcattaaaccaaatgaaaatgtaacatattaaaatttgtgaaactcagccaaagcaatgmtgagaaagacagttatgtagctaaatacatacattagaaaagaggaaaagtctcaaatcaataatcaaactcacatcttaaaagctaaatacatacatta

SEQ ID NO: 12926 - DNA, 201 bp, Homo sapiens
gcaaacccactgttgccacatgtcccaatttttcaagaatagtaacagatctggtttttacattagatttttcaattttaaaaacactgccacagggactyccactcccaaaaaattggatagacatattggtccctgttccatccttaagtacaattaaaacccaatgacattatatataagaagactctgaaacatgag

SEQ ID NO: 12927 - DNA, 201 bp, Homo sapiens
agacatttcaggacatgattcatccactcattacatacttagtaagctcctattatgtgccaggaactgaggatacaatggtgaacaagagagacaatccytccatgctctaagggataggcaataaacaagtatatatatgtattttgttttcaggtaaatgttaagtgctgtgaagaaaaatacaatgaatgtatagaa

SEQ ID NO: 12928 - DNA, 201 bp, Homo sapiens
gatagacttactttttctaaattccctgcaattaagcctctacttagcttaaccaccttcagtgattgggagctcactctttcgctgttaaagtgtttctrtttattagaaagtctgtctttatagtaggaaaaactttgcctctttgcaaattaaccgtagggatgccatttggaacaacatggcacatatttatttcct

SEQ ID NO: 12929 - DNA, 201 bp, Homo sapiens
ttaagtaaaaatcagttagttcatacttcatggtagcaaggactccaaccttttgatagacttactttttctaaattccctgcaattaagcctctacttakcttaaccaccttcagtgattgggagctcactctttcgctgttaaagtgtttctatttattagaaagtctgtctttatagtaggaaaaactttgcctcttt

SEQ ID NO: 12930 - DNA, 201 bp, Homo sapiens
actattcttgagttgcaactgtaacatacccttaagtaaaaatcagttagttcatacttcatggtagcaaggactccaaccttttgatagacttacttttyctaaattccctgcaattaagcctctacttagcttaaccaccttcagtgattgggagctcactctttcgctgttaaagtgtttctatttattagaaagtct

SEQ ID NO: 12931 - DNA, 201 bp, Homo sapiens
tctatggtacctgcaaactacagctgttcatggagacagtgcttgtattatgtggctgtgggtgtctcctggatggaacatagatagatagtgcctattcyttcctcaatgtggtgatccaacagcaaaggaaggactgctggatgtgtaggagtgggaggaggagaaagtggtgtgatggaaatgcaaggcagaaaggga

SEQ ID NO: 12932 - DNA, 201 bp, Homo sapiens
aatccacccaatgttgcccatgcaccagccacacagaatttcccaattttactgagacacttttttttttttttgagtgctgcatactgtttcctcttgaratgtcctttggcctctgtttggtagatgcctcttcatccttccagatattgctcaaatattagttacttctttaggatactttccttgaaatagttgaag

SEQ ID NO: 12933 - DNA, 201 bp, Homo sapiens
actcattagcctggttaaaaaaaaaaaaaaaaagattaaccttatttgtctgctcaagttaaatatattaccaagaatggcaaattagggtatttgaggtycgtctttttccctggtcactgctcatttatcaccaatccagccaatgccacttactgaagatctgtcatagtcattccctcctttccagccacaatgcca

SEQ ID NO: 12934 - DNA, 201 bp, Homo sapiens
agaaaagttagcttttaaattgtatatgtatgctttttaaaatatatttacatttaaattttctttctattctattcaaagctaaagttaagaagatcagyagaggaactccaaatctgatggatttctatttttggcagctctccatgtagttaattgctcctgatgcagttacttgggaaagttgtcttttccctctga

SEQ ID NO: 12935 - DNA, 201 bp, Homo sapiens
agtaatagcgcctaccccacaaggttatgctagatttgggtaagttaatacacgtaaggtacttagaacaatgcctgcacatagtaagggttcaagaaaarttagcttttaaattgtatatgtatgctttttaaaatatatttacatttaaattttctttctattctattcaaagctaaagttaagaagatcagtagagga

SEQ ID NO: 12936 - DNA, 201 bp, Homo sapiens
tggcacttttccctcacctaaaaataacttttctcaaagtactatacccttcaccaataaagttttaggaacaggagctgcccctcaccaactccatgtcstcataaccattccttaactctttgcagcttagctcgcaacaccccagcttcctgaaagggctttcttcaaggcttctaattccctcctgattgtgaaaat

SEQ ID NO: 12937 - DNA, 201 bp, Homo sapiens
ctttacatacgctgttccctctacctagaatgcttttccttttctccttttctgagattttacggatacgtcatttatcaatctttaatacatgattggtwaggagagttgaggcattcagagaatcatataaccgtaataggaaaagggctagctccagctgcttccagcactaggcaacagttgagctccttcattcat

SEQ ID NO: 12938 - DNA, 201 bp, Homo sapiens
gtcacacttaatgctcataactcatctgtgaggtaggtggtggcattattcttgttttacggataagaacaataagactcagagtcagataacataagccratgactactaagtgagaatcaaacccagaatctgtgcccctaacccctactctatactgtctttcccggatacaagggtgacctccacgtttaagccttc

SEQ ID NO: 12939 - DNA, 201 bp, Homo sapiens
taattgaacttaatgtcagtgaaagtctttactattgtaatgtcagtggaagtctttactatttttgtgcccatttctctccctttcctggacttgtgcarttggtttatttaactaaagcttgggatcattctttgactttgttaaatccagctttggattttaaaaatccatcacaccatgatctatgtgggtgcagtg

SEQ ID NO: 12940 - DNA, 201 bp, Homo sapiens
aatctaacacactagaaaacctgaaggggcggtgtggctgaggcatgattcagagctttctagaagtttctttgggcagatacagcttctaggggaggcarggtgggggctagagaagtgctcagctgttgctatgggtatgttcattctggggcacagcttagttggtcagcacctggatttcctggggcaagggcccta

SEQ ID NO: 12941 - DNA, 201 bp, Homo sapiens
gatgttgtgatgttgtatttttatggaatttagttttggatatgctaccccagcttttaatcctttctctgaaatatggctcctgagatcccacgcagcaytggacgttgtacatacaacaatgcacattatactctaaaatacttaatgaccatcagttccttccatactttccagtggtctcagcgagcacacactgat

SEQ ID NO: 12942 - DNA, 201 bp, Homo sapiens
gctgaagagagaaagcatctgtctaaggaaagagcccaggcagtggatgtggaatttgagctctttactcatctctctctctcaccccctattcaatctgrcattgaatgggggcgggggggctcctgtggatatcagtgactgaaccttgtcctcggctggcccagctggggggtctctagcatgcaaagacactgccag

SEQ ID NO: 12943 - DNA, 201 bp, Homo sapiens
tgctgacatgagaagctgagaaccaaccatacaggtatgtatgttgagaggttagggtgacaggaggcaaggaagtcacatttccttctatccttttaggrttaagccctggtttctcttagacgggttttatgttgccatcccctactggtctcttcgtggaggtggtgtaaggtatagggcagaacagtggttctcaat

SEQ ID NO: 12944 - DNA, 201 bp, Homo sapiens
tggagaacctcccaggttcaaccgtgacttcccagggagaagcagggaggcacagaggcttaggttgccctcccttgctcaccaaatctgactgtttgggrttagatctaagagaggtggctcaaactttaacttgacaaatacttaaaatccaaattcctggacttactcacggcttagatttgggtagcaggaactgct

SEQ ID NO: 12945 - DNA, 201 bp, Homo sapiens
gccccgacaaagcaggctaagtgcccatgatcttcccccacaagggaatgtttctgggcagcagagtttttcattcatgggtttcctcaggtcactaagcrtgtgctgctttgctcattggggtcatgtgaggttggcatccagagaggcatgggggttcaggattgatgtccttgtgtaaagtggggttgtgtggaggcc

SEQ ID NO: 12946 - DNA, 201 bp, Homo sapiens
caaagcatggtggatatttgcccttagttttctagaagagaggttggttttgacttggggaactgtaagaaggaagttccagcctacaaaacaggaactastaataattttctttaaaacccttcttcaagtgacataacaaaaataatagattaacatatatatgtatcaggaagtgcattaagttgcttttattgaaat

SEQ ID NO: 12947 - DNA, 201 bp, Homo sapiens
acatatgaggacacagaggggcagagccattagaacactagaataaagcaacacagctagccagcaagtagagatagacatctaggaccacagcctggtcrgggctaccatccccctctacttctctggctggggatggggcttgttggctctttcaatacatgggcatgtcaaggctcatatctgagtccccatgccttt

SEQ ID NO: 12948 - DNA, 201 bp, Homo sapiens
taaggtaggtatcatatttctccatattacagataaggaaactggtgttttgaaagcttaactgactgtcccagggccacacaactagctccaggtgaacwggcataatgtggttcctggcttctctgaccccatgccaagctctcaatgaacccactctgctatttgattggttaatgtgcactgggcctggaacctcaa

SEQ ID NO: 12949 - DNA, 201 bp, Homo sapiens
agaatgacttgtccaccagccactgaacaaaattctcaggctttattttggttggaccaacatggatcaaatatctgtctttggaccaatcacaatgggaygctcctgtagctagaccatgggtggggactagagtggacttggggagatgcaagagagtgaacacaagcatttggactttagtctgtgtgtccttggagc

SEQ ID NO: 12950 - DNA, 201 bp, Homo sapiens
aaccattgcaaaagtatagtaaatccaggccaatccacaggtgagattgagactacagaatacattgttctttggttagaattggcttaacaacaagtcamtgacctaagctagggtaggcataagctggcgtgtcttatctcttatgcaaaattgtaagttctccgagaatagtcttccacacttggcatattacttcta

SEQ ID NO: 12951 - DNA, 201 bp, Homo sapiens
ttaacaacaagtcaatgacctaagctagggtaggcataagctggcgtgtcttatctcttatgcaaaattgtaagttctccgagaatagtcttccacacttrgcatattacttctattacacattttaaaagataattttgattatatgggttaagttaaatgtactccatgctcaacgttaattgatgaacacatatctat

SEQ ID NO: 12952 - DNA, 201 bp, Homo sapiens
gcgtgtcttatctcttatgcaaaattgtaagttctccgagaatagtcttccacacttggcatattacttctattacacattttaaaagataattttgattrtatgggttaagttaaatgtactccatgctcaacgttaattgatgaacacatatctattaagcactattgtggaaaatctatttggtgaggatacacagga

SEQ ID NO: 12953 - DNA, 201 bp, Homo sapiens
gtaagttctccgagaatagtcttccacacttggcatattacttctattacacattttaaaagataattttgattatatgggttaagttaaatgtactccakgctcaacgttaattgatgaacacatatctattaagcactattgtggaaaatctatttggtgaggatacacaggaactccaaggaagggtaagacctttat

SEQ ID NO: 12954 - DNA, 201 bp, Homo sapiens
tgtgatttatatgaaatggaagcatgttctccttcccccttatgtgctcttgttttgaattgcaaatattcagttttgcatatatttaaaagttattttgmcagtatgtaatgtagatttaaaacattctgaagttggctgttttcccttgatcaattcttcttttagaagaaacactgtaaataaaccaacaagtgtcag

SEQ ID NO: 12955 - DNA, 201 bp, Homo sapiens
tgaattgcaaatattcagttttgcatatatttaaaagttattttgacagtatgtaatgtagatttaaaacattctgaagttggctgttttcccttgatcarttcttcttttagaagaaacactgtaaataaaccaacaagtgtcagagcatacagtatagggaacagccaaggacaatctgttatgatattctgtgtatta

SEQ ID NO: 12956 - DNA, 201 bp, Homo sapiens
tgcagtggtccagacatttttactctagtataactgctgtgtgtgtgtgtgtgtgtgtgtgtgtgtgtctgttgatcagaaactttataacgaggattagmcttaaatttggcaagcttttctagataaattctagagaaaggtcccatgatgatcctagaaaatttaattaagagtaacaattaagagatccttttgaag

SEQ ID NO: 12957 - DNA, 201 bp, Homo sapiens
ttcaaaaagcactttgtcatttctcgaagtactcttagctttgtgtggctgtctggacacaagcatcagcatctccaggagaaggaggaaatcgagtgaaktgagagcatggaggggccagtatgccacttcctagggaaaggcaaaggcatttcttctcaggaaaagagcagagaatgatgctgtacctcatttggttat

SEQ ID NO: 12958 - DNA, 201 bp, Homo sapiens
gcaaagctcacagaaccagtgtcagctctgctgtgaatgctgctgttttcccatcttgttctaccactacacaacacagcagtggggaagctacagggttycttgttctctagctggccagagcccctgagcttccctgtggctggcaaaggcaagttggcttgagacaatgttttcactggttggtaggagaatgaagac

SEQ ID NO: 12959 - DNA, 201 bp, Homo sapiens
ggttgtagtgagccaagatcatgccacggcactccagcctgggtgacaagagcaaaactctgtctcaaaaaaaaaaaaaaaaaaaaaaaaaaaaaaaaaaragagagagagcaagaagagtgaaagttataaatgaaaacaataaaaaaaaatccaagaaactcaaggaacctttgatgggaaaactgggtttttctctga

SEQ ID NO: 12960 - DNA, 201 bp, Homo sapiens
gttgtctgataatggtgggactgggaattggaagaatgcagcttgtgtcagtaacatttatttatttatttatttatttatttatttatttatttatttayttacttacttacttaattacttacttacttgcttacttactgagtctcactctgttgcccaggctggagtgcagtggtgcgatcttggctcactgcaacc

SEQ ID NO: 12961 - DNA, 201 bp, Homo sapiens
ggcttattttacttaacataatatcctcaagatttgtccatgttgttacaaattaggagatttttatctttttaaaggctcaataatattggttgtgtacrtataccatgttttctttttccatttccatttatgtgtcgatgaacacttaggttgattccgtatgtttagccaaggtgaataatgctgcagtgaatgttg

SEQ ID NO: 12962 - DNA, 201 bp, Homo sapiens
gagatgggaggaagctacggttacaattcccataatacattaatgtatatttaatataccaccttgatttgtggcctcaagttaaataactacatatgttkgcagcataattcttttcataattgtgtagcctcaatgggataacatttgtattagtttccataatcgaaaatgtcaaatgcctgtttccaccttccaagt

SEQ ID NO: 12963 - DNA, 201 bp, Homo sapiens
ttcatgtcacaagaactcaaagaaaaaaaaaaaacaaattatctgaaaggaaaagggagattgtagactaaaggcaaaaaaaaaaaaaaaaaaaaaaaaarggaaagccaaaacaatgtgatcacataactaatttgaaataattagtaacaacagggggtggaaaagatatggctaaaaattgaaatattgccagaggga

SEQ ID NO: 12964 - DNA, 201 bp, Homo sapiens
atgtcctggtgggaaggtggggtttttgaatccataccaatcttatctgctgtcaggtcaactggacacacttggaaaatgcctacatcataaacctaaartctctgggacacaaaggactgttttgagcagtgacttctttagttatgtcttttttttttcttctagttttcagtgtttacagtaccgtgctctttttct

SEQ ID NO: 12965 - DNA, 201 bp, Homo sapiens
tgtcctggtgggaaggtggggtttttgaatccataccaatcttatctgctgtcaggtcaactggacacacttggaaaatgcctacatcataaacctaaaawctctgggacacaaaggactgttttgagcagtgacttctttagttatgtcttttttttttcttctagttttcagtgtttacagtaccgtgctctttttctt

SEQ ID NO: 12966 - DNA, 201 bp, Homo sapiens
atcagtagcaagatacatctttgcagatacctacatggagatttcactacatctggcagggatgagccaccggtcctcattttcttaattcctggacaagktttttgtgtattctaaccaagtattcttgcttttctttgttctgattcattcatctacaaagtgtggtcagaaaccttgaccaactgctgatatatacaa

SEQ ID NO: 12967 - DNA, 201 bp, Homo sapiens
ggtgataattgttacagagaattctttacttgttttcatcttgggctaaagagatatttgatagaaataaacattttaaagttcatatggtaaaaaattcmtacttattgctttgaaatatctaaatatctgtatgagttttcccaaattctgtaaaccttcatgacttctatattattttctaaacatgtatgtgtgaat

SEQ ID NO: 12968 - DNA, 201 bp, Homo sapiens
agataatcctaaatgtatagatttatctttaatcccaaagttaaggcagaaaatgtcagtaaaagagagagaatggttgaagagaagtgccaggcggaccraaagagtttaatggcaatctgtaagagagagatcatcaaaaaaattttaatgcccccacatgtcagtaaaagatttggagaatgccttcaaaataggtaa

SEQ ID NO: 12969 - DNA, 201 bp, Homo sapiens
ccccaaagcaatagaaaggatatttttcaactaacgatttaaataggtcaaagcaaacaggatactcacattaaaggaagaagaaactgcatgttatagamagacctatgcattcagatacctttgcctgccctgaaattccatttttcaaattcatttgcctgttagctgaggacctttttaatggaactgatgttagtg

SEQ ID NO: 12970 - DNA, 201 bp, Homo sapiens
ttctggaagggggggaaaaggctggacactggaagttcgctattaaagtgagcaacagggctgggtttattttttaaaaacaaccggactgtgcgaatgcmcttttctggagctttctggccctttctagtgaaataataatttaaaaaaaattgcttcttgagaagaggagggggcagaaattaaagggattctagattt

SEQ ID NO: 12971 - DNA, 201 bp, Homo sapiens
gaacggagggacagacgggccaacatggaagtgcatttgatgaggctgtgggaggaggctgagaccttcccagggaggacccctgcaggcattggcctccrctgcaatagtccctttcccatagctccccaccctgatctagagttgcttggctgtgtggccagatagactgggaaagcctggtttcatctctttggcttg

SEQ ID NO: 12972 - DNA, 201 bp, Homo sapiens
gcctgccgggcctggctgcatctggcagaagaagggaggacccgctcatctaccatggttgcctagggccttgggaagagtgggagagctacctatgctgygggtgggttagaaggagaagggtggggtgagccagaatgagcagaggggctccagaggcggatggctacggacaggtggcagtagttgcagaggagagaa

SEQ ID NO: 12973 - DNA, 201 bp, Homo sapiens
gtgaataccaacgccagcatataaattatccagcaggcctcagccctcgcccaaccagactcttcgctcagtggcgtgcatgcataatcaatacaggaggstgtcactgcttttagctggggtgctagaaaagaacttcggctttcagagcttggctgcatgccagcatttactccccacgcctccctccttcttgcttct

SEQ ID NO: 12974 - DNA, 201 bp, Homo sapiens
agagataaatatgattccgaagggatctttgcccatcttggaaagatacgaccaggccctgctctccacactcatcctgcggccactgccctgttggtcaytgtattggcacagctctgggtggggaaatgctctgctgggatggtttctatctggcacatgagtttgattttctttttctgttctcctccctgctcagcc

SEQ ID NO: 12975 - DNA, 201 bp, Homo sapiens
ataggaggggcttctaggagaccagagtcaaagtgcggagaccaagagtagctttctatctgaccttctgccctttgtgttgatgggggcacaggtagtgmaggagaaatctatttaggtgcccgctgccccagcccacagggcacgctgaacatgccacccaaggtaccagtggatctcaggatcactgcagttggtgtt

SEQ ID NO: 12976 - DNA, 201 bp, Homo sapiens
tgtcctcttgaaagagatctcagtggtgcacttccatggctaccctcataggggagggccaggccacccagagagcaatgaggcatttgctgaaacacagygagaggggagggagagcaaaacatatttttccagacccggggacagctatagtgaactgttgtctgtttattcgccagaaactcagtgtccaagcaagtg

SEQ ID NO: 12977 - DNA, 201 bp, Homo sapiens
ttatctgactctagtctagctcttaactgaatcccagaataccagaaccttggggcagggacaccccttgaaatgtactacaggggaatctagggcaaacratgagcaactccctttcatgcggacggtgataacctcaaggaatgtgtcccccaaatgagtatttactgatggttccctcatgctcagatgtgtgaggtt

SEQ ID NO: 12978 - DNA, 201 bp, Homo sapiens
tctgggtttaaattcagctgtgcctgcctccaaagcccatgttctctctcactagcctgaactacttttatatctttgagagaattcatgccttaacctcyctcactacatgcagtagagcctttgctgttgtattaagatagatagtgctgactatgtgagcttgccctaatggtgtggtgtctggaggggtacagttta

SEQ ID NO: 12979 - DNA, 201 bp, Homo sapiens
gcaaagaaggctgaaggataaacgctggcagcagttggaggcctgcgatatttagtgtaagggcatctctagcttttggccattttggcaatttcccagargctgcaggaatgtccaaaactaggaatgaaaaggaagggctgtaggaaagaatgtggatagaccatagagggttaagtctacataagcccacttgtgatg

SEQ ID NO: 12980 - DNA, 201 bp, Homo sapiens
accttgtgatgtgaatattctaataatgtgctgatatggctttggggatttttattatttttacatatggaaaacctgagtgcatcattaggacctggtcrtcttgtagtggctctggaagaacccacggcctccctcctgtttgaagcactaagcactgtagcaatcactagaatagcttggctcgaagtcagcattcca

SEQ ID NO: 12981 - DNA, 201 bp, Homo sapiens
gttaacacagattggggctattttttcctcgtgtagaatatataaccagtggctacattttaatgtgtctcttggctccctttggcttttctatccttaaygcaagttgcgattgctcaactgggtttcctgattcctgtggcaggagtatgtgaggaggtattctctttaggaactgtaagacgtgaaaccaagggtgga

SEQ ID NO: 12982 - DNA, 201 bp, Homo sapiens
cagaccccatcctgtataacagcacacagagaatgcttaataaatatgagctttattaggattaatattgcttttatcccattttgtcctcacgttcaccstctgatgggctgatactgccagaatggtaattgacagaaaggggaatccacagctggatgtccaggattcaggttctggctccacaggctgtgtgacttt

SEQ ID NO: 12983 - DNA, 201 bp, Homo sapiens
agatcctaagggaggtggctgcaactgggacagagctagttttcatcaggattactttttccccctgaatatttcttgagtacctgttacctactgaggaygtgtgtgaatggtagagctaggaaggtgggagtaatgtgagccagtcctcagtttttctatcataacttagaaataactaactgaacaggtacagcctag

SEQ ID NO: 12984 - DNA, 201 bp, Homo sapiens
tccagacctccatactctgattcttaggatcatctttccctttttccttatatgaactatgcatatgtattcattcctttatttgtatagcatgctgttaygtctcaaccatgtacctggcagtgtcctggttgcttctgaaaagctaaacagaaaagtccttaccaatgcactttatgatcctggtagcccatgctgcta

SEQ ID NO: 12985 - DNA, 201 bp, Homo sapiens
aaggagtcccaatgggtcatgaagtaagaccacgtgttctggctccacttccctcctcactaaggccttctcttggccctgtgtgtgcaagtgtcagaggsaaaattttatagattacaccagaataaacgtgggaaaggtcttgaatttattcttagacatttgtcagagaaaagaaggactatgcctcagatgttgtca

SEQ ID NO: 12986 - DNA, 201 bp, Homo sapiens
taaacgtgggaaaggtcttgaatttattcttagacatttgtcagagaaaagaaggactatgcctcagatgttgtcattcttttaaagctgaatgatgaagyagtaaatccataatggaaagaattgtcaagttaaatctacaaaactgagcagggtgggtaggctataacaaaaaccactctgttgaggaggccgttgggc

SEQ ID NO: 12987 - DNA, 201 bp, Homo sapiens
gtcaagttaaatctacaaaactgagcagggtgggtaggctataacaaaaaccactctgttgaggaggccgttgggcaggacatggccagaaacaagcgtgracttacctagaagtggctcacacagaggacttcagcaaccagccttggtcaggtatttcgaaagcccctgtttaagtgttgagagtatattttggccttc

SEQ ID NO: 12988 - DNA, 201 bp, Homo sapiens
taagtttagtgcccgtccgtgaggcagccttgggggatgttgatgggtgcaggaaatcggttcttaaattgttgcaaaattgccttccttcagactgtttkgatcacgagggctctcaagtgtcaaagtcatttgtagaactagatagataaaatgcatgagcactaagctttttttccaggatagaataaataagtgtgt

SEQ ID NO: 12989 - DNA, 201 bp, Homo sapiens
tttaaaacaagctgcgtttatgtataccaaatctatttgttatacgtagatttttgttgtagttcttgttttaagggatgtgacctctatcttgcatccayaacccaaaagtgattgggatcttagcttgagttgatggagtggggccaaatgcctgattcaataggattttgttttattgtgatcactgggtaaaaatat

SEQ ID NO: 12990 - DNA, 201 bp, Homo sapiens
agatcacccagccctaaattatccctgctgggattgctgggattcaagtccagggtgctcttcataaccccatcttgagctctttccagtgtctcgtgcawgctgctactttccatctgccccaaggcagcatatctaataaaaacattgaaaaactttcccaaggccaggaagggagaagtaaatgggtcaggggttaca

SEQ ID NO: 12991 - DNA, 201 bp, Homo sapiens
tttgaaaatgctttatgcctccaaggtctcataggcttcaaaacattgctggtttccccttccagatccattgcttgagtgtctgttgtgtgctgggcgtyggagattcagagaccatgttccttgataaccagcaattaccttctgaatgttacctgagtgcagatgaggaaggtctctgaaagcatacagggcgggggc

SEQ ID NO: 12992 - DNA, 201 bp, Homo sapiens
gcgctctggagtccaagacctccaatagtagtattgtgtaatgttgtagccttatttaatgtctctttgttttctgattgtctctgtcatgttgcttgccrtgatataccaccttctgtggggctgcagacaaataaatcctccctcaactctgtgctccatgtgtcactctcccaatgaaaagacttttgatggctgccc

SEQ ID NO: 12993 - DNA, 201 bp, Homo sapiens
attcggtacttcacagtttggctaacctcagctcccatcccacttgctgaaaccttggctagaaccccaccctgctaatccatgatgcttcactatcccakgtgccgtcttatctctgctcgtgcttgcccatttatcagggacatttctcccatttgtagccatatcttgaagtttaatttgagcctcacacactctgtg

SEQ ID NO: 12994 - DNA, 201 bp, Homo sapiens
gactggagggagcctgtggtcagatcctgtaggccctcccatctgtacgaatattctcatgccaaggaagtgcttccctaggccttgtgaataaagataargtgcataggtcctaaccttacctgtgacaggtacaagtgggagcccagtcccaggatcctgatggtcagatatcaggttttggggtataaatatgaacac

SEQ ID NO: 12995 - DNA, 201 bp, Homo sapiens
ataattaatccaatctcctcaccctttcattttcttgaaacagagagagcttgaggaatgggtaagtgtgacctagatgtcagctgcagtcaccttgaccstaagagatttggctaagcttgacaggagtccccacaatgtgccttatgagttaaactctgcactcccacccccattctctttcctgttctctccttctgg

SEQ ID NO: 12996 - DNA, 201 bp, Homo sapiens
gaggtctactgaggtctctgagtcatgacaaaaatgacttcagagaccgaagcactctctgcatgaaaagccctgtctccagctccatgaaatgtaaatcygggaactgctggggaaggcacaggcagtcaggtgaggctaatgggaaaagcctgagtctagagagagcatcgctaaggtaaccagaaccctaactctgaa

SEQ ID NO: 12997 - DNA, 201 bp, Homo sapiens
atttctgagatttcctctcttcttcctggttacatccaggcacctgctgggcaaaccggctgccacttgttgcaaaaaatgttgacaataccgagggaaaytgagacttgaaagaactggagggagcaaagtgctgcttttctgtagcatcaggtccctggggacaggccctgagtgttgtacctactctagctctgaagg

SEQ ID NO: 12998 - DNA, 201 bp, Homo sapiens
tctgtttttcttcttttgatagtgtacaacatttctccaggcatactgcctggggctaagatgtgtcctgtatgttatcccacggagtgttttaccaagcsactccctggatgataatagagctccaaatagagacaagacaatgtatactttctaagctgttgccacgctgaaatttccccttcattcccctacccatat

SEQ ID NO: 12999 - DNA, 201 bp, Homo sapiens
tgtcctccaacagacctgaccctgttgtgccacaaaactctctgattatttattatcttcaccaccaaactagagccccttgaggccttagtctctgtgaygttgggaacagcatttagcttggaatcaggagtccttggttgtattttgagagctgctgcaggctggctgtgtacttagtatatcagaagctcgtgattt

SEQ ID NO: 13000 - DNA, 201 bp, Homo sapiens
actaggtgtggcctgtaagtttgctcaggaagcatgggagaaactaacatcttattcttaatcttcactcttcccccatatggttcttggggatgaggaaratgttaccttggagtgtaaggctgcgtatcattctttggggccatgcttctcaaagtgtggtccccggaccaacagcatctgtatcacttgggaacctac

SEQ ID NO: 13001 - DNA, 201 bp, Homo sapiens
ctgtcctttgtggcagaccccaagtgctccagtgggcaccgaggtcatgttacaactaaatgatcatgtaaaggtggtcactgtgcagagggcacacaagmagccaatttattaaccaagagcaactttctgtaaattaaaaattgttagtgatcagttttgaagcgttgagagcctatcagggaccacatgcctggaatg

SEQ ID NO: 13002 - DNA, 201 bp, Homo sapiens
gactgtaagctccttgaagacaaaagatatgtcccatccttgctttgcattccccttcaaggactagcaagtgcttcatagacactcaatataggatagcygttgttaccagtattattcctagtcattgtcaaatgaatgaataacacaactcagggtgctactgtgtgctcagtgggtgtttcatatttgcatgcatat

SEQ ID NO: 13003 - DNA, 201 bp, Homo sapiens
tctccacttagttccatccactactccattgccagaggcaatctttgccaggaattggcatttatcacagtagtccagactttcctatgttagtctcatasttaagtgttcataaacattatatagtactcacagaaatggtttctatagttttctgcaaattgttctacatagtgttgatatgtttagctctagggcatc

SEQ ID NO: 13004 - DNA, 201 bp, Homo sapiens
tgccaaagtttccaaaacgcttaggatgaaaacaaaaccatataaggctgcctatcttgttcccttatctctccctttgagggagcacagtgagagatggragaacaagataggcaggagctggcttgtgcaataggctctaaccatattgactttttttttttttaatcaggcctcatatgaacccatttctttcagtca

SEQ ID NO: 13005 - DNA, 201 bp, Homo sapiens
cctttaaaggcagcctcagagacaggtggcgaaaaatcttaacttagttctggagaatgtttgatgagagaggagaattttacaactgtgattgcaaaggkaaaggccaattgttgacacagaaattctcacccactttgccttcatgggcttggttggccctctctcttctctgatgatcttacaagccttaaaaaatct

SEQ ID NO: 13006 - DNA, 201 bp, Homo sapiens
acccagtctccctccaagtggaaactcattcctcggggtaatcaatgtccctctcagccagaaccccgttaccagggaaaccattccaggcagccgacttygactcattgagatgcagctgcagaacccagggcctgtgtaagggcaactgctatcagagtgggcagtttttggcaactctggagtgtattgtaccaaatg

SEQ ID NO: 13007 - DNA, 201 bp, Homo sapiens
ttataaaattccctgatgaggaatctatcccagtagcagtacctttttcccaactgaaggtattactttggtctacatggagtctacatggtaaaagccarttggtcctgtggcacagagaaaagaggagttgattatctgtaaggagtaatgggttctcatatacagtctatgtaccaggaagtgcttcataaaataaac

SEQ ID NO: 13008 - DNA, 201 bp, Homo sapiens
ccaagtcagagattagataaatattcatttgcgttgtgtgatttttaaatttaactttttaatctttatgaaattgatttttgcataaagtactaaacaamattacttatatttgctttccaaagtataaacttttccagcataagtaattcatcttatccctcactgattttcaaggattcctgtattacacaagctttt

SEQ ID NO: 13009 - DNA, 201 bp, Homo sapiens
cacaggagtacagaagttgaccacacatctggattagctgagggctcaagataagaaagtctgaggtgctttgatgggaggagtaggaggtatgagctcaygaaaggcaacaatgtttactaagaaggttaattcttcaagtgtgaaggtgtatctaaaagttccttcatgaccttttttgtggcaggtgtggctatgtgc

SEQ ID NO: 13010 - DNA, 201 bp, Homo sapiens
aaaagagataggtttggcatgacacaatctgcagattcaaataaatcccctgggagaggatgaggctgctgagagtcctctttgctggctgaagctcccartgtatgcacaaaacaccctgtcccgggccccagatgtgtgcaggtttctaattgccggtgctgcactaagatttgaagggtgagagagttgcaaaatcac

SEQ ID NO: 13011 - DNA, 201 bp, Homo sapiens
ggcttgaggaatgtggtggtccctctcttcgttgtttctgccccctgaggttgtgctttctcagggatatgcactctgcacttccattcctgcagtgaaaytaactcgagcttggcaggtaagtctttcggctcacctttaaaaagaaaagatatgtgagctgcggtgggggtgggctgttccccatttgccttacattgg

SEQ ID NO: 13012 - DNA, 201 bp, Homo sapiens
ttattttaacctcttcttccactaatctcatgcttgatgctacaaacctagagtaaagtagatgaatgttctggccctgctgtgggtcccagtgaggtaamactagcaaagggcagataacagtcatgcaggggattgagtcatacatggagggttgaatgttttgccctttggaggtgataaagcagataattgggtggc

SEQ ID NO: 13013 - DNA, 201 bp, Homo sapiens
tatttgaaactgaatcaggaagatcatatttcccttccgatcctgcttaataaaatattctattattttctcagctgcaaaagtacactattatcactgawcattccctcctcatctcagagtgtttgtcactggccacagtttatatacaagctatacaggctgcctggaacttgaattggctttagagtggatgctggg

SEQ ID NO: 13014 - DNA, 201 bp, Homo sapiens
tatgctttggaaggccatttttttcctgtgtttgaaccaaattgaatttagcaggtgcaaagggctgcagaagagacttggcaattgatagaattatagcmaggattcagagggccctcaggagtcctaggcattgactctttgagccctgtgctgaaatcacctctcaagctttcctctatccaggctcttctcttgtgt

SEQ ID NO: 13015 - DNA, 201 bp, Homo sapiens
ggccctcaggagtcctaggcattgactctttgagccctgtgctgaaatcacctctcaagctttcctctatccaggctcttctcttgtgtgtgtaacaccaygccatgcccagccacacttgggaataatctcagattccgtatctttacctctctttttaattttgctgctcagcctctctgtgctgccttcacacatccc

SEQ ID NO: 13016 - DNA, 201 bp, Homo sapiens
acatctcaccactttgctgctttggttgcagcctagtgatggaatgacaagcccactccataggtgcctctgaatagcttatttcagggagctgcaagacractatttgctcagaaaattctcacgagggtgatggttttcaaagcaggaaggagagggaattcctggtacacttcccctctgcattgctggagaaatgaa

SEQ ID NO: 13017 - DNA, 201 bp, Homo sapiens
taactgtgcccatggaaataaactacactgattagcttaggccaatgggtataagaataaatgaaagtggagaaccagtaagtctctgaggaaattcagtytacgctggagaatggtagtgacatcttcaatggaagcttcttgagtgacctatgttatagctctgttagatggcgtggtccctccagggctaacagcatc

SEQ ID NO: 13018 - DNA, 201 bp, Homo sapiens
attctcacctgaaaactatgaatttcaagatcacacttaaggtccacttcaatttaaaaaatgtcctgaggatctgaataatgacaattggaaaattaaawgagcattgatagcttaagtgccaatgaactcaaggccaagatctcagttttcatgcaaactggtggctctgacttcgttccactgctatagccttggctg

SEQ ID NO: 13019 - DNA, 201 bp, Homo sapiens
tatagatataatattaggaatatttttcagccattaaaaactacgttttaggagagtatttaataatggggatattatagataaatacagatagatttagstataaaatggagactatttctttctttaaagtactttcttgatttttttaagtcagtatatccatctctctttccctagcaaatattctccagagaaaca

SEQ ID NO: 13020 - DNA, 201 bp, Homo sapiens
tccgtttattagttggctcatggaggataagcctgagcttctgagagtctggggtaaacaagtggccatgccttcctcacaggtccctggaggatcggagragtgatgtgtgctgtgcaaaggtgaaggtttctagccaaggccactgctggacttgcacttctgcctttctcctgggggtcactttttcactcttcaggg

SEQ ID NO: 13021 - DNA, 201 bp, Homo sapiens
tcacagcctgctaggagcgcttatacctcccctcctccaaccttccactgcccggtacattattttggaaatttgagcagagttgtctttggaatgacggygcctcatcaatacagaatttgtgataatctggtccttgggtgggcttgagtttatccacataatggaggtggagtggggagacagaagtatgttaattaa

SEQ ID NO: 13022 - DNA, 201 bp, Homo sapiens
gacatccccagagcaaaagcaaagtatctgggctgatgattcaggtattacctttggagggaagcaggatgagatttctagagttgctggagtttgaatcwctgggttgactcagtagataagcctaaaatctgtaggaggtacaatgcctgtgcacggtcccagtccttccaacaacaaaatgagggggtcattcccata

SEQ ID NO: 13023 - DNA, 201 bp, Homo sapiens
tcagaataatatattttctaccccttcccccacccactcttggctcctggccctacctccttcacccctcttcgatttgtaccacagttcgtggcattttytgaacctcagggctcctgtctggctagttatttatttagctgaggaactgcagcacctaattaataggaaattagctgtgagtgtaacatttggcccgta

SEQ ID NO: 13024 - DNA, 201 bp, Homo sapiens
cccccacccactcttggctcctggccctacctccttcacccctcttcgatttgtaccacagttcgtggcattttctgaacctcagggctcctgtctggctrgttatttatttagctgaggaactgcagcacctaattaataggaaattagctgtgagtgtaacatttggcccgtagtcaaggcccaagaagttataaatac

SEQ ID NO: 13025 - DNA, 201 bp, Homo sapiens
tcagggacccaccttaggaccctcatagcgagtggtcctccagctcagcccatgtgcatccagctgaaaggctttcatacctctgccctgcataggtcttkttcagagaagtgggtgcactgtggcagaaacaattctctactaacccatttggaacaataaagaaataaatcctaatccaccaaccttgaccagacagct

SEQ ID NO: 13026 - DNA, 201 bp, Homo sapiens
tgtgtatttcccctaggtgtggttccctctttattaccagagggtacataggagattctgcattcatttagtcattcattcaaataatgtttatggatttmattttctttaggtccagggaacttgataggcactaagggaaactaaggtgaattactgtcatcgcttgacctcaagaagcttaaatctaatgggaaggga

SEQ ID NO: 13027 - DNA, 201 bp, Homo sapiens
gcactcaggttttttttttttttgacatgtctcagctcctttctccaccatgtgtgcctgcagtactgtctccttttatctaaaggtgttttgcaacttgwccccttgctgcctgccaaggtttacctctgagaagtatcaagctgttcagcattggctagaacaagctcttctgaccctgtcgacccaacagtgaaaaag

SEQ ID NO: 13028 - DNA, 201 bp, Homo sapiens
agatgtggggtgtggtgatggggctcattagtacagtgacagagtggacagggagggagggacagattctttggatgttttatagtaaaattgacaggatrtggtagattactagaaactgaggagaaggaaaattaattgagaatcaaaaataatcctcaggtttctatgacacctgagtgggtaatgatattattaacc

SEQ ID NO: 13029 - DNA, 201 bp, Homo sapiens
gagggacagattctttggatgttttatagtaaaattgacaggatatggtagattactagaaactgaggagaaggaaaattaattgagaatcaaaaataatyctcaggtttctatgacacctgagtgggtaatgatattattaaccaagatggacaaggaattttggagattcagataaacttgaggacttctttggacatc

SEQ ID NO: 13030 - DNA, 201 bp, Homo sapiens
atagtaaaattgacaggatatggtagattactagaaactgaggagaaggaaaattaattgagaatcaaaaataatcctcaggtttctatgacacctgagtrggtaatgatattattaaccaagatggacaaggaattttggagattcagataaacttgaggacttctttggacatccaggtggagagaatcattaagcagc

SEQ ID NO: 13031 - DNA, 201 bp, Homo sapiens
tagctgtacgacactgccccaagctcttagcctctacacacctggcacctcggggtctaagcctactgggtctgaccctattgagagcactcgggtgctgyccatgccagaagagaaggtcaccaaagcctagcccctgagggacaataacactcgagggctaagaacaggagctagtgaaagaggcataggaaaagtaga

SEQ ID NO: 13032 - DNA, 201 bp, Homo sapiens
gcaagaatttgtaattggaattcttgcaagtgtaaatctaggttgtctgtttaaaacaagggcattggtgaagaacaaggataaacgtggtaatgtctacwgcacattgagcatctgcacctgtgtgccaggcattgtttagcgctctttgggaattgtcttttttattcctgaaaggcaaatgtaattggcatacccatt

SEQ ID NO: 13033 - DNA, 201 bp, Homo sapiens
aggaccctcagggaagctgcccacccctggcacatgagtcacccacagtcccagcacaatcctgccctgcaggccccatcaccttcttccctgaggaatgrccaagatgcaggcatcagctgatgatgatgatgattactgttattgcagctattatttttataaatactcccttccttgagatgcaaaaaaaaaaaaatg

SEQ ID NO: 13034 - DNA, 201 bp, Homo sapiens
ttcctagatccagggttaaagaggtgaaatcaactatgttcgtcctgtaggctccctggggccgaggctgcttttattagagcaaatcaggcctgtccagragctgtgctatgggggaggagagagccaggaggaggtgaggaggggttggggtggggtgtgctgcagggattgctgtctgcacctgggctgcccaaactg

SEQ ID NO: 13035 - DNA, 201 bp, Homo sapiens
ccccatgttctctgttctacagtgccttgagcacagctttattatcttaaagcatttaccaagttctagtgtctttgggcagcaagtccctcaacagactrtgagctccatgatgggaaagaccaactattgttcactgtgatagttgaaaaaatgaatgcatccaaatgcttttggattccagtttctctagagatgtct

SEQ ID NO: 13036 - DNA, 201 bp, Homo sapiens
agtgtctaggccaggacctggcacaaagtaagaacttagtagacattaattgatgttgttgctactgtgttcacatttgatagtttaagggtcttcatgayattctgcaatgtaaaaggagaaaacaaacttggttagttggagatagtccatcatttgtagagcaggataaatattgctgatcattaaatcatctcagac

SEQ ID NO: 13037 - DNA, 201 bp, Homo sapiens
tgcatagtatgattatgctgcaattgcctctcattcttttaatcatacattttgactgtatcgttttaatttacggaggcaccctaaggcctaataacatmtaatgcagcatgcaggaaatcaaacaaacagataaatgcactggaggaagaaagaaataacttttttaatatgttgtttgcaagtggctgtatggctgta

SEQ ID NO: 13038 - DNA, 201 bp, Homo sapiens
cttttttagcttggtattccttgtccttcacagaatagttgcaatctccctttttgagttaatcatgcttgctatggcctgagatttgaaaatggagtctktgggtttaagttcttcttttcctagttatagaaacttcataaagcaagtgaggctcttatagcctacctttcttcatctgtgaaatgggctcagtagtca

SEQ ID NO: 13039 - DNA, 201 bp, Homo sapiens
cagagcaattgcccaatacctgttttaattggaatgcaggatgaatattacacagcactcatggccttaggcttttgtaaaaatacaagcgttgctggagraggtgactcaataggtcatgggtacttgcatatgcattaagaacattgggtttgggtagccaaatgaaggtggaaaatctggaaagaacaagttgaataa

SEQ ID NO: 13040 - DNA, 201 bp, Homo sapiens
gcctgcattccactcagcttctttatgatgtataaagatgaaactgaccccagtcttcagcctgaagagtgccttccattgggcttccacatttgggaagrttcccgctgagatgggacagaagtgtctcagcagtctctcagttcctgcgtaagttcagaaccaactcaaatcatgctctctgcagtggaatctccccac

SEQ ID NO: 13041 - DNA, 201 bp, Homo sapiens
atgtataaagatgaaactgaccccagtcttcagcctgaagagtgccttccattgggcttccacatttgggaaggttcccgctgagatgggacagaagtgtstcagcagtctctcagttcctgcgtaagttcagaaccaactcaaatcatgctctctgcagtggaatctccccaccctgggcgcggagagagtgagcactcg

SEQ ID NO: 13042 - DNA, 201 bp, Homo sapiens
agagtgccttccattgggcttccacatttgggaaggttcccgctgagatgggacagaagtgtctcagcagtctctcagttcctgcgtaagttcagaaccawctcaaatcatgctctctgcagtggaatctccccaccctgggcgcggagagagtgagcactcggtgcctttttggataaaccaggtaaagaagaaaacaaa

SEQ ID NO: 13043 - DNA, 201 bp, Homo sapiens
tgttttcatttttctgtttctatgttttcaaaattttcttcagtgagatttttaacttttataatggaaaataaacattacaaagtggaaaaaaatgtttygtgccacaggtttgggatgtgtttgtgcagctgtgtgcatgggagtggctgttgccacattgtgttaaatgggatggaggctgggtagggcaggaactgt

SEQ ID NO: 13044 - DNA, 201 bp, Homo sapiens
gtagggcaggaactgtgctccagtcttctccaaggacaggtcattgtgtcattcactggttcccattcctcccctaaagccctggctgatgattttcgcaygctttacttaataacttcctccctacctggagcccggtggaatccacaaagccataagcacacaccagcctggtaggttggggcaggtgggaaggagctc

SEQ ID NO: 13045 - DNA, 201 bp, Homo sapiens
actctggccattcttcagaccagccttatttgcaggcgttagaatgggattatgtgctagatcaagtggacatttttctcaaaactcacctagtgttgtcyttttcacatttccccatgaaatttagaaaataatagaatcttatcaaatatggactacatcctcaggagaagacttccagacagttctggagaaggcatc

SEQ ID NO: 13046 - DNA, 201 bp, Homo sapiens
agccttgttggagcagttgaataaggcttattaataggtttacttagctctctgtgccttagttttctcatatgttaaatggagctattaatggaaacacrggtatgtaaagggttttctgctttaatgacataagcattttgggagggacttcttgcaacactatttttgacttcacacttttaaaaacctatcactaac

SEQ ID NO: 13047 - DNA, 201 bp, Homo sapiens
agattctatccctgttgggtcaataattagttggtatgtgactaatgtattgggaagatgcccggtggtctatgatattgggattttttttttctttttgrttctttgggcctctgaagataattcagcagtttaccagaggagtacccattctgcctgctccttccctctctaacttcctttctccctccctccacaaat

SEQ ID NO: 13048 - DNA, 201 bp, Homo sapiens
ttccctctctaacttcctttctccctccctccacaaatatttatttgtaccttgtttgtaactgaagataagcacctctgaaatcaggcctgttggcatawgtctaaatactctttaactgagagacatatattcaaagaaacgtttttatatgtccataaactgacacatagattgtcaaatccctaataacaaggttca

SEQ ID NO: 13049 - DNA, 201 bp, Homo sapiens
acgtatgtgtgaagaattggaggcacttttgcaatcaatccagtagagcagttaagaacattgaaatctattaggaagtgacatagatcttcttggtgagmgggatcctgccttaggaaagaatgaatgtgtgaggtgctctgccagtctttggtgtgggagtgagggagagggaagagtcaaagatggctttgaggaacc

SEQ ID NO: 13050 - DNA, 201 bp, Homo sapiens
aatcctgcatcaagtagagatggtgggaaatcgccctgaaaagctctatagtgtataaaatgtcatgatgctattgaaacccctgttgtcccattcaaacygagctttctttacagtagcacctgaaaaatacaacttccaccatttcctttgagaaggtaaattcagtctgagatctcagtatttgttttccttgattgg

SEQ ID NO: 13051 - DNA, 201 bp, Homo sapiens
gaggagaagttggggcaatttcttttctcggtgggagaggctttgctccataatcctcgtcagtaatcaagagatacacctttccttaaagagtttccaamaatgttctgcatgaggaatcaccatttcatgtcagtcttgtatatcagtggggctggttggttaatacatatggattgtattgtgttcatctgacattaa

SEQ ID NO: 13052 - DNA, 201 bp, Homo sapiens
cattggtctaggcatacttgtataattctgtagatcagctacccccctagaaagtactaaggtaaatttatgcacagagagggtgaaacaatgcaaagggwcactctattgctagttggggcttaggcccctcaaatactgaacaggattttggtgaactgggctgcaccacaaagagaagctgggtggacttgaaccaac

SEQ ID NO: 13053 - DNA, 201 bp, Homo sapiens
aagactcactggaggcctgcttggagcctggctactgtatgaagacatattaaacgtatgtccatctgtaatattagtggtcctctgaaaaaccagcttasaggactaattatcattcatctgataagaagagagagtaagagatagggaatggtgtaattaactttctggttatttgtagttttagaaaaaagagccacc

SEQ ID NO: 13054 - DNA, 201 bp, Homo sapiens
tcacccaaattctcttctatgtctctgggaagggaagcaattctttttgcaggtcttcactattgtctttttcttttttccattgctttttctgtgctgtstggagaatcactttccataccattgggtcttcttttccccagttaatataccagagcctttctgctcattcattctctacatttcatgcctctctgaagt

SEQ ID NO: 13055 - DNA, 201 bp, Homo sapiens
ttcactcaagaatcctctcccaggcagaaagaaggaaagaaagtcttgctagaggagaaatcttattaaggctcatggtgattcaggagtgacagccgggkctttttcaatggacttatctgctgtcacagagacccactatcctggaagagcccaggcaaagtctgagggttttgaccatcaaaatgaatgactgcaata

SEQ ID NO: 13056 - DNA, 201 bp, Homo sapiens
ctctcccaggcagaaagaaggaaagaaagtcttgctagaggagaaatcttattaaggctcatggtgattcaggagtgacagccggggctttttcaatggayttatctgctgtcacagagacccactatcctggaagagcccaggcaaagtctgagggttttgaccatcaaaatgaatgactgcaatatgttttgaattgca

SEQ ID NO: 13057 - DNA, 201 bp, Homo sapiens
ttatatcagctgactactatatcttttctcaaactccaaagcccacatagctgatatactcttgtcaactgatattgtttccatgttacagatcaggaaayggaggctattcaaagttactgtatatgcgttgtctaagtgctatttgtatacttgtttatcactcctttgatctgccccattgaggtagacaatgattct

SEQ ID NO: 13058 - DNA, 201 bp, Homo sapiens
tagtacttgtctcatgtacttcaacaaggactttagactaaactgatttgattggttatatttttagacttgttacttctgttttgacagaaagaatagamaatacgactacaagcatagtgaccttctggatttgttcctgtggataatcttaagataatttgaaggaagtttcttaactttttaaaggcacaggtgtca

SEQ ID NO: 13059 - DNA, 201 bp, Homo sapiens
cttgtctcatgtacttcaacaaggactttagactaaactgatttgattggttatatttttagacttgttacttctgttttgacagaaagaatagacaataygactacaagcatagtgaccttctggatttgttcctgtggataatcttaagataatttgaaggaagtttcttaactttttaaaggcacaggtgtcagaagt

SEQ ID NO: 13060 - DNA, 201 bp, Homo sapiens
ccactagattgtttttttaaatttttgagcatgctctgttttattttctgattatgaagggcatttctagtagtcctgggaagagtgagctcacaaaaagrcagctagagaactagtgatcatgactattatcacatcaagactttggcttaagcaaaacagaacaacaaaaccccaaaaaaccccacaaaactgggaagt

SEQ ID NO: 13061 - DNA, 201 bp, Homo sapiens
ctctacttttctgtaagggccccaggctgtatgtcttttatatcgtcttcagatgactacaataaacacacactaattgggcacttcctgtgtccaagcaytgtagaataaacagagagaaataaagcaatctccattttcaagttttctcctttaagggtgtggagtagtgcttgacatgtagtaaatgctcaacaaatt

SEQ ID NO: 13062 - DNA, 201 bp, Homo sapiens
tttctgtgtggaatctggttgatatttttggagaataatttaaatcagttctaattccaccctgaagagctccttttgacacacaagtggctttgtgtcaktgcaactctggaggaggccagggcaggcttcctgggtgctcagaacactggctgcccttggaattatggctttatctctgggggatagtacttcaagaaa

SEQ ID NO: 13063 - DNA, 201 bp, Homo sapiens
aagctaagctctcctggaaactggtaggatggcgtgagctggtccacaggccccagctgccagatgatgggaattgggatcagctgtgacctaattatgartctcgtaaacctgcattgtgcccttcattttccagctcattgaccactcagagggggagggaaaagggatgagattctggtcaagtccttcctgccacta

SEQ ID NO: 13064 - DNA, 201 bp, Homo sapiens
agacagagaacactcaccaggggaatcaatggaggagggaagtgaagaatgtaactgtgcaggaagagtatgctagggatagagggatgctcatcttcgamctggtaatcaatggaatccagactgacctattacaagagtggggtccctatgctctttacatagtctcccttgtcagtttcctgaaatttattgtgccaa

SEQ ID NO: 13065 - DNA, 201 bp, Homo sapiens
acatccatgcttgcagtataaaattctaggtctgtgtccctgaaaagaatgttggtgtgagctaatgtgaaagatttggggagaatttgtgtaaaaagtarcaacaaacaccaaatgcctagttgagttctctgatgggtaaggtagaatatttgagagatttttttgagaatatttcccactgaaacttgggaaataact

SEQ ID NO: 13066 - DNA, 201 bp, Homo sapiens
aaatgccttccttattttcttcttaaaaagattatcatttgcttattttcttcctcctctgtgaagtaaaactttatcaagaagaattaaacatttaaaaragatgtgcagtaattggtagggaaggataacgagaagaaaagcagacaactgtctgctgcttagcatatccatgagtgtgttaatttaattagaactgcc

SEQ ID NO: 13067 - DNA, 201 bp, Homo sapiens
aataacctagtataaatcctggcacatttttctctatacacatataatttatacatatagaaatgtatacaagtttttcaggtcattgttttataaaatgsgatattatatacttattttgcatcttgattttctttttagaagaacactattgtgcatcatagaataaatacaaaaaagtttaaaacatatttaggtact

SEQ ID NO: 13068 - DNA, 201 bp, Homo sapiens
ccaaaacaggcttcgtggggaccaaattggcttttggatctcaagtgtgtctctgagtcactccagtgaacacgttataggtcactctgtgcaggttagtrgcccgaaaatctgcccttcaaaggaaaagaaaagtgaaattctcatgacttttacactttttgtcaaatcttctgcatagagaccttctgagttggctct

SEQ ID NO: 13069 - DNA, 201 bp, Homo sapiens
taataaatggaaaaattgagtcatgtaatggattagagactttcccaaggtttacaactacagaggaatagaattggctctagagctaagtcttctcattmtagtttaattgtttgtttatttgtttctatgcaaacatgttcatactcttccttagcatgtttcatcctatctctactagtgcaacaagatgctgagaag

SEQ ID NO: 13070 - DNA, 201 bp, Homo sapiens
atatacccttgtaagatatgtaacatgcttttcttgttatttatttaaaatttattttactggcagcatgctgtatatcttaatgcatttttttacctttkccattcaacactgtttataagatctttcatgttgctatgttttcatttagttggttttctgtaactgctgcatagcatttctctgtatgcatccaccaca

SEQ ID NO: 13071 - DNA, 201 bp, Homo sapiens
attcacgcaacacaaagtgcacgcacatattggtcttgaaattccccaaggaccaaaatggacccatgtgatgagtctgtgttataacagggaatctaccrtaggttcttggctaccttttgtgaaccttctgtcttctttcctctcacttacaagtaatcccctgagtttttacctcctgaaccctgtgatttcaagggt

SEQ ID NO: 13072 - DNA, 201 bp, Homo sapiens
tcttaattcagcccatgagcacatggtagattatgaatggatgctttaggaaccatgtagatggaggtttgtgaaaatttccacggaacatggcagttgaraattggtgactgatatggtctagctctgtgtccctacccaaatctcaccttgaattgtaataatccccatgtatcaagggtgagactaggtggagacaat

SEQ ID NO: 13073 - DNA, 201 bp, Homo sapiens
acagggtagtctcaaggtgtgattaagacacttgggagtggtggtggttaaaaaaaaaaaaaaaatagagccaaagtgtaaggaggcaagctggaggcacrtggttatatgaggagaaaaattgcagtgaggccttctcatcaccctcttcagggtcaatgtgatggcttcgtagaatcaagtgcaagtctgtggctccat

SEQ ID NO: 13074 - DNA, 201 bp, Homo sapiens
gagatgtgaacaaccctaggatctaggcttggctctgccactaagtgactatgtagaactaggcaaatctcttggcctctctgggccatgagatgcaacaytataaatcagtacgataatactcgcttctccttccttatagcagtagagcaagaatccaaataaatagtacaagtgagaactcaacacaatctacatctg

SEQ ID NO: 13075 - DNA, 201 bp, Homo sapiens
ataaatcagctttgcaaagtgggggctgaagcttttctactaactgaaccatcttttcttttttattcttgttactttttaaggagatgatggcaagtgayttctttttaacccattttaagggcccagttcatcttgtacaattcttgtgcaaagtctctactgagactttggcctgatgcaaaagaagaggcccttaga

SEQ ID NO: 13076 - DNA, 201 bp, Homo sapiens
gaggctgaggtctgatgtcgtcgtcatcggcagagcgaccttgctcctcatttgtgcgcacaggcactgaatggagggagccttgaatcatctgattttgytcctcattagtatttctccactgtgttctctgaccacactttcctcctcggtgcatgcaaagctattagcaatgcacacacgcggcacatctgtggagcc

SEQ ID NO: 13077 - DNA, 201 bp, Homo sapiens
ggctaaggtttgcagaggagcaaggcagtctggggtatgtgccatctctgggacgcggggtctttgcagaatgtgttattgtggtgtagtctttaagtgarttctcagataaactggaaggtgggtctaggtggagattatttcaagaaggttagaactctggtctctggttacaataaaaaagctggattgctgaagatc

SEQ ID NO: 13078 - DNA, 201 bp, Homo sapiens
agagagggagtgccaattgggaggacaggtgaccgaggggggcagagggacacattcatttattacccagttttgtcctggattgatgctggtcttgggtrtccgacagtggaaccactctagtacctgacacacctactcttgacccagctttttcactcccaatttggttgttatacagcaccacaaatagggaaagat

SEQ ID NO: 13079 - DNA, 201 bp, Homo sapiens
tcatttattacccagttttgtcctggattgatgctggtcttgggtatccgacagtggaaccactctagtacctgacacacctactcttgacccagcttttycactcccaatttggttgttatacagcaccacaaatagggaaagatggctgggactttgaagagaacaggtggctcctatcagctggtgctaaaagagccc

SEQ ID NO: 13080 - DNA, 201 bp, Homo sapiens
ttgatgtcacagttttcactcttcaagaacaaggagtcattagtatcttgacatctaactgtataagttaaagcacttcctggaagctcaaagggaaacaytgaactcttaacacacagattctgctggaagtaaatgactctgccctataaaaggaggagaaagaaattctatttgagtaatgccgttgaaatattaaaa

SEQ ID NO: 13081 - DNA, 201 bp, Homo sapiens
tcacattttatacgtgttaaatggtgtagtagtaaaccatgtttaaaaaagcttcagttttcattggtgtacaaagctgctacatgtaaatattggaaccrctttttaaaagaggattgctgcagtcagattttttaaaataataaaataatcacaaagttcaacatatggtgtcttcatgtgattataagtgtgcgagtg

SEQ ID NO: 13082 - DNA, 201 bp, Homo sapiens
tatgctgctagtttaatgctccagttcctgatgaagccagggctttctttcccaggagacagtcaactcagggggcatgtttggtttagtacctgccagcrtgttgttgacaaacaccatatactctctgttgcaaagccaaaacatgaccttttccacaaatggagtaagcgtttattggggaataaaaaagtatgatga

SEQ ID NO: 13083 - DNA, 201 bp, Homo sapiens
tttgtaatggggaaacactcactggtttctaaaaccctatgtagatttaagtagttgatgattctgtgaaaaaaccaaataccttctagagaaaacatacrggttgggcagagcccaggtattgatgtccttgatgaaactggtttttgtattctgaatgttggagattgagagatccaaagccattctctaaggttgaca

SEQ ID NO: 13084 - DNA, 201 bp, Homo sapiens
gctgaatagtcaaaatgctatatccacctcaaatggagtcaggataagcattatgaaaagtcagaattggcagttgctaggtgatgtaatttgagggactycatggagcataccctccaaaaaactcttactgatgcctgaaatttcacagttatgtcttgattacattggattgagcaacagcccctcctttaaaaaatg

SEQ ID NO: 13085 - DNA, 201 bp, Homo sapiens
ttggattgagcaacagcccctcctttaaaaaatgcaaattcttctcacacagggaggtagctattatgcccctgacacactgggtgcttattaagcactcraagcagaacagaggatgtggatggatgaggagatggaaaaagttgtgcagtgaacagtttccctgagagctggcatggcaagaggggggcggtatgccca

SEQ ID NO: 13086 - DNA, 201 bp, Homo sapiens
tattaatcttggtaagatcccacaaccaacactatgcttttgcaagagcatccaaagttgtgattttgggttttgttttgatttcttttgttggttttttwatttagcttgtgactaatagaaaaccagaaatactaatctcttacatcaaaggaaggttactggcaacctccttgtactctccagggaggcatggttctc

SEQ ID NO: 13087 - DNA, 201 bp, Homo sapiens
cacatcctcagaacttccccaggcttgcatccctggaaagctgaagtagtctttggggcttcagagaaggcatcaattgatggatctcagtccatgtgtgygtgaggctcaaggttacctggcaaggcagtacagggcagtagtaaagagtgagtaaaggatttggggtcagcaaaacctggttttgatcctcgatgctac

SEQ ID NO: 13088 - DNA, 201 bp, Homo sapiens
gagcagcttggctatgtgagcactaagcagtgcattacttacccagagcccttttccagaggcaggtgctgcccagtgccagctccagtgactctgggacrttgatggaaatgtgaatctggatgaggcacacatgcaggaggcttggagtaaggactcaactgggaattaggaatctaacatcctggaaatcaaagttgt

SEQ ID NO: 13089 - DNA, 201 bp, Homo sapiens
gttctgctgtcttgccatagaaaagggagccaaagggttttaactagagctctgtcaccttgggagaaccctcgggaaagaaccactgtccaggctagcarccacagaagccctagaagatcacacagtgaattgcttagcttctgctctcactgcagtgccttttacccaaaacaaactcttgttttggtaggagaaaca

SEQ ID NO: 13090 - DNA, 201 bp, Homo sapiens
aggtttctaggatttgcacctccgcattggcaaattttcccagtctgtgtctccaaacagggttttaatcacctgggctcttgtccttggcattgaaagckttaagagtactgcagaaatggtaaattaaccacatttaacaaaatagaaagttttcattgtgtcataaaaagccctattgatcttgttcaggcattgact

SEQ ID NO: 13091 - DNA, 201 bp, Homo sapiens
ccatcataacagattaacgtgtcttccatatccctcagcttccagcaacatttcctcctgttgcccttaggaaggtaggctgaactctgatgccaacgcasggagcagtgggtctccagaaagagcgtggaaagcaacgatggggcaggaggaggaattggcaactttagaatcactgtgaccaactcaacttcatttcaa

SEQ ID NO: 13092 - DNA, 201 bp, Homo sapiens
ctagggacacagacctctcctctccagctctgtgtccctcctaacatttttgtccttatgaagtccacagaatgtagtgtgacagcatggcatttgctatyccagtataatcgccttagttattgagtacttttgatgattctttttggtcttggccaagggtgaaaggatatgtaagtttgtgagtatgtatatattgta

SEQ ID NO: 13093 - DNA, 201 bp, Homo sapiens
gtcttggccaagggtgaaaggatatgtaagtttgtgagtatgtatatattgtacaattttttttgttcaaaaacttcaaaattctatgtgaaacttatttrtaggaagtcaattctggttaagttctccaccatcctaattacttatatactctgtgtaacttcaggaaatgtatttttaggaaacactgtaggctagagc

SEQ ID NO: 13094 - DNA, 201 bp, Homo sapiens
ggtgcatagtaggcacctgtgaatctttactttttaagtgaataaacaaaaatgtaacttttattgtaatgcagttgacagcaattcagtctttaggatamcattagctttctagtgatttcagtgaagcgtggttttccaggccattcttctgtggacggaggcagcttccctcaccaggatgctggctgtttattttcc

SEQ ID NO: 13095 - DNA, 201 bp, Homo sapiens
gggcacacaaggtataacttaaatgtttatagaagacacccattaatataccacttgcggtgccaaggacatgcacagtagttggctttgtggacatccaygtctgtagaaaaagagcttagttgtgataacgccatttgatttgtcaccttctactctagatcagggtcacctccaggtctcctgagcagggccttgtcc

SEQ ID NO: 13096 - DNA, 201 bp, Homo sapiens
tactttatgatgaaaaaatattcattttgcctaagaaatttacctggggctgtaatggttaacacagatctgagttgaagtggacttggctttggttaatwagcctggagtgtagttccggcagggaaaatataattctctcaaccttattttgtagcctccaatctttagagggaaactgtatacctcaactattgttgc

SEQ ID NO: 13097 - DNA, 201 bp, Homo sapiens
ctagagagtcctttgtcagaacagttaattatccattctaaaccagctcttctacaagcatttaaaagcaattcctgaagcaaaagcaactcgagcctcayttgatcattttgcatgaaacctccctttaggtttttcttgagaaaattcgaaggaaaggcagcaatctcttttgcaccatcttgttttgtcttctaccct

SEQ ID NO: 13098 - DNA, 201 bp, Homo sapiens
acctcatcagctcacatcagtaaaagaaaaccgtttcctataaaaatcaaagtctgtgctgagaccgccttttccaggttgccattttcacttggtttttytatttgcgaatctgttgttaaacccagttggatggcatccaggctttattaaccagaaaacactatactttctgaagtgcttatcaaaaagtgcttacca

SEQ ID NO: 13099 - DNA, 201 bp, Homo sapiens
tatttttattgttttggttattattcctcatcattcattttattgttgttcttagagttgcctttttggtttgggtcatttcttctcttggaggtggtgaygggagccaagggagggtagggattggtgtcctggggcagtccatggcatgtatcatccatgaccatatcagaatcaagacccttctccttccctccctga

SEQ ID NO: 13100 - DNA, 201 bp, Homo sapiens
cagtgttccttcttgtagataacaatcccttgtgacatcttatgagtctcctcttggggcatatgttttattcttactatggttatttgaaatttgttgarcatcatttgtatatgagatggcactgtccatgcattcattcatgccactgccctgtgagccttgtccaggcaggaattgtgtctgttaggcatggcacat

SEQ ID NO: 13101 - DNA, 201 bp, Homo sapiens
atgtgagaagaatggggcgtggttatgtagaattcaataggtttagaacagctcatactgtcattacctattcactcgagttagaaacctcaaagtgagaygtgatctttctttctcattccccttcttcctttttgccctcatttaatcaaacacaaaattcccttggcaatgccctgtatatttctgactcatctctgt

SEQ ID NO: 13102 - DNA, 201 bp, Homo sapiens
tctggtttggcaacattaattgaatgtaggtatgctggaggagaggcaggcctaatggggaaagtgctgtttttgatgggttgagtgggaagtacctgtgktaactgcagaacaaggtcaagtcaaatagctggagttgtaactgtaattagaatataagcaatagagttaaattaattgaaattgatgagatcagttaag

SEQ ID NO: 13103 - DNA, 201 bp, Homo sapiens
ggaggagaggcaggcctaatggggaaagtgctgtttttgatgggttgagtgggaagtacctgtgttaactgcagaacaaggtcaagtcaaatagctggagytgtaactgtaattagaatataagcaatagagttaaattaattgaaattgatgagatcagttaagaaaccacatcaaaaggaagaacaatgtattttaaag

SEQ ID NO: 13104 - DNA, 201 bp, Homo sapiens
gctgctgatttgggtttggaactgggattaaaatccacattctcatgggttccaagcccatggttatagtcagtcattatgttccacttcctcactagctsttcatcaagtattatcagaaagcaaggaattatttttcagactagcagaaatttactagtgacttagtaatatgtcagaatgtcatggtagaaaatcatt

SEQ ID NO: 13105 - DNA, 201 bp, Homo sapiens
gggaagcctctttttaagaaatttggaaaaggagctgacagaaaatgagtctgaaaatgagaggcagaaatgagtcatcaaagagttacttggaaagtgtrcagtcaggaaacccaggaaaagaggatgttgaggaaggagtgagagaaatgccagctattgcacagatattgcatattatgagaatggaggcctatataa

SEQ ID NO: 13106 - DNA, 201 bp, Homo sapiens
tccacgtgtattttgtataaattagtgggcttgacattacaagaggttgcccctatacgcagtcatcttcttagccccagagttctggaacttacccattrgcctgcacctctttatagaacccgtcttacgcatggttctgaactaactgcttctgtcacctggattgcttacaatacctgcttgcctcatgtgctacta

SEQ ID NO: 13107 - DNA, 201 bp, Homo sapiens
ttttgtctttgagcctctcagattagctttttctacaaaagctgtttggcatgcctattgtcatctattttctttcagagtagctgctaacagccagaagstgctagttatggccaaaggcctcattgttggagagtcgttcttgttctttgactctaggtagagaggatgaaggctctgagatactgtctcaaaacattc

SEQ ID NO: 13108 - DNA, 201 bp, Homo sapiens
ctatatagttaggagcaatttcagatgttaaaaggtgtaattcatatttcttgctcataaggtgttcgaaatctattgaaaagacaagacttgtgctgtasaaagataacaaagttgagagagttttaagtgatgagtgagtggagtggacagtttagcggagggagaaatcacagcaggcccaagtcatcagctgcctga

SEQ ID NO: 13109 - DNA, 201 bp, Homo sapiens
tgtcaaaggattaaatttggaagggagataagtatatatttatttttttgcttgttgtgagtaaatgactttgcagttaggtatacagttgaaaagctttrttgagatttgtagtcaactctgctccactcatggtaccccaatactggcttctccaccattccatttctccaacttcagaaaatgtccacagcgtcctta

SEQ ID NO: 13110 - DNA, 201 bp, Homo sapiens
tccacagcgtccttactttccaacattctccactgatgtggagtggatcattggtgctcaggcctcaagtcacaaacctgtgagtgacatggtcttatccrctgacctggtgttttttattgaagttgtcctctatgcagatagtttaaaaacaagagaaaagaaagaccaggtggtaaacctcctattccttgtcaggag

SEQ ID NO: 13111 - DNA, 201 bp, Homo sapiens
tattgtgtatgatataaaacagtgtttgcaaagtacctggcacatggtaggctcttttcttatattgttccggctctcagcttgctttactcctggtattkctcctgtgtgtctctgtattaaagatcatggaggaatataagtatatttttttcctgagagactttgtcttaactttgagattctgtcctcagctgtttt

SEQ ID NO: 13112 - DNA, 201 bp, Homo sapiens
ggtttgtgtgccggtttagaattgtctgtgtcctactatgtctaacatcccacttgatcttgacaacagccctgtgagctgggaaagagggacagtttgtrgaacagatatcgaggctcttacctttggaataaataaaatgggactcagaagggttattcagctgtcagtgagagtggtgttggctttttattcacaaca

SEQ ID NO: 13113 - DNA, 201 bp, Homo sapiens
ttctaccactgtacagagggcacatgcaatgtgcaaaaaataaaaacaaaaacagacctctgtccccaccagcttttaacacttactcttttctttcaagkaatatatccacatggttgaaaaaaagtctaacactgtaagagggcacagtgaaaagtaagtcaccctcccactccagaatattaatcccgcaaatatact

SEQ ID NO: 13114 - DNA, 201 bp, Homo sapiens
taacaacatcaacacaatcactcagtttgccattctctctctaatttttattatgtagaagcattctagaatcaagtctaagtctagaatggatcatttgyactaaatgtgttaagcctaagacaattcttaaggctgtgtgtcccagtagctcaaactgtgttctctactggaacttccttgggggtgagtccattggta

SEQ ID NO: 13115 - DNA, 201 bp, Homo sapiens
ccaggtcagacactagacactacatcaaaatagaccaatgacccaagcaaagtcagcaacagataaatctaagagacaattcctggatcaaagtcatcagscaagtataagagagtcagagaataaggcctgggaagtagaaagtgtgtatatgatactaagattaatttgcatgtgtatgtttctcttacagtaaaattg

SEQ ID NO: 13116 - DNA, 201 bp, Homo sapiens
gaaccctagctgagagttattccaccaggtgagagtctgagctacctctgatcacagctggtcctgttactctaaaaaagagtatcaggattgtagattcyggttattctagagtcttgaaggtttcgaggtctaagaaggacaggctggggactttggagatcttttaagaatcgacacctgcattcaacctgagaatgt

SEQ ID NO: 13117 - DNA, 201 bp, Homo sapiens
ggcaccattgctcactggttaaactgactccatttgcctgaatgattatcgcctgatgtcttgaggcttacagacccagagaaacctttattcttttctcrtaacagttaataataaagcacttgttcccttgtctccttttttttttctgccacagtatttctcaacctactatctttccatcttttgtcagctagtagt

SEQ ID NO: 13118 - DNA, 201 bp, Homo sapiens
gaaagcctattttaactatgtaatactattcttattccattatgtaggtaatgaaagtttgtatgtaaataaaagtttaagcttctctttataataatttrtcacaggaactgcctgcaaatagattctaacgataagaatgttcttcttttagctataaatccttagttttctacttcttgcaaataaacagcttagtta

SEQ ID NO: 13119 - DNA, 201 bp, Homo sapiens
gagaagctaaattataatcagaaagttgttttggtgagcttggaatcagaaaataggagtttaagtcatctgttcaacatgcagctttcctcagctgtgayagctttttcctgctgtccagtcttcatgtggagcctggtcaatagcaccagaattctaagtctgctggccaaggtgctgcctcctgcagagagagaaagc

SEQ ID NO: 13120 - DNA, 201 bp, Homo sapiens
gcttcatcatacttttggtagcgcctttgcttgctacatgataactgtcattttagctgcaatttttcaaaaatctcctaaaacactcttctcacacaatyggcctctcttaactaacttgtagacaattttgcccttctgctcaagatcttttctgcctcctttagatttcctccctatccatttctgtctcttctccct

SEQ ID NO: 13121 - DNA, 201 bp, Homo sapiens
aaccattctagaggataaagcccaccactgcaaaagtgtgatccagcctcacacactgccttgcaaatattcttcaggccaactgatgggtgaaggccagrtttgagaacagcacctttgtagcccatgaagtttcttgacacatttagcctcaaacacttgcagagcagatatagtcgatatatcctgggttcatgaatg

SEQ ID NO: 13122 - DNA, 201 bp, Homo sapiens
tcatctccatatctatagactgcatagacctctcacacaaatttgcattgctagttgaggtgttctttgagcttctcagtggttatgacaaaaaggacttyagcagtttgtgactgtgccctggaatccttcagcagactgaaataccttcagctgaaggagatggtgtttatgcagaagcccagcacctagcccatcaag

SEQ ID NO: 13123 - DNA, 201 bp, Homo sapiens
tgggttactaattgttacagtgaaattagattcctctttccaaagaagtcagagttgtgaaatgcttgggaaactatgagctgtttccccatcccttactsgtgtagacaaaaataactgatacagggcttttatttcctgtgggttcacacttagtctcggaatgctttaaaagacaacacactagacagaagctaacat

SEQ ID NO: 13124 - DNA, 201 bp, Homo sapiens
tggtaaatgttgggtttaggaactgaacccaggtctagctggttccagagcacacattggtgctttccgtggcgtggcctgtaggtgacttctgagggaawtcagctccttggtgctgagggcttagccatgattcctttcagagtgagttctccatgtcttctttggccaggttcctgtgctcagggggattttcaaaga

SEQ ID NO: 13125 - DNA, 201 bp, Homo sapiens
tgcccatggtcatgcatactgaggcagaggatgtgtccttccgcttcatgtcccagcgagcttatgggctgctggtggctacgacctccagggactctgcygacaccctgcgtctggagctggatggggggcgtgtcaagctcatggttaacttaggtatcgtatgaagtaccctctgccacttcgtttgggcttgtcttc

SEQ ID NO: 13126 - DNA, 201 bp, Homo sapiens
ttttgcctagcttcagattcagtctactccattccaaagcctctgctcctcaccattgtacatattgcctctgccacttgtatgctgaagtgttaatgccwaaatgaatgaaatctatcactctagaacaagtgctgatggtcccatgaaagaggccacttctaatcactaatacctcctatctctgtaggtagtctttct

SEQ ID NO: 13127 - DNA, 201 bp, Homo sapiens
ttgtgtctaaggccctctttgttggctttaaaatgtttattgatttggggatttaatgttggatccaactgtgaatagtggccactttgggcctggtgagygatcctggaatttgtcaaacaagtttatggaaggaaacctgaaaatgcttcaccctagtcctttgcctctttatttttgtgggttttttttttttctctt

SEQ ID NO: 13128 - DNA, 201 bp, Homo sapiens
ctccattaggatcacattctagtagttttggccaaggagagtaaaggaaaagcttgtctttcttgcctagaagtttaaaggtcaaatcctctctctagccrtattgcaattctggggacagttcctattgattgggcacttccatctaatatgctgttcaactgagattctttctggccaagagctgtgcaggggtaggtg

SEQ ID NO: 13129 - DNA, 201 bp, Homo sapiens
tgccattaccgtattctgagttggtggtataaatggcatttttctaggtgatcgttatatatgtgtatcatgtatattaccaggtatagtcctgtaatagytccacctttctgcataaaagtcttcacaaagctaaactgagagttatagtaactgtaattatggaaggtaatcacaacaggaaatatgttatatgaaata

SEQ ID NO: 13130 - DNA, 201 bp, Homo sapiens
ccagaattatatgagataatgcatatccaaagtttagggcagaaactgaaacctagccaacattttaaaaatgtgaattattgtcattaacttatcctttyggtgcttcacctctccatacattttaagatactctggtcattatgagtacttgccacaagtatataggagataaaagatttattttcccacccattatta

SEQ ID NO: 13131 - DNA, 201 bp, Homo sapiens
cccatttacctgttgtcctttggctgtattgccctggttatatattactgggttttgctaaatgtttcctatcttttctttcaagttaaatctttatgtckctgttagattatcacatataaatgtgtaaaaacatagatattcctgcaaagcttacaaggaaacaataaaacagaaaagacttgatctaactcctcccca

SEQ ID NO: 13132 - DNA, 201 bp, Homo sapiens
agatagaaagcttgtgtttagtccaccatacttagtgagaagttgccataacatttttgaagattgaatgtacagtatggaatatgttcattatctcagtmccatgtttgggctcataaaaataaaaatagcagacatgagtgtggcctttattcatttgttcaacaggcttttactgcttgcctatcatgggaatggcaa

SEQ ID NO: 13133 - DNA, 201 bp, Homo sapiens
tgcttgcctatcatgggaatggcaagaaacatcatttcagttaactgaaaggacaaatacaatattcttagtgatctccttccttcagttccccacaggaratttgaggttgataaaacagcagcaaaagcatatttttagaagataaagagatggttcgtatgatgtacagaagtctacttgctactcaaagtgtgatca

SEQ ID NO: 13134 - DNA, 201 bp, Homo sapiens
acataaaaagcactcaataaatgttagctattattactgttttcagtcactccaggcgagctatattgtaaaaaaccatacttccattgcttcttcactasagcctagcaaatcattgttttctactggtctactatttgtggatatttctaccccaagatcctttcccaagaggacaatgcaatatagttgaaagattct

SEQ ID NO: 13135 - DNA, 201 bp, Homo sapiens
cacgttggggtttgtataagtaataaacgctgagatatatgccttaaactttagactgtctgagatcagtttaaggcaaagatagaatattatgactaaasagcgtaaaatgaactgctgagcatgcaagtaccataaaaaggcccttccttcagaattgagctgatccatattttttctcttgatttcattttctactta

SEQ ID NO: 13136 - DNA, 201 bp, Homo sapiens
agaaaaaaatgtgtatcagagtatgttgaatatggctgtttgtcagatcaagtttacgctgtgtatgggccttcgtccaatttagatgcagatggtataarggactttgaatatgctatattattattcagctgacttctccagtaaataatagtgttcttcaggaacagaaaaccaaacgccacatgttctcactcataa

SEQ ID NO: 13137 - DNA, 201 bp, Homo sapiens
taacagtattctattaataccctgggaggctgaagtagaggatgaggcacggagaaagaggtgagtagtccatcgttgaacttgttatatgtggcagtctyaatggtatgtttgcttattaaatcctgataaatattggtggcatttttagtaggttttaactagaagcaggggctcctggagggtgctcaggctgaatag

SEQ ID NO: 13138 - DNA, 201 bp, Homo sapiens
catttagatgtataattataggcatctttcactacgcctttctaaagagggtaattttcatatattttatgcattgtagaaattttggttcatgtgaaacmtagtttgaagggaaatcaagttactgtttcatttacctctttgaataaatagaaagatgttcaggtaaaaccaagtgattatgatacagatctcaccccc

SEQ ID NO: 13139 - DNA, 201 bp, Homo sapiens
tcattacctgggaaattcaactgaggagtgttaggtaatttattaacattctctacttagatccagcagtgatagtttaagcagcctcaagagaatcaaasgatttttttttgtgatcaatatttattacttaaactataaaagagggaaaaatacatgtaatacatacaactaatatgtacccagttgcagatcataact

SEQ ID NO: 13140 - DNA, 201 bp, Homo sapiens
ccagaaaaagtcatccctagactacatcatcaagaacagttttgtatatttcaaccttcagcttgtgtctgcatcttgcattacttatcaattcacttttwtgcctgggctacttattaggtttgtttctcctctctctttgccttgatttcccgctgagtgtaaacatcacttttcctctgtagaatgagttgacctttt

SEQ ID NO: 13141 - DNA, 201 bp, Homo sapiens
gtaaacatcacttttcctctgtagaatgagttgaccttttgacttgattaaggataaatgccattgactctccacttctggaggccaagggttttacaaartcccactgggacttatttatttattgtttgaaaatgaatatcaaatactattccatatcattttaatgagatggatgtgaatctttttttttctacttta

SEQ ID NO: 13142 - DNA, 201 bp, Homo sapiens
gggaggagtgtagctagtgacagttacataataaagctttcaaaattacttagataaaatatattgactctaattgatggttaccatagaaacagacttayatagacattgattattcaagcactcattaaagctcctactatgtacttggccctgtgctcagtatatgttggagccaagtatatggttttccaaactatt

SEQ ID NO: 13143 - DNA, 201 bp, Homo sapiens
atctggatcctgcaaaggataagtcacacatctgttgctcactcctctgggcttgtctctgaagggtgatgggattcacagccgcttctgaaaagcagccrctagatggcgacctcaccctgatctctcctgacagtgagttcgtttcattttccctggaaaataaatgctccaaaagtatagtcataaagaactacagag

SEQ ID NO: 13144 - DNA, 201 bp, Homo sapiens
ctctctcagtcattattcttttatgaaaactttggaataaagctatttgtaaattgcactttcttttaccactaataattaaaaagcagggccaagtcacraaatgccattatccagtaatttgattttttgaaattaatgaaacgctttcattttcagacgtgtccccccaaccccccgaacttcactgctgatggaaga

SEQ ID NO: 13145 - DNA, 201 bp, Homo sapiens
tcccaacccctcaatcctggagatcaattcatccagaatttctctgaaagttctcaacttgactttaaaattgtttcttcagattccttttggaacctcartcttcaccagagattccccattctgacttcttagttctcatcttagattttttctttgtaaaataagaattagcatgactagcagcatcatcatagttca

SEQ ID NO: 13146 - DNA, 201 bp, Homo sapiens
ccagatactgaagtttaagagacctaagaaaatacaatcctccctttttttgtcactgtaattctgagccaatagagaaaatattgcaatgaggatggaargcaaatatcattttaattagtaataacacacaataatattgcttacacccactgaacttcagaattagacagaactgcccacttgaatagtagttcagaa

SEQ ID NO: 13147 - DNA, 201 bp, Homo sapiens
gactctcattcattcaatagttattacatactgtacttgggcttgggaataccaaagagttcttgtcagcatctggtgagtctgaaatcaaaggacacacrgccaattaaataccaccaccccacccaccctaagaaaaaaatgtaaataaaaacagtttcaagtaagagattacttatgtgagctcttattggtaaattc

SEQ ID NO: 13148 - DNA, 201 bp, Homo sapiens
ataaacaactattatctttcaatttaaaagaaattaatttaattacagtccacgtaattgttattagttaagtaaataggaagacatgatgaagagtaaawgttctgctaatgggggcttccttaagtaggatagtttggagaaagctcattttgagctgaaactcaaagaataaaaatgaaacagtcatttgaatctgga

SEQ ID NO: 13149 - DNA, 201 bp, Homo sapiens
tgggcatctataacctgtgtctccacttctttctcatgttattttcttgatgtgaccatagtaaagatgagcacacacttgaaatttctgaataaccgtgrcaaagagatttgttgaaaatccctgactctgtgggtcctgctaaccttctgactttctaaatgcagcctttgttttataatccagactcatttgacctct

SEQ ID NO: 13150 - DNA, 201 bp, Homo sapiens
gggtcttatatggaagagcacagaggtcatcagcaattgctttggtaacatgcctgccacaagtggcctgcctttgacctaaataacagaaatgggtcacwgcattaaaagtcgagtgccatcaaggaaacctggcttttacctaattaattcctgcaaagagagtgttctatagaatgttgcatatagctcaaacaaatt

SEQ ID NO: 13151 - DNA, 201 bp, Homo sapiens
tggtatagcagtaatttttaaggatatcatagtatagtacatccatgtttttggttatgtgttcattccccgccattgttttcagactctacctgcccagygaataggccatatgtaagaagttcacttgtaaaacaattgtttgttgcttagaatgcactttatcatgtattgattcattcactcaccaaacatttctta

SEQ ID NO: 13152 - DNA, 201 bp, Homo sapiens
atataatcatgaataagagagttttgttctcaaagaccttctagtctaatggggaaagacacatatgaaggtgcttcagtagaaacatgaacagtgtatarcgaggagtcataaggtggagtaatggcagctgtccccagggttgagactctatgaagagcagctgcttttaggatggttttcattgaagatgagccttga

SEQ ID NO: 13153 - DNA, 201 bp, Homo sapiens
cactgctgaaaatgtggaaaacacataaaagtatgaggcagtaggaaaaaaacatgcttaatttcatcaactattaatatgaccttgtttcagaatatgcrtgatgtcaggcacataacagatactcaaaatatatttgttggttgaatgactgagtcttgcatattttcagcatctgagttgtgcaaagatcttagcttt

SEQ ID NO: 13154 - DNA, 201 bp, Homo sapiens
aagaacactaacagttttactaggactaggtgttttcttgccagaagaaatgcttttaggcatatgggaattataataagtatcccaatatgaaatttccytcttcagataaaaaatgaaaatgtcaagatggttccatttcttttcaatcttgcccttctcctttctcaaagaaagccttgctgtttctgaacagtcatt

SEQ ID NO: 13155 - DNA, 201 bp, Homo sapiens
ttattccacctaaattctcgatatttggggtatgattttatttctgtaaaaaaggatttaggcagggaggtgtcatctggattttatctgcccttaagagkaagtgttctttctcctctccctatctaaaatttccatgtgattccctcacactggcactaaagtgtgtcatctggttagagctcacatcagtgccctgct

SEQ ID NO: 13156 - DNA, 201 bp, Homo sapiens
ctttggtcagttaaatccatactcatgccttatcccaaatcccactgcatttatattcagtgctgagagacactctggcttggcatctaaagggaattagygtggacctgagagtaaaaggtcagttcaagttctggcttcttttctttctaatttttgtggcatttgtcaattaatagaaggtgatcttactatggaagt

SEQ ID NO: 13157 - DNA, 201 bp, Homo sapiens
ttaactaaaatctggacatgctgcattgagagagcatctcttggaagtctcctttagtgaaggatgcttttttcctaatgttttaaattcctggagtcagrccttgattctacaatcattcttcagtgatgtttcttcttttaaggtcacgtattttttatatgctgtcgccccgtcctcatcattagcatttattgacct

SEQ ID NO: 13158 - DNA, 201 bp, Homo sapiens
gctgtcactttcttcttgaaatcagaaaaacatcgtagtttttacatggtagtttttccttgttggaggacagttgcattttactccacactgttaaatgsattaggccatgtaagagaaatataattctgtaattattcagaactcagttggttgtttatatggtattcagcaagatacttcccccccacctccaacttc

SEQ ID NO: 13159 - DNA, 201 bp, Homo sapiens
gatgagaatctgatggacgatatgtaccacgtgctttgaaatagccataaggatgtctgcacaagaatatccatgcattcgttcttagaatttcagggccrgttgtagctcagtcattttgccattgacttaattgaaatccaaatcaatgcagacacttgctcaaggtcacatagcttgttctctcccagctcccctgac

SEQ ID NO: 13160 - DNA, 201 bp, Homo sapiens
tgtgtggcaggcggggaggcaggagaggaaaatgaggtagatgtccttcccataccttaactagtttttgagagaaatggaaaatggcagatcagatgccrttggccgtttgcccaattaagccatagcagtgttagctaagatgtgatcaatatggaagacttggtctgcagagccttttttagctgtgctcctgtacta

SEQ ID NO: 13161 - DNA, 201 bp, Homo sapiens
agaagaatagatgtgagtaggcaaccatacaatagtgtttgttttgaggacaattatgagtaggttttttagatacattgtatgtcacttgcaagtgtatragcagagtttgctatttttttgagatattttttgagtaactgtcatttctttgtgagatttaattctagaccctaattctctcactgcacagagagggag

SEQ ID NO: 13162 - DNA, 201 bp, Homo sapiens
aagcatttccccatgtttccttccacccccaaattcttaccccatttcaggcagagctgagcaaacataagccttctctgaagtattgagggaaagtctgmtaaacggctaaactacttaaggagctaacagaaaaggttgtatcagagaaacagtggagaaacacaggtttctaattatatctggcactggagagaatgt

SEQ ID NO: 13163 - DNA, 201 bp, Homo sapiens
tgaaaagtgatgcacactgccccaacacgcacacatacacatacaccccgcctaaaaacctgagacataaacaatgtctagaattgtgggcaatcatgcaragcccttcaaacaatattaaaatccagccacttgtaaagagtgagtaataaaataagtttagggttatataaattgagtctaataaaataattcagattc

SEQ ID NO: 13164 - DNA, 201 bp, Homo sapiens
taaagctatgtgtttcagaatgaaaggaccaatcacaagaaactctcaagccttaaaatacatttagcttttggatataatacatcacatctgtatttgtyagtaacatattaaacaaaatgatagataaaatgtagattatataagaacctatgtaattgacatgatttagatactcattcaaagatgagtcatgaaaaa

SEQ ID NO: 13165 - DNA, 201 bp, Homo sapiens
ctttttggctagtataatatttccagaatccctgaggcttgcttttaaatcagcataagctggttttgtgtctcacttttgtgttgtacaattacagaaarcagcaaatacttatcttggcatgtcctgtcatgacatgagccaaaagctgtcatcctcatagattccctgtctaagggaatagttgccctatcagcattt

SEQ ID NO: 13166 - DNA, 201 bp, Homo sapiens
atgggcaaatctcccaaagattccattgtgagtcacacaaacgttcatctataaaaagtggaaatttatcagaaatgatgaccttgatattttgaatgtartaactgagaaattcaagtagaatctcatctagtatgtgttgaaaatgctcattttttgtttaattttgtttagtttttttttcttgtccagaggaatgaa

SEQ ID NO: 13167 - DNA, 201 bp, Homo sapiens
taatccactaaatagtgttcccattgttttcaaatataattcacaggggtaaagatagaaaatgtattttttagggctttttctaacaattatattttccrtggaatgctgaagtcccacaaggaattctgaggcccaggtaaggaagaagaattagggaagacacaccagtgggaggttgcctagggcacaccaaaccat

SEQ ID NO: 13168 - DNA, 201 bp, Homo sapiens
tctgacaaatgctcagtaaacatgagtagtgggaaatcttgattatatgctcattaaaaatatatctatgtatttaaagtagtaagtctggtgttcaaaakgtaaaaccttcaaaattctaacacagttcttgtttggattaactctagtctataatcacaactcttctgtttccttgtctgcactgtgctcacataatgg

SEQ ID NO: 13169 - DNA, 201 bp, Homo sapiens
cattttcattctaataagctattttttatttctaataagctatttcttatttctaataaactattttttatttctaataagctcgtgtcttgagcagaaayactaatacccaggaaattttctgaggactggctcacttaaaatgaagggaagtcactccacgctctgagttgtcttctctcatcttcttcatgtgaaatc

SEQ ID NO: 13170 - DNA, 201 bp, Homo sapiens
cactcacttctgctacacttcccagctgtctcttttggctttgcacattcctgtctcatgactctacagggaaatccatgatgtagattttcctgtattcragcaggcaaagatacgggtcaaacatttaaggccgttaacaagaagttaaatcagcaacaacatttatatagaggcattaattcagggtgaacgcaaaat

SEQ ID NO: 13171 - DNA, 201 bp, Homo sapiens
cacttcccagctgtctcttttggctttgcacattcctgtctcatgactctacagggaaatccatgatgtagattttcctgtattcaagcaggcaaagataygggtcaaacatttaaggccgttaacaagaagttaaatcagcaacaacatttatatagaggcattaattcagggtgaacgcaaaatgtgttgcagcatcga

SEQ ID NO: 13172 - DNA, 201 bp, Homo sapiens
ttggaattgggtgatattggacattcttcaaaaaatcttctaaagggaaagaatgtttcatctactcatttgttcagatttccctataatttttagccagsagtcctttatggatcagatattgcatcaaaaaagaaggggaaaatattcttgtcatggagacattttcagattaagttgaaaaggtccataatccttacg

SEQ ID NO: 13173 - DNA, 201 bp, Homo sapiens
ccctataatttttagccagcagtcctttatggatcagatattgcatcaaaaaagaaggggaaaatattcttgtcatggagacattttcagattaagttgaraaggtccataatccttacggaaattttttttttaatcatcatcaggctattcttgacagtcagtaaaatatcaggtctttctcatttaactgacagattt

SEQ ID NO: 13174 - DNA, 201 bp, Homo sapiens
taatcatcatcaggctattcttgacagtcagtaaaatatcaggtctttctcatttaactgacagatttcttctttttgctttctttcttccctctctgtayctatatctactctctttccagggctcacggcatatagtaagtattgaaaaaatgaatttaagtctaacttatacatacttgtgaaacctcattccttatg

SEQ ID NO: 13175 - DNA, 201 bp, Homo sapiens
tcattgctggcatttggctatgttcagttgccccggtgtgctactgaaggcaagtgtccaaacgccaataatgtttggtttctctcgatattccgaggttrtatatcaaaagaagccgtgtgtatggcttccagttacccatccagagaattcctgaaaaaagcaaattattcttaagatcccctggaattatgaatctct

SEQ ID NO: 13176 - DNA, 201 bp, Homo sapiens
cttccaactctgaaagtctgtgactaattttgttaaacccctactgtgtgcaaagtttgtcactgggacgaataaggttgacactctcagagaagcaataygtaaaaagacatgtacaattctcttaatttttttttttttttttttttttgagacagagtctcgctctgtcacccaagctggagtgcagtggcatgatct

SEQ ID NO: 13177 - DNA, 201 bp, Homo sapiens
aagaaatcaggtggatggagaagatacactagaggaatgagatctcctacatgagtaaagtgttttctaatgtgtttttcttgaatgatagcatcttgaawttcctacaaagtatggaatagtttacctctgactagcgctgccctacagaacaatgtcaatttattctaagactgcaatgttcagaatgcagatatgatc

SEQ ID NO: 13178 - DNA, 201 bp, Homo sapiens
ccttcattttcctgcctgagtgataacgaatgatgtctcttgtcctgtacccctggcttcctctcctcagagcattcaagccagaccccatgacaagatgmtcccagtgaagggagaaaactgggaatgacaaatgtgagtctgggaacccaggcatcaaggggtggacttcctgatctctaccacttgccatcatctatc

SEQ ID NO: 13179 - DNA, 201 bp, Homo sapiens
ttactgtatctgtaatttctttttttttttaattccatgatttactggaaatctcaaaggatgtttgaatgaactctaattatccgttgtctttgttgtcsctgactccactgtcaaaaacccaagccaggcatccgcttggtttggtgaccttaaccacaatttgaaggctgctgactgatcagggcagtggttgcggaa

SEQ ID NO: 13180 - DNA, 201 bp, Homo sapiens
atgtttgaatgaactctaattatccgttgtctttgttgtcgctgactccactgtcaaaaacccaagccaggcatccgcttggtttggtgaccttaaccacratttgaaggctgctgactgatcagggcagtggttgcggaaggttggggtggcaaacaacaaagatgtttcccgcaaggaatttgagtcttcctttcatga

SEQ ID NO: 13181 - DNA, 201 bp, Homo sapiens
tttctacttcccttcttgtctctctatttttaccttattcatttcctctcgtgcctttccattttttatatcaggaattaaataccctctagagtgaaacratgaataaaatctactagtcctgtgagaaggacaaaattaaatgtgttgggttgtgtttgtgattgtgctgatgacagcaaaagaagccacactgaggat

SEQ ID NO: 13182 - DNA, 201 bp, Homo sapiens
gaaatcctgaactagagtttgagagagtctgctaagctaaagttgtggatttgcacgttagcctcctgaagaggatggttgaattcataaatatggatgayactctacagaaaagaagtttgcttagaggatttggcatatccatgatgagagtataccggggaagcaaggaaacactgaagagagaaggggtggtcagaa

SEQ ID NO: 13183 - DNA, 201 bp, Homo sapiens
caggagagtcaaggtcacattgcaaaagagcgtgttggatggaagatgttacatctgattttgaaaaatatacttctctacaatattgtttggtcatcttrtaaaagtaaaaaatagtgtacctttataatatttcattgagaagtgtattaggcactttatcttgctaatgtaagatggttcactttaaagtgctctgtg

SEQ ID NO: 13184 - DNA, 201 bp, Homo sapiens
actttataggtcatataactgaagtgagtttataattatggcaatgggtctacattggaatgtagtttatagttactagctcaaatatctctgcctttcaygttatgttggaaaactgcatgctatctttatttcttagtttcacatctgtaaactgagattaagatctgcttttctgtttaaagactattgcctacatca

SEQ ID NO: 13185 - DNA, 201 bp, Homo sapiens
atgatgttaccatatgttggttctgaattcctattttattttattctcaggtggaaaaaagaaagaaaaaaggattcatcagcaatagggcaacttagagmggacacataggtactatggcagtgataagagatgagatagatcatcactatgcccttttcaattcttgggaactgtcttcgttaaacagttttagatgca

SEQ ID NO: 13186 - DNA, 201 bp, Homo sapiens
aagcctcagggtaaacaggcattgcctcccattttgatttcagctccatttaatgactttttatacccaatgtggacacatactcatttttagttttccartgcagatttcagctatattttggctttattcctcttttttcatcctttttttctttttttttttttttttttgagacagagtcttgctcttttgctcagt

SEQ ID NO: 13187 - DNA, 201 bp, Homo sapiens
ctttgcgctgccagcaacaagcctgtgctgtgtagatctagtgcagccacagaaccttgggactagctgaagggccgctagacctaatggcaggggtaacyatttttgcaattgtgaatattcagcatgcacaggcttcctatcagctctcccaggagctctctgagagatggaccctgtgaggaaacatctttaaatgaa

SEQ ID NO: 13188 - DNA, 201 bp, Homo sapiens
actgtcctgccttttacccttttcttagcatacaagagttactgagaatgcttcagaagctattatgaaccactgtagcatcagctatatttatttaaggyacctattttgtatgttaaaatattctagagtatcttataactcttggttaatgaaactaaggactttctcactccttaggtaaaaaagtagtgtttattt

SEQ ID NO: 13189 - DNA, 201 bp, Homo sapiens
aactacggtgtttcgcttaggaacatcaccaaacaaagctacttgttcttcaaggacccagtaatcatccttatccttgcacaattatcctggctctatcstttgatgattttctttctgcaactaatgatttgggtagaaagaaaacctgccgatagtcatctttgatattgactggtcagtcccaagatctaggcattg

SEQ ID NO: 13190 - DNA, 201 bp, Homo sapiens
caaaatccgcttttatgtaggatggcttttttaaataaataagcagaaggatgaattatgtggctataaataaatctactgacatgtaataaagcaaagtygaactgttttatggtgtcactgaaacccttagatatatttatagccatgttaacagtccccagtattttttcaggacttttatttcatttcacattatga

SEQ ID NO: 13191 - DNA, 201 bp, Homo sapiens
accttgtcagagggccatttcctggggggctgtggatcctggaccacccttacaaatgagagccagggcagttagggtgactgtgtgcatcatttactacsggcagcttgaagcttttggaggacaccaatttcagaaccagaataccagttcactgccataaattctgaaatggacttgatgtatgaccttgaaggcaaa

SEQ ID NO: 13192 - DNA, 201 bp, Homo sapiens
tgagagccagggcagttagggtgactgtgtgcatcatttactacgggcagcttgaagcttttggaggacaccaatttcagaaccagaataccagttcactrccataaattctgaaatggacttgatgtatgaccttgaaggcaaatcacctgtaggtttggtctttttgttagagagacataatgctgtttcctcaacacc

SEQ ID NO: 13193 - DNA, 201 bp, Homo sapiens
tgtggggagaatttggtctcatgaataatttgggcagagagaggatcctgtgatttggatagccaaagttttattgtttattttttccaggagccaattaytatatatcttttttcattgaatcaatatctctgcataatggaatggtcacctttgaatgttctcttttcttaaaacaaacttcttagataagttaaacac

SEQ ID NO: 13194 - DNA, 201 bp, Homo sapiens
tccttattcatgggttttattactactatcctaatttcctcatatggaaatgagcctcaaaaacattaaataagttactctaggtcccatatcaataaatygacagagctggaattggaatcaacttaagtctgacttcagagcttaaggttttaaccatcatattctaccaccttcataatacctttagttactttatta

SEQ ID NO: 13195 - DNA, 201 bp, Homo sapiens
tttcattatagtactaagaatgctggaacaaatattttttctacttacatacttgagttcagttgaattattttatcaggtatttgcaagatgacctggartatcttggaagttattatatgtaaattatacatacacatatatgtgtatagttcctggcattgggcaactagtataaggaatgctgcaaaaaaaatcctt

SEQ ID NO: 13196 - DNA, 201 bp, Homo sapiens
tgtggttttctgaccctggagttctgatgggaaagataatgagaagtgtttacttagcatctaggccagcaagctaagaaaaacattgtgccatgctagtwttgacaaggtgacagagagcccacacttgcctcacatgttggccactcccgatgctacatcccactttactcttgctggaggactgacattaatgcttac

SEQ ID NO: 13197 - DNA, 201 bp, Homo sapiens
ctttcttcaaaaggaaaaaataaaaaataaaaaaaagctactcttgctggaaaggtagagagaagggtctgcgggtgccctctaccattgtggtttcaatrtctaaatcttctggagaggattgctgcagtgatgagataaaagcagctgcctttccaagtactgtctatttgcattgatatttacattctttgccaaagt

SEQ ID NO: 13198 - DNA, 201 bp, Homo sapiens
aatgtccttgcagtcagaatggcaaacaaatggcatggcctgtcagtatctgaagttaatttgggctggctgtcctttctttttggatatttaggtttcartaatgatttcccgaaggccacaataataaacatgtgttatgttataaaaagcgggtgctgcatacattggaagcaaggccccctaattgaatcacctgtg

SEQ ID NO: 13199 - DNA, 201 bp, Homo sapiens
tgagtaaagaaaccctagaggtcaaagattgtagtgtaaataaaagtattttcctttatatatgatataatttatatgtgttatataatatgaagtctcarttagaatagggaaaatgaaattcaataattattagagtattatttgcgaagtgttctgctaatatttttcctcctattaatcaaaattagttttgtattt

SEQ ID NO: 13200 - DNA, 201 bp, Homo sapiens
tacctttagaaggattcagaaaagaagaaatggccgtttcaccccaatatgtcactatagatatgaatgccactcatagaattgacacgtcatgtttttarcttctgtgctttaggattttcctgtttgaattgtttatgtgcatgtgattttggtggaatttcttcccctttcctctgttccttgctccttcttttgctc

SEQ ID NO: 13201 - DNA, 201 bp, Homo sapiens
cataaggtaattttgtccaagtggttactgtgtgggtcctgttcacaatcttgatcatgattgtattccaacttctatgtcagagtttgcaagcatgtggyttataaactcaagatggctggtacaatgttgttcaatatttaatggaggggtattaccaagatctagttttctaggttttcttgagaaattagaaaatct

SEQ ID NO: 13202 - DNA, 201 bp, Homo sapiens
atatcttcaccaaaaaataaggaggcataagaggggagataccagatcttacaaaataagtaggttttatttacaaatacttatggattagtgggggcccyttcactaggctacaaagaatttgaggctctatctatgcttagttttaaagaatgctatggtcaaagaagctatgtttgtcataggcactagaggaaggga

SEQ ID NO: 13203 - DNA, 201 bp, Homo sapiens
tcaaaatttagagacatacagtatttcattttaccatcagcgtatttctatgtttatgcaatagggattgaaaaagttcaatccccatgctcaaaaacacrtacttccagctctctgagatgatatgccagacagggcttttgattagaagccttatttttttgcctagttctagcttctgtatgagtggagactttatta

SEQ ID NO: 13204 - DNA, 201 bp, Homo sapiens
tgggcaatactgctttgttatcagacttcaccatgtagatctcacatccttctcttttctgatcttgctcttatcatttcaaagttacatgtagagtgagratgcaggtttcatagggtttttgtttttatctgagacagagtcttgctttgtcacccaggctggaatgcagtagtgtgagcatggctcactgtagcctcg

SEQ ID NO: 13205 - DNA, 201 bp, Homo sapiens
actgctttaatgtgaattgcattagaaagctcccctccacttttccttccccagtgtttgtctactgaatagcagggtgaaagcgtcggttgctctcatcrcctcacaatcaggccaattgggcataactgctttctggtagaattcatctcataataaattgcattcatggaagatgcctagtatgtggtaaacatggca

SEQ ID NO: 13206 - DNA, 201 bp, Homo sapiens
cagaagatgtgtgtcttgggtgcctgaataatgcttcttttgctattcactttcatcttaatttagagtcatatatttcttgttaccttttggttttcccyggcacctaacaatgtaatcttcacaaagcagtgctacattctaaatttatagtgcagtaaatgaaagaggttggatccattgtgcttcataattcagagg

SEQ ID NO: 13207 - DNA, 201 bp, Homo sapiens
gagggactgaggtttggtgcaagttgtccgcagccaggacttccaacatctggaggatgagcaccctaatcttgaaggctgaattcagtagcacatccackgcaactgaatatctgattcaaggccaaaaattgtggagctcagagccacaacgggcttctgatcttccacaggctgctgaatgcccctggcagtccactg

SEQ ID NO: 13208 - DNA, 201 bp, Homo sapiens
attaaatctcaagggaatgtgaaataaaaactggaatttgagttcagagtacctgaaagagcatttttggaaaagactttgtttatgccatttgtgcataygtagatggaatcaaaatgtataagataataagagaaaggtgccattgagcctccaagtagaagcccgatgacttcacttatgcccggctgatcacccaag

SEQ ID NO: 13209 - DNA, 201 bp, Homo sapiens
accacggtgccatgcagttacagatttgatggcctgcatcccagtgacattgctccaagaccagagacaagaccattttttgtttgcatggagctaagtaktattttcagaaaatcaaaaccaaaaggtatgttttgcttcctagctcagggtctctggagacctgacctgccaggtatcatttgctcattttatttaaag

SEQ ID NO: 13210 - DNA, 201 bp, Homo sapiens
catggttggcaactgggaaagacactcagcaaatattacagataccagaaggaacctggagaaactctgattctttttcattttgttcttaaaaagcaggygtctgaaatgtgcccaacttcagctaaagaaaaaaacactattgttgggtctagacacaaagcctgatttgctgattttatttttcttcatttagttatt

SEQ ID NO: 13211 - DNA, 201 bp, Homo sapiens
tcctctggtgtcctgaatgaggaatctttggggcaagaagggtcctgtcctatttattatccttaagaaattccttgctatttttagttctcaacatcagytacttctcattactaagtaaaagccagattacttaacttgcactcaccctaattcatcttatccactggcagcaaattccttccttagaatacttcccca

SEQ ID NO: 13212 - DNA, 201 bp, Homo sapiens
tgtcgcgctccccttggataagtttaatatgattttgtacacattaattaattatcttaataacagacaaaatagaaggaagccactaccgtcctttccartgcatcagatgaatcaaaatgaatcaaagggctgggcatggtggcccacacttgcaatcccattactttgggaggctgacaccagtaaatcacttgaggc

SEQ ID NO: 13213 - DNA, 201 bp, Homo sapiens
catgtatacatattctctttctctctctccctctctccacacatactcactccctctctctctctaagtgccctagagtaattcttacttcccaaacagcrtccttaagtgacagagtgcaaatgattgaattaacatttatctactcaggtatatgtagaatctaaaacagttgaactcctagaagtacatagtagaata

SEQ ID NO: 13214 - DNA, 201 bp, Homo sapiens
ataagaccaggaccaggtgtagaaagtgccttattccagggcctgatgacctggaaggcaattttcaaatgtagggattatgcagtcacctctcacaaggwccagggtgaagaacaagtaagaaactttctattttctggggaataggcacactttcaaaggaggaagaggtattgagatgagacagagaaattgagatgg

SEQ ID NO: 13215 - DNA, 201 bp, Homo sapiens
ttatactttttcctagaaatgatccattccttctgactttcaaatatattgctttaaagttgtacaaagtatgattttatatttgtaatcttttctattgygatggttatataatttctaatgttctatttttctcctttagtttttatttctgtttttttagaggtttatatattttctttgacattttaaagagcaaac

SEQ ID NO: 13216 - DNA, 201 bp, Homo sapiens
agttgtttaatctccttgagcatcaattttcttttttattaaaatagtaaccaaaatatttgccattaatatttcagtgagtgttgagggaagaggcatcrgatgagacactccaaaagaaagcaatttgaaaatcatttaattctatggcaatataaggcccagctgttataaaatagtgaacattattcactcctaaaa

SEQ ID NO: 13217 - DNA, 201 bp, Homo sapiens
tcaatatcaccatcagctccatcacagtaagtagttagccaattatgaaaacaataagccaggcccattatttgcaggttgtgagttaaaaaaaaaagagycatccttgttgactatttgaagatgagatgtatcctcttaatctttgttagtggtgactgtgtagagatttcattcctggaatactgtgttggttaaaac

SEQ ID NO: 13218 - DNA, 201 bp, Homo sapiens
atagcatgcctcagaaatgaaaatctttgatgaattaagaggaggttcttatagttcccaggattttcccaagaagttgatttgtaatccacattttaaartaacacaattaacttttttatttgaatatgtaaaacaaaataattctatgtttcctgtaggactctaggcattttatattaaaattaacacgaagtatgt

SEQ ID NO: 13219 - DNA, 201 bp, Homo sapiens
aagggtgcagtgagccgaggttgcgccactgcactccagcctgggcaacagagagagactccatctcagaaagaaaaaaaaactcctagaaatcatttttrttaccatgtttatagcaacacaatagtgaaataggcaaatgcatttagtcacataacttggttttcttgggccactgctttctttcctgtgggagtggga

SEQ ID NO: 13220 - DNA, 201 bp, Homo sapiens
tttctttgtatgagcaaaattaccagacattttatatcaaaatgtaaagagccccctgggatactgtagacacttgggtgatacagccgattgcttaaacsttctgtgaaagcccagtagattttcctccaaatcttagattaggaaatgatgtcacctgaccctttcagaaaaaaggaaaaaaggatcctatgctgtggg

SEQ ID NO: 13221 - DNA, 201 bp, Homo sapiens
gaattggatttgagtcaagaactgtatttggggaactttccagtggagtacagaagaatgttggtgtttttgagactggtaacgcaaataaaaaaggaacraacaagaaaacaacagaggtatccaacagatgcaatttcgtttcccatggagtgctgtgcactgcaggttgactccgtatttccttccatcgctatttgt

SEQ ID NO: 13222 - DNA, 201 bp, Homo sapiens
ctttaagctctagtccaggtcattctgcattttgtcaatatagtaaattgagtaacagcctctgagggccctgcaaagagccaaggcccaatttaactccytagtgccagggtctccaaatgtttttggttgtctatacatactagaaaaaaattaactctgcaccaattaaaaatatgtatatatgtatgtagaatacac

SEQ ID NO: 13223 - DNA, 201 bp, Homo sapiens
ggttattaatgggccttcatacctgggaggacagattacaggagagatgtgataattagagatacttcactgatcataagcaggcccccgagcaccaaggrctagcagctgtgttacacatatgaggcaagctccatgctccagagacaaaagtgaagtagaatttgctgcagtgaccttacctaaaagaggtcatctcaa

SEQ ID NO: 13224 - DNA, 201 bp, Homo sapiens
tcttatcagcttctccattcacatgtcttaaatgatttctacctttactaacaagagaaaaatccaggtacattctggggaaaccattagtgcttagttgktaaaatcttgagacttttatcttactagtagaccctcaacatttttccaaagaggcactaatgtaccctgtaaagaaatgacatttttcgtctcaaaaaa

SEQ ID NO: 13225 - DNA, 201 bp, Homo sapiens
ttctgctgtatactgaatgacaaaggctgtcacagtagcgaccaatttgttccaatttgcttacttctccagatctctctgtcagactttaagttccttgmatatagggtcctagtcttcttgcccatccttgtatacatggtaggtgttccatcaatgtttcttgaatgaatgtataaaaagtgtattttaattgaaatc

SEQ ID NO: 13226 - DNA, 201 bp, Homo sapiens
tcctctgtgggttgcagtgaggtcaatcagatgcagtcaaatggcagagaagatattaaaagtacatatatcctagaactaaatatacaccatctgtgaayttcagttacaaagggaaacttctcttaatatgaccttaggtaaagccattggcagttttattgtatctgtcagcaatcaccaatagctttgattaacaac

SEQ ID NO: 13227 - DNA, 201 bp, Homo sapiens
ccgagatccatgtgaggtattctgtgatgaagatcttgttctgtttttattattaagcgtacatcttccccttttctgatattaccactatgcatcatcarttaagctgtcaccaacctgacctctgaggcattggaatcattcacttgatgaagcttactttggcataagctaagggttaggaaaaccaacagatttcta

SEQ ID NO: 13228 - DNA, 201 bp, Homo sapiens
cactcaacagtgcacacatttcttctataaaatttgatagttacttatctatctctgatttttccctctgtgttttattatatctagtttaatttttcccytttgttgatttctgttttgtatatcttgttgcgggatatacatggaagggagacgagtttccaaagataatatagatcccagtttgcctgtaaattgata

SEQ ID NO: 13229 - DNA, 201 bp, Homo sapiens
tcaaccttaacccacacaatcatctttagaattggatccagaacaagatgggaccatcttaaacctggtacattctcataaggttcattctcataagaccstaaagccttcattatatggcatttttgaaactcctttgtcattttaaatttttgtctttcctagctcccttttcctctactattctatctaacttaggca

SEQ ID NO: 13230 - DNA, 201 bp, Homo sapiens
tagccttgttttcatttctcctcctcccgccttcctgtcttcctcttcctctcccttccttttcttctttttcttcttattttgattttgttttactttayggaattaaacctccataattctgtagtgtgccaagtatgagggggaaaaagtctctttcccccattaatagataatgacaccttgacagataagtgagca

SEQ ID NO: 13231 - DNA, 201 bp, Homo sapiens
cgcaaaggcaagcagggtaccagagttagagcaaatggcaataagccacttgaattagaaggcccccagcttgcagcagagttaatgctgcctgttttccrggtgacctcaatcactgcctggggcagacactggactcagatgctctccagtcacaagagagtttgtaaatatgatttaaaaattgtcactggctgctca

SEQ ID NO: 13232 - DNA, 201 bp, Homo sapiens
gaccttggcagtggacttgctttgtgtttgcaatggaagaaggaactagaggggggataacctcatggttgtcttttcttctaaatttctaagacaaccartgaagcttgaggccttttctccagaactatacaatctttgcctccagcaagctctgtttttactaataaccagattgtcaggtggaaaactttttctaag

SEQ ID NO: 13233 - DNA, 201 bp, Homo sapiens
gatcccaaaatgatgaggagattgtggatggaaagtggtctcttaagcagaagaaaaagcatggaagaaatactagggtcagggaagataaaaaatattaygctgttatgaacaatcaattatatagggaaagtaaataatgttagaaaggtagtttaaaattttccttttttgcttatcatgttagaaagaatttaaaat

SEQ ID NO: 13234 - DNA, 201 bp, Homo sapiens
tctagtcccatttactgcaattgtatttaaataccagcttaattagctgtactcatcctccttcccaatcctctttgaagtaggaaagtcccattgcttcygtttagctaatgctatgctcataccctagtttttaagctttgtagaaagtacagatatgactgccccatgtgatctctaagaagtctagatatttgatcc

SEQ ID NO: 13235 - DNA, 201 bp, Homo sapiens
acatagctcacctcccctctttctcttatattgctacccataaggactagagaaaagatggataacataatcctgagtctatgagttgctagaaattcctyattataattgtgtgtcttctggcaaaaataaataaataactttctcttttaaagccacttataggagacaatgcacattctgtgttttttctctgtggct

SEQ ID NO: 13236 - DNA, 201 bp, Homo sapiens
ttgcaacagaggagagggttagcacctttcatgacatattccagcatcctgttaaattgatcagaagaccaattgcacacagtgtcttctaccattgagaytggaaacacagccaagggtggagatggtcagtgaggcttcccagtgtcttgcaagttccaggtcagttgtttatgcttagagtcccctgacagagagatg

SEQ ID NO: 13237 - DNA, 201 bp, Homo sapiens
ttatgcaattttgggccatagattcctttattctgaagtggagaaaatactttccttatacaattgttatgtttacataaaataaggtgccagatacatartagaaataaaataaatgatgttactacttcctaaaatcctaaaagtttcatttcagattgctgagtaaacccagttaaagaaaccagcctctgtgttttg

SEQ ID NO: 13238 - DNA, 201 bp, Homo sapiens
ccgttgttggtgtaaagagcaagatcttttatgggtatcagttttaaggggcttatgggaataatcaatatgctatggaagtaatgaagatatttaacgtyctgaaaattctagtctaagctttgagaatgtgaccataaaattgacagggattaactttaatatttgactagttaacggtaggattttttccgttacagt

SEQ ID NO: 13239 - DNA, 201 bp, Homo sapiens
ctttgctgacacctatttggttgaattttacaaaatggaaggatgaataatacctcaaaggcaatctggtagattctttgagggaaagagatgtgtctatktacagggaataaagctaagcacattgactgttcttaggttaatggaaaagaataaggctagtgtaggagccagcaaattatgtttcctccataattagag

SEQ ID NO: 13240 - DNA, 201 bp, Homo sapiens
tgcatttttttttcttaagtctcaccctgtcttggtgatacacagattaatactaacctcctaccaaacaatccctgttgccactctactgaaaatacatycttgccttccacaagcagaaggctgagtgtctttgtggcttaggagagaacaaaaacacatctatgtattcattgccttgttcacttgcacaaacggaga

SEQ ID NO: 13241 - DNA, 201 bp, Homo sapiens
ttgctggttatagtcctccaccaaaactcttcagttcttggcctctaattcaagctttcttccaagtttctctccactctcactgtgtcatttctaggagrcctcagagttttccacgctagaacacagtcggtactctcatgtgtgttttcattttagcctctttgttgatgtctgctgcctgtcaatccacctgggttt

SEQ ID NO: 13242 - DNA, 201 bp, Homo sapiens
agatgatttttggggcaagtattcagtctatgacaatcctcatttaaactcatcagggaccattgataaaatgctattcattcttccctatgctggtgtgkaaatttgccacccaatggatgcctgcaatatatgccagagactttaggtacgctgtggcatggcttagtgactatgagaagactgacatattagcttgga

SEQ ID NO: 13243 - DNA, 201 bp, Homo sapiens
atcttttctctatagcacaaaagattatgttttttttttttttttcataactcagcatctttgtgagctatgaaacttgccctgatagccttttcttgccyagggtaggatatattctgaggaagggctgggactgcccatgcattcctgcagagcattcacgggtgctatttacagtcctaattaaatggaggattatta

SEQ ID NO: 13244 - DNA, 201 bp, Homo sapiens
ttattttccccttactttaaattctgaaaacgctaatgactgagcttttcatttagtactaactggatggttagttttctttgtgtatgtgatcgtttacrtggtcgttttgtttctcaccaacacattgtaaactcttttagaattgttatctaatagaaatataagtaacataaacctgtattatatttttggagcatc

SEQ ID NO: 13245 - DNA, 201 bp, Homo sapiens
cagaaaatgaccatgcagtcactgtaagcaattcctctaaaattattaaaaactgtttatgtttggagaaaggcagcccctcttgcagtgataatgactgstatatgagaggattaagctgattacatctttggaatactgagattgtgcaaaatagagggaacgatgaactctccacataagctaaggaattcagcaaaa

SEQ ID NO: 13246 - DNA, 201 bp, Homo sapiens
tttgttccttagctggaggattagagggaagaaatgacataggtgattagggatgggggagagctgggatgaatatggagaaaggttagagaatgcaggcrgaagttgatggcagcaatttgacttagaaccttatgggacttgggacacacgcactgtaaccttgagacctagataacagtgttttatacagattcggag

SEQ ID NO: 13247 - DNA, 201 bp, Homo sapiens
caacctggatatggtggagagcattcacattccttttcagtagtagcctcttaacgatgaggtatggatgaacagcaaattgctgctgacttattaattascatgcccacaccactgatttccctatgtcttacctgtgcacacacattggctttacagcatacgaacgccaagtttgtggcgtagcatatggtgctccct

SEQ ID NO: 13248 - DNA, 201 bp, Homo sapiens
ctttattttcattttgtttggtttttgaaatgctcattgtagaatgttgaatatggtcagatgttgggtgtgaagtttattagaaattaaccctgaaaaastatggtatagtcattcagttgccttttccagtggagtctgatttggcctggcgggtgtagtgaaacattaactacacccgcctcagccacccaaagtgct

SEQ ID NO: 13249 - DNA, 201 bp, Homo sapiens
caagatttttgtgacaatttcattcattcctactttctttacaccagtagtagctattcatattcattcttctattttctttgcatgattaactggcatayactagttcttcacattattagcctaataatagtagttacaggctataataggctattaattcattatcatctcctgactcaagtgaatctgctggtaact

SEQ ID NO: 13250 - DNA, 201 bp, Homo sapiens
tgccatgatttgcctctgctggacgcttccttcaagggctgtcaacacctctcttaattgtctggcttaaacatcaggcgagcaatgtgttaaagttagayggcaaatatacttaagacaaatatgtaaatttttactctttcaaatatgcattcaactggtgtgtatagatttcagaacaaaagccagagagagagcaag

SEQ ID NO: 13251 - DNA, 201 bp, Homo sapiens
tagtcattctcaaatatgattataggctatttcagattcatttcaggaaaatgtcatgtgtcaaggtgtcaattctgagcaatttttacattttgccaatwctattatagaagtggctctcacccataagtagcttgaaggagtcagtatgtaatgtgccagtctcattttcactttatgtgggcacaatgtctctctaat

SEQ ID NO: 13252 - DNA, 201 bp, Homo sapiens
gacgaataatgtacttcagtgccctgagatagtttttgtctactgtaataaaatatttccagtcttctctgtttttgcattcttcaattattaccttgaarttttaatgttttttaaaataatgaattggcctaattgtagcctcagcacaactactaagttacacattcaataaaaagactttttctttgtaatgttata

SEQ ID NO: 13253 - DNA, 201 bp, Homo sapiens
tgttactaatagctgtggaagctccgctatccacaaagcagagattatgaaacagtctatactttggctagaagcctaagcagaatctcttctacttccckcaaaatctatttcttagcaccagcaagactgggtctgtccagtgggttgtgggtttggggagaagcagaggaaagattgacatcatgtggaatctggaag

SEQ ID NO: 13254 - DNA, 201 bp, Homo sapiens
ctgaatagtctctgaatggaagaaagtgtttttcatccctaaagcccacatgtatacttcagatgcacaaggttcaaggtcagggcctgaaggagaaagtrtcacagcacaagtaacaatgttaaacttcaaaggaagataaaacctcaaaataagatattaaggtcaaatactagaatctgcagggacactgtcctggtt

SEQ ID NO: 13255 - DNA, 201 bp, Homo sapiens
ttctgcacatgttctttatcctaggaagcaaaatatttattccttttcctgcattctttaatacctagtttatgcatgtctcattgcacttattctaatcrgagcttgttcttgtcattttttttcatatttttttccttttgtgggggagtttaggacccaagtctttgtcctcttttggtttaactagtaccttgcaca

SEQ ID NO: 13256 - DNA, 201 bp, Homo sapiens
atttgttgaatagtagcgagtcctttccccattgcttgtgaccatgagattttatgtgatgttgaaacccaaaactacccaaaggaattaactactgctgkttaattgtacctatattaaacactttctttatagtattttccttatttgggggccatctcaaagtcctaacaatcagaatttgtgtcttctcatatgatt

SEQ ID NO: 13257 - DNA, 201 bp, Homo sapiens
tacaggttcataattcttgtcctcgaagatctcccaatctactgataaagcaagtaccatatgcatgaaaagataaatgtctttataaagtttcttaatcwtgagtgcccatttgagtggtctgtgggtttttagaagttattcacagaaacgaggctccttagttctgacatggggaccatttgtttttattttcaaaaa

SEQ ID NO: 13258 - DNA, 201 bp, Homo sapiens
aggctaggcctacttgcatctggagttggctccagaagtctttacaaagttagcttggcattggctgggtttcaaagaataaatagaaggggataaaccargaagaaatgtggatatatatggggcacgattgaataatttccagaaagaaatcagatagtacaaggagtgtccagagaatgatgtatatggctgaaatgg

SEQ ID NO: 13259 - DNA, 201 bp, Homo sapiens
tggccacactttgtcttactctatgttttctaggaacacattttggggtggaaatgcctttattccatttatatttagtcaattatctggtttagcttccrttcttacaacctaattaaattcagcccatcaactcagtttaaggcatagcagctgtagacacttcgtttatctacttggagagaaaaaagataagttggt

SEQ ID NO: 13260 - DNA, 201 bp, Homo sapiens
aaaaaaaaaatcttaggctgtccctacaacttttgctatcctcacgaaagagtgttactccagtgagacaaaagtccatcacaagaaatgatttttctacrgaaacagctgtgattggagcaagatacaaggtaaaacatgttgtggtcaagttcaaggagaaaacagggtggctagccctagcaatcctactggtggact

SEQ ID NO: 13261 - DNA, 201 bp, Homo sapiens
aaattatctcttttgatgaaggaagtcctttttgttttttgataccatgttgcttttgggaaaacatgcctgaaagtaggcaagtttctctaaagcaagamctgtaaaactcacagaaacataaagttgacttgatcatgcccattttataaataaaggaatggagactcaaagcggttaagggacatgtctgcagtattt

SEQ ID NO: 13262 - DNA, 201 bp, Homo sapiens
gccacttgtcccccatgcccctcctttctagcctgtggtttataacatgctgtaagtctggaaaccaaataatcatgtttattagacttgtatgtaaatckaacctaatgctcctttcctttgttgttgttttccttgataatgtggtcttttaaaagagtaaaatttgaactaggatttatgaaatctaggtttaagttt

SEQ ID NO: 13263 - DNA, 201 bp, Homo sapiens
cccaggttctttctgtttgataacaccgttttcaaatgttgagaatgactaaagaaagatatagaaatttgtaatgattaggtatttatacattctcaatratgaattttggtataaaaacatatttttttatctaactatatttttcatgcagtcatttcagtcagtatcaccatctaggtttcctctagggaccacata

SEQ ID NO: 13264 - DNA, 201 bp, Homo sapiens
tttaggccaattttctattttttccttctatagactgaattttatttttataccaatagtttcaatcttctaaacttctcccattcctctttactttctcmactgcatccacttaaatacatcttattgtttcagtcagccttggctgctataacagaatggcatagattgggtgacttaaaaacaacaaatatttattgc

SEQ ID NO: 13265 - DNA, 201 bp, Homo sapiens
ccaaagtatcgtttacactcttgagggctaaagaatgccagatgtatttatctaacttctgatgtgcctcccaaaatgccctatacagaggataggatcartacacacttgatttcaaaatttctatgacttgattctacttacacatcttattgatttggagaaataaaggtacttcttgggggaaaacatgactacatg

SEQ ID NO: 13266 - DNA, 201 bp, Homo sapiens
gactcaggattccactgactgttctgccactgtttaaggacgatattacagttggattatagatgacctccagtggacacagaggtgcttagattctactragccaccattactttgcctaaaagaaaataagagggtcaaagggactaacttttgtgtaagttttaaggttttattcaaacacaaacacacacaatcaca

SEQ ID NO: 13267 - DNA, 201 bp, Homo sapiens
aaatatcacctggatgaaagacctaactgcagcactatctccaggacacacacacacacaccagagtccccacgtgcagacaggcactgctgatatattayagtctgttggccattttgtttatgataactaggaaaggaaaaatgagcccttatttcagtgtgttcatcccaagatgatgacacagtagattccccttgc

SEQ ID NO: 13268 - DNA, 201 bp, Homo sapiens
atggattataatgccaccgtggtcccatgacaaatgacaaggaggttgcagtaatgaaattttattactgcaaatagagaccacatctgagatctagcacsgccacatttaccattgtgggaaacaaaatgaaacacctgggaaaggatctccactgactttagcagtgagctaacaggattaagaagatctcccagaaac

SEQ ID NO: 13269 - DNA, 201 bp, Homo sapiens
aaacagaatgaaaatagttctatagcaatcggaatcttatatcactaaattctgggaggtagaactgaaaagcaacttctttctttgaacctgaaaatagraaagctaagaaacaggagagggaaataaaagaagaatcagcccagagctatcatccaggcactgacaaatgttccttataaagtctctgattgttgtccc

SEQ ID NO: 13270 - DNA, 201 bp, Homo sapiens
ccctgtcacttgccagcttgcccacaaccttgagaaggttcccgctgtcgagaagtttctctatgctttgatctccatgatcatatatatgcattttctcrcattaaaaccaagtgaatgctcagattgacattactataggacacttcacaaaaaaagaaagtactggctagaggtatgtttcctaaacacacatggcaa

SEQ ID NO: 13271 - DNA, 201 bp, Homo sapiens
taaaaattagaaagcacatcatatttatttagccatatgttaaatgttataaatattatagtttagggactcagtaaaatgaataattaaaaatttgaggrtcacttctaggtacaatgtaaccagggatgtaagataaagaatttcttgatttccaaccataatgcatctattttaattaaataatatctttcaagatta

SEQ ID NO: 13272 - DNA, 201 bp, Homo sapiens
tggttagtgaattacaagttttgttttccctattgtcacatggaagctctagtttaagtagttaatacaaattctggcctgcagaagttgtctctaattaygaaaacttagaattattatcccagccataaaatacaattaccctgtaccgtttttcctctgccccagagctgcctgaacaccaagtgtcctaccacccat

SEQ ID NO: 13273 - DNA, 201 bp, Homo sapiens
tgattcaggtctcaagctgtggttggaaatcagtgactttcactaagggattgtcctttcttttctttaggacatggctttttgaaattaatcttgattcyttctgccatatcccaagccttacatttttttcctttttttctctatgtctgatcattttgctttaagtcaaattgattttttaaaaattaaatgcccatt

SEQ ID NO: 13274 - DNA, 201 bp, Homo sapiens
ataagaggaaaggcacctggggaaatcttgaagggatcatatgtcaaacggctgaagagcaaacattaaagctttattttgaaaaggatatttgaaaatakttgacaccaaaaattctgtagggaagtaattcttgtggagtttgccttctttttagtttaactcttctgaatcaggtacttgttataacaaatcatatat

SEQ ID NO: 13275 - DNA, 201 bp, Homo sapiens
aatcattttagtacataatacctcagcagaaatggatttttgatttgtttaggatatgaaagagaagtctaatattaacatgtatgcacaaaacatgtatrttcaaccagcaacagacagcaaggaataggggcatgaacattcggatagctggacgtaatacaccagggttacatctccggcatggttccattcccattc

SEQ ID NO: 13276 - DNA, 201 bp, Homo sapiens
atagttggacatgataactacatgtctacaggctcatcagagagagagcacaggcagaggctagagctcaatgcaaatatcgagactgaaaaaggttttgraaggctctcaaggcaaggatttaccctgactcccatccccctgctgttcaaggctccttactgggagaaagaactttcttttctaagccttaggtgagtg

SEQ ID NO: 13277 - DNA, 201 bp, Homo sapiens
gaagtaatttaagaatggtttatttgaagatctctttgtataatttatagatttctcagtgtgattaagaaatgaagttattacatttttttctctaattrgtaatgcacgtatgcctccttttaatgatattatgatgtttactactcatagggccattctttcttgagtatagccatcactttctgttgaagaattgat

SEQ ID NO: 13278 - DNA, 201 bp, Homo sapiens
tttctatgaaaacgtctaaaaagtttactcaactttattttgaatgaatagaatgttgtaccaagatctaccaaggtagaccattataatgatctctaatygatagctatattctttcgccatgggctattgaaacaccaagaaattaacttgcctgtctctttttcctctttgcctgccctctccatttttttctatgag

SEQ ID NO: 13279 - DNA, 201 bp, Homo sapiens
tattttacacttcggttgtgtgcatacacttgtgtatttgatgttttatgcaacaaaagtgtaagaagttaacataatgagttggaaaagaaaaggttcaygaaaggcaaaacagcagtctctgatttgctggagacaacaaccactgttaataaaagagggcagcggttataactgatgttagaattttcctgtatagct

SEQ ID NO: 13280 - DNA, 201 bp, Homo sapiens
taactttctgccaagggttttggaaatcttttttgttcttgaccactagtcatcagaactctgccctgtgctccattaaaaacttaaaagcctcatcttcragcctagtctggtcttaaacacattctgttgatcacatcaaacctatgttaggactggggacccaacaactattggattctattcaaagtttaggacaat

SEQ ID NO: 13281 - DNA, 201 bp, Homo sapiens
acagttacaacacatagactattctattaggttgaagtgtatgaaaccactatttttgtagatcaaaatggttaaatattagcaatatcacatggttctaygatgacacacagatttacagcatgttgttatcaatggcacttcgaggcccagactagaacctcagatattctccaggtcttcaaataatcaaactgcctt

SEQ ID NO: 13282 - DNA, 201 bp, Homo sapiens
ggtctagtcgatgaaagggtcctgagggcagacgaagtgtgaaagctcccaggagaattcatagagatgcccttccaattaggatgtaatatttacaggayggaatttccaccagaactactaataaagtgctggctcttatttctaggcatctgaacagctgggagggaagtggggtcagttcttggctacccacgggtg

SEQ ID NO: 13283 - DNA, 201 bp, Homo sapiens
gcttttgaaagggctactttaaaaaaaaataataaaaatctatttatgtgttgtataaaccacagtgtctgattctctcctgtttctcattcaaagaaagsgtgactgctaaatgatttctggctctgtcatttaagaagactgcacagcagtggtcttagttgggaagttgggaccacaataagagtgctattgtaacac

SEQ ID NO: 13284 - DNA, 201 bp, Homo sapiens
cctgccaaaatctctctcctcccaggagatagctcccttttctccctgattgcttcctctcatgaggagaaggtcattggcgctcaccacttccagggcarccctttatgcaagcagtgggtgcctttgaaaggcaaaccgcagcaggaagactttgaaggcaagaagagactttttcatctttgcaggccccagccagaa

SEQ ID NO: 13285 - DNA, 201 bp, Homo sapiens
gcatatccagtctctccatggactggccttcacatatgctttgctatctggtagaaatatctgcccaaaagattattttttatggaaataatagtgcacakgcagattctagatattattttctatttatcaactgcattcaggcagtgctaagtagatgactgatgctgaaattttactagatgatctttgctctctatt

SEQ ID NO: 13286 - DNA, 201 bp, Homo sapiens
ctgttcagtctatacgaattttcaggctgtatagtttaaaaaaaacattgttcaatttcttatacgtttttactagtgatattactttagaaatgggcctygaaagactcaggttacttttagatttgttcagggtttaaagcttcttttaggcacttcttgggcttcttctacctttcactgtaatatagtggtgaagag

SEQ ID NO: 13287 - DNA, 201 bp, Homo sapiens
cacagctgatactcagtctcctatatttcttgtaatagattccctgggactggggagtttctgcgagactcagaatttaaaaggtgcctcaagtcgaactrctattattgcagtcagaactgtttttgctctcttcaggaacagccttacctgtgttcagggactattgtgtggtatcatgctactggtctacattaccaa

SEQ ID NO: 13288 - DNA, 201 bp, Homo sapiens
cattagagagccaacacttcaactttgacctaaattcattcttttcccattccagagaacacgacatacataatagctttagttctgagaatagagtctgmatttgagacaaacgtagaaggaagtgcccagttaattatccaaatgttggactctacctgtgattatccaggcgatttgatgctttacttggaaggattt

SEQ ID NO: 13289 - DNA, 201 bp, Homo sapiens
ctccatgtctacagaagaagttatgaggaacaaaggtatatgcagggctcgttttgtaatgctgacaacagcaatcctcacatccagacttccatgtccaygtacagggttctctactttcgttctaagtcaaactgtgattcagaaatgagccatccattctcccagaattcctccattcaccccacagacacaaaaatc

SEQ ID NO: 13290 - DNA, 201 bp, Homo sapiens
aaaagaataacaaaaaataaattcttactacctaattccagacacagatcattactaccagtagtatgttaatcatgcttgccattccttctccttcgatrtcattatgctttaggatagaaaaggtgggtggtatgtgagcctccttggataaacaaaacgttggagtgcacaggcttctcaagaggtacaatgttattt

SEQ ID NO: 13291 - DNA, 201 bp, Homo sapiens
gctaatctgattcatatctctacctagaagcacttaaagaagctgtcagatgattcccacagtgacaaatttgagtcccaaggagatgatggagtgaaatyagacacattttgggaagaaattcctactatcttttcaaaggataaactcccacagtatttgtgccaatctcttttacagcattcctatctcaaaaaccag

SEQ ID NO: 13292 - DNA, 201 bp, Homo sapiens
tatggatgtgataacatggagcggagaggtgccataatgatttcctttcaaatggctgcctcaccatttatctttgcacactgtcaaagactgatattgtygggagttagcagtggcatggaataattaatctcgtacgggggaagtaagttcttcatttgtctcctgagaaattagcactgcattgacagcaaaagtaga

SEQ ID NO: 13293 - DNA, 201 bp, Homo sapiens
ttgcattctggggaattggattcaatttaaaaagttgaagctgcttgctggcttccttcctggtagttttgaatgtgtaatctcacaaagatcttcttagytctggcaaagctgagcctgtctaaaacatttatgttagaatttacatgagttcatttgtgctggcgtcaaacatttcttgagtatttaccatgttattgg

SEQ ID NO: 13294 - DNA, 201 bp, Homo sapiens
aaaaaaaaaaaaaaggagaatccagtaggaattcattgagtaagccaaggttacaatctgctggacttcagaggtagagttctagatgcccattttaccamcctaggtcagaagtggggagcagagagacagaaggctataagtgaggagacagtactgagacactaagtagacattctagccaactctgtagaggattct

SEQ ID NO: 13295 - DNA, 201 bp, Homo sapiens
agtacatttgggaattggaagatcaacaagtcagtaaatattggtcacatgaagaaggggaaataaatgagcattattgaactataatatattgagtcttsttatgcacatagtaggccaaaagttttgttttttgcataagatctgtagattcattcattcaatatttattgtgcatgcaatatgtaccaaatacagaaa

SEQ ID NO: 13296 - DNA, 201 bp, Homo sapiens
cataaactggaaaatgtgtatagttgaaaatgtttgcataccctctgtcctagagcagtgcttccatcttagctttgaagcacagagacctcctcttactraaagatcatgaaaactggcaatactgtattgcccagtgttaaaatttgtcagattaattacccagagccaaagttagcaaactttttttctgtaagggct

SEQ ID NO: 13297 - DNA, 201 bp, Homo sapiens
aatatctccagagaggcaagtgttgaaacttcatgcttgtttttttgttctttttttttttttttccaaagataacccactgcattcactatcacccacarcattctcacagttcagaagaattctattaaattttttatacactgtcttttttgatggcagtgagccccttttgctggatatcagccctagaggcatgaa

SEQ ID NO: 13298 - DNA, 201 bp, Homo sapiens
gtaggaacaaccaacctactctacaaggttttactcttcccttgaaattacacttcaaaaaaacatgcactgactccccccaggcatagaagcaggatccrtgttttaattctaaccttaattaaatctttacacaaactcactatttggctgtccaatgaagaagggcaagtagaaggaaggaagtgaagagcatttgct

SEQ ID NO: 13299 - DNA, 201 bp, Homo sapiens
ggaaagtggtcattttcagttctgaaggtgagagttttgaggtttggatgactatgaaataacccagtgagaatacccatttatcagtgggaaatcctgarctagagtttgagagagtctgctaagctaaagttgtggatttgcacgttagcctcctgaagaggatggttgaattcataaatatggatgatactctacaga

SEQ ID NO: 13300 - DNA, 201 bp, Homo sapiens
ggatgccattgtctttttttaagcaaatacttgtagaagtgatgtctaaaagaataaagcttctcttctatatctccaaatagaaaatataatcaaaatcygcttttatgtaggatggcttttttaaataaataagcagaaggatgaattatgtggctataaataaatctactgacatgtaataaagcaaagtcgaactgt

SEQ ID NO: 13301 - DNA, 201 bp, Homo sapiens
gtttttttttaatttggagaaatttttaaaaattaaataaaaactagaaataatacttaatgtcttgacaaagtattaacttgatctagtttcagaaagakctcattaaactgcctgataaagtgattattcagtgccactttcatagagttttcagtaattatctgaaatgatttttagaatgaggcaacgttttccttt

SEQ ID NO: 13302 - DNA, 201 bp, Homo sapiens
gtgtaaccagtttctgagctaaaggaaaattcacttaacaggtagagaagaatagatgtgagtaggcaaccatacaatagtgtttgttttgaggacaattwtgagtaggttttttagatacattgtatgtcacttgcaagtgtataagcagagtttgctatttttttgagatattttttgagtaactgtcatttctttgtg

SEQ ID NO: 13303 - DNA, 201 bp, Homo sapiens
aaccagggtagttgggggccattgtgtattgagcactgcccaactcaattcacttagcttgcaatgtgaatggcttctctcttctagaggtgctcaaggtrcaacccacataatcacacctgatagccatgttgtcaatgcccaatcacattttaaacacttggagggcagagactatgacatagagaaagatttgaatag

SEQ ID NO: 13304 - DNA, 201 bp, Homo sapiens
agtacccaagtctcactactgaggcgagtcaggggtaaagagtttagcactgagtggctgaggatacgtatcaagggaaaatgtcatccttgggacttctytttaaataccagaatatgttttgttttgttttgatttgttttcctatcagggatgtgtctttattggcaatccctaatggaaattgctctctaattttcc

SEQ ID NO: 13305 - DNA, 201 bp, Homo sapiens
tattttttatttctaataagctcgtgtcttgagcagaaacactaatacccaggaaattttctgaggactggctcacttaaaatgaagggaagtcactccaygctctgagttgtcttctctcatcttcttcatgtgaaatcctggacacttgcagattcatgacaattcagagattattaatccaattgcttttaataaaga

SEQ ID NO: 13306 - DNA, 201 bp, Homo sapiens
gatagttaaccaaggccatgggcttcgttcacctagaaccagcctaaaattaaggatgctggccagagtacccaagtgtgatgcttgtagcatttaagcayacagataaattctttttgaaaaatttcaaacaagtgtaccatgagcggagtcagagcccctcttgaaagcaggttggtaaatttccagaaccacttagca

SEQ ID NO: 13307 - DNA, 201 bp, Homo sapiens
caactctccctgatcacagagcttccctacttggccataggatagcctcatgtgcacttagctcaatgttactctgagtttctttctactccgtctttctygatataatcctaaaagttagggattcccaggaattatcatggaacaactggcttatgtcttagtttcctatcactgctgtaataaatcacggcaaccttt

SEQ ID NO: 13308 - DNA, 201 bp, Homo sapiens
ctttttaaaaaataatcactgcgatactgttcatcacacagaaacacacataaattgtttttaaaggaagaaaaaagggaaagaggaaggagtacaggcgygtgtttggtaaggtgtcaagggtcataggtccttagattctactcaggtttttcttcataaagatgccatttctattggaaagtgatggctctgcctctg

SEQ ID NO: 13309 - DNA, 201 bp, Homo sapiens
gaggaaggggaaaagggtttagaagagctggagaagggagcatattggggaaaagttgaaggattgctaagtagctgaggttgagagtgacagaaccataytgtagttgcatttgttggcatagatggggttttggtttctagtgcctatctgttgctcaggagcaggggaagtggttgcttagattcctcaagatagaga

SEQ ID NO: 13310 - DNA, 201 bp, Homo sapiens
tgtggccgggtctagcaaaaccattcattctttaatctatcacctccccttatggttactgctcacatgtctatctctcctcacccactaaaccctggctsggatctttgggactccaggaacttacagggtgcctagcaagtagcaggtgtttttttggtgtgtgtgtgtgtgtgtgttggtgtgtgtgtgtgtgtgtgt

SEQ ID NO: 13311 - DNA, 201 bp, Homo sapiens
aaccagtgaccattcatcacagacacattttctacttcataaccaccataggtggacgaatcagagctagggagtacaggagggtgcagggaatataggawtgtcatttgggaaggtgtggtgggaagaggagatgtctaggatatccactgggaaaagggaggaaatgtttggaaatatttgcagtagatttagaggaac

SEQ ID NO: 13312 - DNA, 201 bp, Homo sapiens
agttgacaaaccaggtaagattgatctaggggtggtggcattttcccctgtgccagcacacttcttcagctacctcctgctgttttattttctcatactgrtgggcctgtagttttccagagcgccactgcatttaaatctgtattctattttctctcctagaaaataggtcagactcaaggcagagttcaccaggtgggg

SEQ ID NO: 13313 - DNA, 201 bp, Homo sapiens
tggctcagcaacagggatctgaaactgctgatgctctattgagacctgaagcacgggtgatggggaaaagcaggcatcttctgatgcatgattctcccagsaaccagaaggccctacaacctctggctgatctctgactacagtcttgactgcggctcttgcccatcctagggtcactggaatcagatgtccatcttccca

SEQ ID NO: 13314 - DNA, 201 bp, Homo sapiens
ttcaatttagctatttctatgaaggggtgaaaatccctaacctcttgatatgaatttagcattcaaaggcacctgagatgaggaaggcagaaagtgttcastataatttgggtctgcttcctgatttttctcaggtttggtcaagaggctgaaaagcaaatagaatgcaatggcaggcacacacacataaggagcttattg

SEQ ID NO: 13315 - DNA, 201 bp, Homo sapiens
gtcattcatatttcagagtgctgctgatttctgtgtgagtaaatgagataacagatgctaaagtgggatatgaatgcatagtatgattatgctgcaattgmctctcattcttttaatcatacattttgactgtatcgttttaatttacggaggcaccctaaggcctaataacatataatgcagcatgcaggaaatcaaaca

SEQ ID NO: 13316 - DNA, 201 bp, Homo sapiens
cagccaatggcttccagataaaagtgagaaggccaatatagagctggggttaaacatgtcaagaattcaaagctatagtgcccctgggtattcaaaaagcrtaaagatttgactaaattcacagccaaatggcatttaccccaggtctaccccataccagtcactggcttctctctaatagttgttatcccttttaattct

SEQ ID NO: 13317 - DNA, 201 bp, Homo sapiens
cagactccctatgctcattatcaaaaagcccatatgctatcttcagttcacattttgctcacctctttctcttcattgcattagtcaagttcagaaactaractgtcagctgccagacaggctgctgtttctctcagagataggtgaaaaccatttaggaattcattatcaaagtgtacagcccaagaaggtgtttttgcc

SEQ ID NO: 13318 - DNA, 201 bp, Homo sapiens
cctttgcaccatataatctgttttctctatgggtaaaaatcacattttaatgatggggtggaacttcctttattccaaaactcatttgtagtcggggttgrgcacatatctaggtctgataaatcagaatagcctattcttctgtccacagctatttatttttaatgttttcaagctgattttacctttctgctagagtca

SEQ ID NO: 13319 - DNA, 201 bp, Homo sapiens
tacctgaatgatgcagctttttgaaaaagtctatttgtaggtcattaacaaattgagattcaggaaatcattgtatggtttaaataggataaaatttttcrctagaatgcttgatctctggggattcccagaagcccattcatgaaagtggttcattcatgcaacaaatattttaacaaatgccaagtatgttgtagaatt

SEQ ID NO: 13320 - DNA, 201 bp, Homo sapiens
atgtttatttggctctccctggccaaccccagtaatggttgggtacaaagaggaattggggtagataatgttggccataaaggatatgtaatctggttatrttggtagttctgctgtcttgccatagaaaagggagccaaagggttttaactagagctctgtcaccttgggagaaccctcgggaaagaaccactgtccagg

SEQ ID NO: 13321 - DNA, 201 bp, Homo sapiens
aataagcttcaaaaatggtagctggcatcatcactatcatcacccccatttcaagggctctgggagtttcctggtatgaaacagtgataatgatgcttacwgtttaaggttatagaattgaggagactatttgtaaagggcctcttgcgatgacaggcacgtaatagagaaaaaataagtattggctcctttctctctcct

SEQ ID NO: 13322 - DNA, 201 bp, Homo sapiens
aaacttttcccctttgaagggtactggatgattaatttaagcttctctttataggcactactttccttgctcatttttctcagttcagtgggcacacaagrtataacttaaatgtttatagaagacacccattaatataccacttgcggtgccaaggacatgcacagtagttggctttgtggacatccatgtctgtagaaa

SEQ ID NO: 13323 - DNA, 201 bp, Homo sapiens
gagtaaaaacatcccagtatttatagactattaggggagagggggttggagaggcaggtgacttttcagccctacactgatgacttttatgtcttccaggycacattaaaatgttttgcttgaattagaataaaagtagtcctttttgtccactctaaattcagtgtcttggttgaaagtatccacagaaaacattcctca

SEQ ID NO: 13324 - DNA, 201 bp, Homo sapiens
actctctggccaaatttgaaggggatagtactgtagctgattaaatatataatctaagaactgtggaataaagataggattaaaggttttttaaatctcaratcagtggggttgatgctctttgtgtttctgttctttttgttattgttttctcttgttattttgaaatttctctaaaaactacttaaaagtatagttagt

SEQ ID NO: 13325 - DNA, 201 bp, Homo sapiens
aaagacctactcagtgacagatactgaacccaatgactggtttgattcctaggaatgtgagtgatattctcttcctgtgttttctaaaattatttgcctartgaatatttaaacaaattcacatgttgaacatcatagtgtttcaaaacagcccctggacttggtatcagatatattgagtcaaatccagagatgctgtgt

SEQ ID NO: 13326 - DNA, 201 bp, Homo sapiens
tacagaactcacccaaggttatatggtctctcagtgacaaagtgaccataatacctcaggcctttaccaagttagtattctctctaagacactgcatgacrgagtccatagtgatttcaagttagcccaggggttaaaactaaccatagtacatttgaatacggattaacatttggtgtgtcctttgaacaaaaggttaaa

SEQ ID NO: 13327 - DNA, 201 bp, Homo sapiens
tggcatatatgaattgttttttttttctttctcccaaaggcataggttaggcatatttactgtctttgccaggccttttctcactttttaagacatccgawtgtgtagatttccttccttttcaacatttacattggaagatgaacatatttagaatgagccaaaagaaaaaatgctgcataaagcagtgttgaaggaagt

SEQ ID NO: 13328 - DNA, 201 bp, Homo sapiens
cttcccttttgtgaagaaaattcaatttttatgaattagatttttaagatggcttgtaatgtacccatacagccaggtataagaaattacctggtagcttsactgatgcagatgacagatacctgtggggacttacagtctagttgggagagtaatcacacacatacacacacacacacacacacacaccccagatttggc

SEQ ID NO: 13329 - DNA, 201 bp, Homo sapiens
taacatttccttaaaaaaccacttccctaaaataatccttgaggaaacatatttgtcagaaatgttcacatcatattccttttgttctggtttatctcatyctccttgacttctccacatctctaagtaggaagttatttattgctgctgaagttgtaaccctggtgatttcgctatcaacttacaaatcacttcctttcc

SEQ ID NO: 13330 - DNA, 201 bp, Homo sapiens
attaacattctctacttagatccagcagtgatagtttaagcagcctcaagagaatcaaaggatttttttttgtgatcaatatttattacttaaactataaragagggaaaaatacatgtaatacatacaactaatatgtacccagttgcagatcataactttcctagttattaaaaatgcaggaaagttaatggttttgag

SEQ ID NO: 13331 - DNA, 201 bp, Homo sapiens
caatgttcccaaactactatgtttgtgttagtcattttccgcttatcttgtccccaatcataaaaattaagcgatgtacaaaaattgcctaaagaacagaygccaccttatagaagatgttttaaatagcccgtacttgtagcagttctgccttcatagctaatattctccacgtctttcttcacttttttctttcttatt

SEQ ID NO: 13332 - DNA, 201 bp, Homo sapiens
taactacatatttatgggtctctctccttaggcgtagagtatgtgtctggagaacagatgtagggttctacagatccttttattattcaatcattcaaaartcacatgtcaatcatcctcccatatgccagttccttccatcagtgagtgaatcactctctagtagaagagatgggcaaaccagaaattcagaacattaca

SEQ ID NO: 13333 - DNA, 201 bp, Homo sapiens
cccccctagtgtgtccaatttcagctagtttatagaaatgatgtaaagaataggtctggctcacaagaaatcaaaagcaaggatagaaatattcctcaacyttgtgtttatcatttattgtaatgtgattgtgttcttggaaaagcattaagttcgggtgacagttaataataattgattgatctatgtttctattattaa

SEQ ID NO: 13334 - DNA, 201 bp, Homo sapiens
ctccatgctcatccactatatgctattgcttcataggaataggaagctacagcttgaacctggccagaattttccataactatatgtccttcgtcactctragagctggtttgtagactgcttgttggccatcagtgcaatatggaagtgaatgtgtgacaaggaggcaaggcaacaatgctgctttagggagggtgctgg

SEQ ID NO: 13335 - DNA, 201 bp, Homo sapiens
gttaaccaacatctttttttcttatactaagagagtgatttgtcactagttgtcaaaacactgcatagaagctcataacatgtaaatctaatttttgtgcktatagggaatataagaaattttatttttatttttttagagacagcatctcgctgtgttacctaggctggagtgcagcctcaaactcctgggctccagtga

SEQ ID NO: 13336 - DNA, 201 bp, Homo sapiens
ctggtcaacaaagattatctaatgtggttgatcagcttttcactgtcccgttcattcttatgacaatttgccctaactatgcacaaactgagaactctttytaagggtaaataaatgttctcattcatcctcacaattgatttaaaatattgtaacattttctaaatatgtacaaacagaaagctatctcatagttcttgt

SEQ ID NO: 13337 - DNA, 201 bp, Homo sapiens
gtttatagtaaaaaaacacgaatgtggataagcttgtgaaagagtaataaaaaagaaataaagaataagaaacctgaaatgatagaggaagaccaacatamcttaccattatgagattttatactaagtcctgaggcaatgatcaaagagaactagagcaggagactgacatcttgtttctcatcctagtttatctatcat

SEQ ID NO: 13338 - DNA, 201 bp, Homo sapiens
aaaccaggaagaacatattccaaagtgtttaaaatagttatatctgagcgtcggaattatactattttaaatacacttttaccaagtttcctataatgagyatgcgttctatgagaaaagggctaaaaatagatgaaagttaaacattagtcactaattcatctcataaacctacttactcctgggaactattaacttctg

SEQ ID NO: 13339 - DNA, 201 bp, Homo sapiens
ttatcatagcatgctggttctcagaccttttctgcacactgctaacatccttctcacctttctttgcttggctttttttttcactgcaagctctcccatgytcatttctcatttgccatcagatttagagtaactggcttatggcatcaaagaatgaatcagatgggagcagctaagtaaactgaatgaagctgcttcctt

SEQ ID NO: 13340 - DNA, 201 bp, Homo sapiens
attttaaagttgaatttctggctattactaggataattttttctcctggacattttatgtatttatgtatctactttggtcagggtgacaaatggtatgtkgtatgcagagcttaactactactcctagcccccaggccccataatcttttagtggattcagccaagcagaaatgtatgttgaataaaaccatgtccaggg

SEQ ID NO: 13341 - DNA, 201 bp, Homo sapiens
tctaagagtatcccagagattggttctatgaatctagtgaaacacagaataccctactcttcacagatgggtgtttatttgcatgagtccataggcatgtragcttttgttccttagctggaggattagagggaagaaatgacataggtgattagggatgggggagagctgggatgaatatggagaaaggttagagaatgc

SEQ ID NO: 13342 - DNA, 201 bp, Homo sapiens
ggtttccatttctacatggtaggcattctctagtttacttttcctcttctttctgtagaaattaactatttttgcttcacagtcatttcatgatagacccratttcttacactgaaattcattttaatgtttggattgagcaatggtttgctttggtcttaacttttatttattgaggtataacttacatacaatgaaaat

SEQ ID NO: 13343 - DNA, 201 bp, Homo sapiens
tagtacattctgaaatatgtagcaattatttctctatggcttcataaagaaaatgtcaatccaaggctgaggatttatttatgaaaatctaaagacagccrgttttcctgatggttcatgccgtgggggaacgggtctctttcccaatatataagaggacaaatcttgggatgggttttttttttttttggtcttttatga

SEQ ID NO: 13344 - DNA, 201 bp, Homo sapiens
tatatttttcatgcagtcatttcagtcagtatcaccatctaggtttcctctagggaccacatatcaatgactcttaaaatcactgttgtgcaaggtgagtkggaaaggaacaggatggtagagtttggattggggaacagactttgagcactgaacagcaggcagcattgctgttggcagagtaacggagaaggcgctgag

SEQ ID NO: 13345 - DNA, 201 bp, Homo sapiens
agtaatttgcccaaggtcagtcaggtctgacaccaaagccaatgcttttgttccctcacatcttctcttttctagacacatgagccagcggagttgatttkcatggcagctgtgcatgatagtttcaagcctgggcaactctatgggtattcgccacaaggcttccgtgacttctaatgaactgaaacaaagcagttagcc

SEQ ID NO: 13346 - DNA, 201 bp, Homo sapiens
ggagaacattttctattccacaaacattgggtgtctcataagtgcaagactttggagaaataaagaatgaaatagaaatttttctgctttagaggaacacrcagtctggtactgttcttaaatattttcagactacaagcggactcacttgcagcccagttttttacaaaaactttagcatgctgattggctagtacagtt

SEQ ID NO: 13347 - DNA, 201 bp, Homo sapiens
gcagccaggcccccactacaggcccacccagcttgatggcctcaccctgcatcttgtcctgtctctgaactgctaaatctcaaaactttaaagccctaatrtcttgctgattaaccataatttccaaatcttatgcttaagtccaggcagtttttaatttttttttattttttggcttcagcaaatttttcatttgtctat

SEQ ID NO: 13348 - DNA, 201 bp, Homo sapiens
ccttaaaagaataacaaaaaataaattcttactacctaattccagacacagatcattactaccagtagtatgttaatcatgcttgccattccttctccttygatatcattatgctttaggatagaaaaggtgggtggtatgtgagcctccttggataaacaaaacgttggagtgcacaggcttctcaagaggtacaatgtt

SEQ ID NO: 13349 - DNA, 201 bp, Homo sapiens
ggttttcatgcctccttcccctttgttttctcctttgccaagtctccattctcactcttttgtggatgtgtgtgttatggagacgaatgaaatttcagacrcagcaatgaattgccacctaaaaggatacaccccagggtcttctgtgttcctttgcagctgtgtgataaattgccatctccaaaattaattgttaccttt

SEQ ID NO: 13350 - DNA, 201 bp, Homo sapiens
ccttattcccaggagttttgtttttatttgttcttgtccttggagggaacaaaagacagctggtagctgttccctgtttggttttgcatgtattcaaaagrcatcatcttctactgctctcttactcctttactttgtggtcatttgttttgcagctatttagacagttacttcttaaagaacccctaaaactatttagac

SEQ ID NO: 13351 - DNA, 201 bp, Homo sapiens
gtatttaatcattcggagcaataattgcattgtaaatattagctcagctgataaggagtagagaaccaagagaatgagggagccgttacattgttttatcktgtttgatgcctttactcagtgctctagcatgggggccatgtctagggagggaatccactgcagctacatttaaggtcacctaataaaccgtgctgtttt

SEQ ID NO: 13352 - DNA, 201 bp, Homo sapiens
tgaagtagaaaggctatgtttgaagattctgtctgattttgggcatcttggttctagatctatcataggtgcagattaaattgtttccaggctgtacttgrtagttggtaaggatcaaacaataccctcacataacttgtcctagaactggttgtgctatggcatcattgtagtcccacatcctagcatggagcctaaaaa

SEQ ID NO: 13353 - DNA, 201 bp, Homo sapiens
aaaattcagtgtttttcactgagcaaaatagcttgtctggtccaaagccagtaaaataagaattttgtgggtggggtatctactccattagtatagcaaaygttgagatatataaattattttaatatatttattttattgacaatataaaaaaaaatttaacaggctccacaccaaggtcaatagaattcagaagcacat

SEQ ID NO: 13354 - DNA, 201 bp, Homo sapiens
ctttatcctgctctagtatatgcattgtggaaaagaagaaaaagaatatgctggctattgaggatgggtagaggttttagggagtgggtgatacgatttgyttgaattcctatgtagtctgctgtctttagtgacaatgaataattactgttgggtgacgcttatgagcccaacactaattttaagattttatagctaatg

SEQ ID NO: 13355 - DNA, 201 bp, Homo sapiens
ctatccaactccattacccaagattttttagtaggttggagagcgaggcaggggaatccataaaatcaatgtatgagtgtatatacttctatctgaaagtytgataaatctcttctatatgtaacacttttgagtaactattacatgtaggcactagaataggtgctgggaaaacaaaagtattttgcttcagaaatatcg

SEQ ID NO: 13356 - DNA, 201 bp, Homo sapiens
gctctatttggtatcttaaaattgtttccagccagtgggaggcctgtaccctagaagaaaatgagttgagttagctccaagtagtaccagtggtatttgcmtctttttaaaattccttaaaaagcatttaggaaattagttcttttccttcagcaaaggggaaataaggtactctcaagtgactatggtagagtttggtta

SEQ ID NO: 13357 - DNA, 201 bp, Homo sapiens
aagcacaatcctgccaaaaaggggtatgtatgcctgattttaaaatgctaactttaaagaatatagatagcttttatcccaaactaaagaaaaattctggrgatagcataggaaattaggattttgatggattacaggttttgtattactctgctcataaccctttatgactttgggttatttgcttccatgaatactttt

SEQ ID NO: 13358 - DNA, 201 bp, Homo sapiens
tctgctcccatcctgagatacacatggccccaacacagagtgtttggcagagacatcatttgattagagaaggcatagctttctgtattgtgaggagtcaratatgaacagtgggaattctggagggcacagagggaagaattcgaaagaggcattgggaggcagttggctacccagggccagagagcagctgctggagca

SEQ ID NO: 13359 - DNA, 201 bp, Homo sapiens
aattatagagtggtgtatgcattaaaggagacatatgtgtaacagtggtctctatgggtttattggtctctcttcacatatggcagagaaaagaccctgtraagttcaggagtgtgattaaggtactccaagaagtcacacacaggaggtccagggcttttactggactcactgttcttggactggctctcctagcctggg

SEQ ID NO: 13360 - DNA, 201 bp, Homo sapiens
gcaaacagtacgggggtcatataattcctcgattcattttttcttcagcacagttaaaccattccttattttttcaattcagttttatcttactgaattayttttaacaagatcaattctgctccatatgtattctatagtgaagatttgattcatcaatcagttatttttcgtgtgcctatcaaattttaccgacacggc

SEQ ID NO: 13361 - DNA, 201 bp, Homo sapiens
ccactgcatttaaatctgtattctattttctctcctagaaaataggtcagactcaaggcagagttcaccaggtggggtcccagaaggtttgactgggactygcctacaggaggctggctgtgcagcctgtcccatgctccccagagctcttccagaggcatgggggagttgaagtagcaagtcaggagaatcttggactca

SEQ ID NO: 13362 - DNA, 201 bp, Homo sapiens
ctaatcctcttatcttgctgtcatttatcttcctaaaagtgaaaataaagcaaaattaaaattaaatcgggtcatgtagctcatctgttccaaagttttgsgtagattcttcttgtataattgtcaaggtgccttccctgctttattttcagtgggcataccccctctgcccacctatcacccctgccagctcccccatct

SEQ ID NO: 13363 - DNA, 201 bp, Homo sapiens
gtgcagttgagtagttgtgttaaagactgtatagaccacaaagcctaatctgctttgctgcctcctgatctagaagatttagactaggaattcaagtagayagaaaaccggtgttacaaggtttagaccttacttcttggcacaccccactcattccaagtgggattttagctgttcgctccaactttttgcatctcgcct

SEQ ID NO: 13364 - DNA, 201 bp, Homo sapiens
ggcaggtaggaaaactgtactgctgcagtctttgtagattagctcaattcagagacacctgtggtcttgtgaaatgccaaactttactccagtggcatttrggtcaatgtgaactaggatgggcctagcaattctattaggtgaatgacaagtgctttgtaatgaaacagaaggactttatttaaacagatataaggactg

SEQ ID NO: 13365 - DNA, 201 bp, Homo sapiens
ccaagttctagtgtctttgggcagcaagtccctcaacagactgtgagctccatgatgggaaagaccaactattgttcactgtgatagttgaaaaaatgaaygcatccaaatgcttttggattccagtttctctagagatgtcttttatgtgtcatttttgtagtttggtctcttctcaatggaataatagatactaaatat

SEQ ID NO: 13366 - DNA, 201 bp, Homo sapiens
ttctacctctgccagattaattagctctgtgtgatcttgcacaacttctctaagccttaattgtgagaattaatattgtatttattaggagtatggcacaygataggtacttattagatgttagctatcatcatcatcttcatcataatttgattttgcttttcttattccctttgatcttgcctcctagtctaacaggag

SEQ ID NO: 13367 - DNA, 201 bp, Homo sapiens
tggctgcccaatctataacgaatattctatctacagggcaataagcagaaaaggtgatgcagagcagccagccagatactatcatcctcatttctttaacmtgtatttctagatccttttttgctcagaacattgttatggcattcctcagaacgcttttagtctctctctttctcttttatacttaaaattctaaaccag

SEQ ID NO: 13368 - DNA, 201 bp, Homo sapiens
cacgcaacaagcggcatgttccaggttgttccagggccagagagagtgacatgaggcaatgtctgtggcaagcgaaaaatgtgtgctgagccttgggaggygccgattggctggcagtgaggtaatgcaatgcagtccaaatgtggaagcagcagtaccagcatcgagggcgtgcctcctcggcaagcctgagtctcctgc

SEQ ID NO: 13369 - DNA, 201 bp, Homo sapiens
caaactgtctctgtttgatattaaaatttgtaatggggaaacactcactggtttctaaaaccctatgtagatttaagtagttgatgattctgtgaaaaaamcaaataccttctagagaaaacatacaggttgggcagagcccaggtattgatgtccttgatgaaactggtttttgtattctgaatgttggagattgagaga

SEQ ID NO: 13370 - DNA, 201 bp, Homo sapiens
tggcagggatgagccaccggtcctcattttcttaattcctggacaaggtttttgtgtattctaaccaagtattcttgcttttctttgttctgattcattcrtctacaaagtgtggtcagaaaccttgaccaactgctgatatatacaaatatcacaacttctctaagtctgggatctcctaccacagttgagatatccaaa

SEQ ID NO: 13371 - DNA, 201 bp, Homo sapiens
ttgcccagtgaagtgtaaacctcactatatccaggaactatatcaacatctaggctgaaccagttccaggcaacccctgaaaaagtagttcaaatgtattyctaaaagattatgcaatctcttaaaaatacaggttgaatccttctatccttctcagtaaaattatgcaatggttccccataacttatagaagttcaaatt

SEQ ID NO: 13372 - DNA, 201 bp, Homo sapiens
tgttctcagcctgtaggacaaaataagaggagcacccaaagagtgctattatctctctgcaggatgttacctaggcttctgctggcttcagagatttcatygtcatttctgatggaattatggtaggcatagagcccttcctcactgggatttactcctatttggatagaataaaggtatagactatgcactgtctagtga

SEQ ID NO: 13373 - DNA, 201 bp, Homo sapiens
atcagaaactgggacagaagcagctattatgcctcctgtccctgtcaggactgggtcaggaatgagggcattagggcttttgtgtgtctctcagattaaaytctgctcacttgaggttaaaacaaggcagaagctggcctgagataatcaaagcctctttcaaatctatttgcttataaaggcaaggtgtttttggtgtct

SEQ ID NO: 13374 - DNA, 201 bp, Homo sapiens
caatcgatgcatgcccatttaaaggattgtttttgaacactggaatctgtcagttcttaatgcaaatgtagcatagcaaggccacatcttcttctggagcrggagttagaatccacgtgcagatgttctggacaaatggctttgcttccagatttgcaaaatgttcttgaaaacccttatccctataggcacagataccat

SEQ ID NO: 13375 - DNA, 201 bp, Homo sapiens
atccgctgacctggtgttttttattgaagttgtcctctatgcagatagtttaaaaacaagagaaaagaaagaccaggtggtaaacctcctattccttgtcwggagaaatagtgccaagaagccatctgggcactccagggcacatgcccacatcccctcattctttctagttcccttgctggagtgcatagggatggggca

SEQ ID NO: 13376 - DNA, 201 bp, Homo sapiens
cctagaactataccagagacagaataggtcttccatacacatttattaaatgattaaataaggaataatgtttcagttaaaatgtgtcacagggaatgctsaaaatattcactggcagggctggtagtgaatgcccaatctagagagtaccagtgcatggagagagagacagaagaggaagttccatcttttgggggttgg

SEQ ID NO: 13377 - DNA, 201 bp, Homo sapiens
gaaaagatacactagatgttaggtcactgagatttttctgggtcttcctaagggccagcttgacttagctggcagagattggaaccaaacggcctacattrtcttttccattgtcttgtaacatctaattctcttgcttacattgttctctcctggccagccaatggctgggctcagcactcacctgttaggtttcttaca

SEQ ID NO: 13378 - DNA, 201 bp, Homo sapiens
ctgcagtgagcgaagatcacactgctgcactccagcctaggcaacagagtgagactgtctcaaaaaaataaaaaataaaaataagtcagttttcctctttycctatttgaataaaagtaaaatgagtttttcaagggtgtcattagctttatgttattgttctaactctgcctctatcagatattctttgaatgggccaaa

SEQ ID NO: 13379 - DNA, 201 bp, Homo sapiens
tccatgccgaatctcctgttggttgaagaaggtgaaagtcaattggtaaagtcactgtgatttataatgttcaaactggggagggattgagtcgtgaagascagaagtactgataatcatttagcttatttgctggaaggctccactagaccctaatgaaacaatctcatttatcttccccacatcctaatggaattgcag

SEQ ID NO: 13380 - DNA, 201 bp, Homo sapiens
attaagtccatagaagttaaacttccggagagctcccaagctaattggtaccccttgttcaggactggggactattaactgagagaattcattgggtgttktaatatctagccttttaaaatctattttaaacaaggactttgaaggatgactgaaatgtggttaaatttccacagagaacttacaactccagcaatggga

SEQ ID NO: 13381 - DNA, 201 bp, Homo sapiens
tgaatagctgggtcacttgtctttctcacacctccctgggagacttctctgtagaagacttcaagaaaaatccctgcaccttccacacctgttgtaggagrtatggcagctattcctgagccttaagtactccagtaagaatgaaatgaactatttgaggtgttctgccaaacgggctctaaaaataattatgatttaaaa

SEQ ID NO: 13382 - DNA, 201 bp, Homo sapiens
tttttattcattggccatcacattccaaagttttacagtcaaatggacagttaaatatttgtgtttgaatctgaccactgtgaatatctcaaggataccayaagagctgatggacctccaaacgttagcatcactggactgagagaaagctcgttttatatctctataggtactgtcataccaatgaagcaatgttcccaa

SEQ ID NO: 13383 - DNA, 201 bp, Homo sapiens
atgagattacctgtttcctcaaataatgaaccaattaagcagatcagataggactctggtatttgaaaacaggaccaaaatatataatgagattctaattytgatgggtgagattacaatttgtcaatcagaagagagaattacccatttgggctggagaaatcaggagtggtttataaacgtagatcttcagactgaatt

SEQ ID NO: 13384 - DNA, 201 bp, Homo sapiens
aagaactacagagctgagggtactataatgtgtctctctcagtcattattcttttatgaaaactttggaataaagctatttgtaaattgcactttcttttrccactaataattaaaaagcagggccaagtcacgaaatgccattatccagtaatttgattttttgaaattaatgaaacgctttcattttcagacgtgtccc

SEQ ID NO: 13385 - DNA, 201 bp, Homo sapiens
tttctcaacaagatgaataactcacttcttctttggtcaacataattctacctaatattctctgtaaactagctctggaaatacatgcggaccagtgcttsagatttttagtaaatgtaaaaggtatctgaatggttgtataatgctgctttaaaagagttttaagggttggaacatggtcactgagaaatacacaagaaa

SEQ ID NO: 13386 - DNA, 201 bp, Homo sapiens
tagaaatcatttttgttaccatgtttatagcaacacaatagtgaaataggcaaatgcatttagtcacataacttggttttcttgggccactgctttctttyctgtgggagtgggagaaggtacaagcaggagagacatgatgcctttggactgctctgttaccttcagttttgtaaggctcctggctccactgaccagatt

SEQ ID NO: 13387 - DNA, 201 bp, Homo sapiens
aaaacaaattgctacgtaaaccatcttgctactagctttaagctctagtccaggtcattctgcattttgtcaatatagtaaattgagtaacagcctctgasggccctgcaaagagccaaggcccaatttaactccctagtgccagggtctccaaatgtttttggttgtctatacatactagaaaaaaattaactctgcacc

SEQ ID NO: 13388 - DNA, 201 bp, Homo sapiens
atcagataatttacttcctactttctgtcctcttctaactatttttagttgtattacttctgtattgtcagggtttattccattttcattctggtcttcarcatattattcccattaggttagacatagttcttctttaaaaactatactctgtgcttaccttcaatttcattgtcatagttattctaattatgttttggt

SEQ ID NO: 13389 - DNA, 201 bp, Homo sapiens
ctagagctatttttgaggtctcttttattccttcattcctgatctgaaattcattaaggctaagagtgccccttaaattacgttctgctgtatcctggagraacacctgaagaagttaataataaaccctagagattaggcaagtggaaagaattatgaaataaaacaaagcaaagaaattgtgtaaacaaattaattaat

SEQ ID NO: 13390 - DNA, 201 bp, Homo sapiens
tttaaattagtttgcataagaaaatgtaatgccagggacaaatttctctctttatcccttcttatactacaaaacagacaaagagggttaggtggttgctktttagtatgcgagtaatcacttgggattcacagaaatattagatgcagtgttattagtgaaaccttagttccctttatagatatgtcttatgtcccattt

SEQ ID NO: 13391 - DNA, 201 bp, Homo sapiens
tttgaattaaaaagtgctcaccctactctttcttctcggctacaagttttgccatagtgcacagtgtttcttcatcttactttctttaaagaacctttccyatctcttcagttatttctacctgttccaacctccctcctgatagcaccccagtagtgggatggaatgtgctggaggggtttggccagttcttgggggagt

SEQ ID NO: 13392 - DNA, 201 bp, Homo sapiens
tgttgagtagaagtttggagaataaacaaattgatagattgatatttgaatccccggcagagtaagaggaataataagattttgaatcaagaagaggaatyctgccacatgcaactaggaagaaaaaagcaaattaactgtgataacactcattagggattatcattatatctttaatgaggaggtaataaagactgatta

SEQ ID NO: 13393 - DNA, 201 bp, Homo sapiens
ttgaatccccggcagagtaagaggaataataagattttgaatcaagaagaggaattctgccacatgcaactaggaagaaaaaagcaaattaactgtgatarcactcattagggattatcattatatctttaatgaggaggtaataaagactgattatttactaggcatcccttattgatccctatttatcactacgtagag

SEQ ID NO: 13394 - DNA, 201 bp, Homo sapiens
aatttctgaatcagccttaaactataatgcttaaactgtttaaatgtgaagggataaaatttggggcatttatgccactattttatgttatcgttgttacrgtgagtacaatttttaattggtatgtgtgtaagatttgctcagatctcaatcaatggttctaagaggaaaaagcttaattccaagctgcctctctcctgt

SEQ ID NO: 13395 - DNA, 201 bp, Homo sapiens
ctttctatagctttttcttgagatgaatttgtggaccagttgaatagtgatagaaatacaggacttgctaaaaattacaaagtgtttatggcagttctggyaaatatcctctagatcaccagataatgccaagtcagcaatattatcaataatgagttgcctactaagaaccaggggaatgggggcatggactgaaacttt

SEQ ID NO: 13396 - DNA, 201 bp, Homo sapiens
agatctggtagtttggtgagcagagttggcgtggctcatcagcagtcaccctttggcaatggaaccagaaaagcatcatgctgtctgttaaagaatgtgtytatgcttgtagctagtttcctaagatgtttgcctctaggtatttgcctgcagaaagttttttgaagtcaatacaaagtagagtggcaagcgatgcatcca

SEQ ID NO: 13397 - DNA, 201 bp, Homo sapiens
ctctgttagtcaaagtcaaaattgatcaatcaggtaagctgtaactcatctttttgtattttacagatgcatttataaagcatagtgagatgttttgcctragatttattgcacgaaatttgaatatggtagcaataatttattttatcctataatactgaaatcatatttggtctcttatggtacaaaaaagattcttct

SEQ ID NO: 13398 - DNA, 201 bp, Homo sapiens
ttcccagagccagatggctgaatcaagcacaacgggagaaaaggttgccttccttaaaagagatcattcaaataatccctcagctttccctcttgcctctsacttctcccaggaaaagtcctgaatgctgatcgtaaaagtgccaggaatggaagggacaacccttcagcaaagggccattgttccacaattgcactgtca

SEQ ID NO: 13399 - DNA, 201 bp, Homo sapiens
tagatattttttattctccatttcaaataaaaacagagacccaaggaggtgctatgcccttcctaaggtcacatagcaagtgaaggaagacctaggacaakatttttctgtttccaattgggcagttttcactattgctcccccagagaattgggggatgttctgaaaaatgcatagctagaaatgagtatttttcttctt

SEQ ID NO: 13400 - DNA, 201 bp, Homo sapiens
tagttctatagcaatcggaatcttatatcactaaattctgggaggtagaactgaaaagcaacttctttctttgaacctgaaaatagaaaagctaagaaacrggagagggaaataaaagaagaatcagcccagagctatcatccaggcactgacaaatgttccttataaagtctctgattgttgtccctatacaatgcggtg

SEQ ID NO: 13401 - DNA, 201 bp, Homo sapiens
ctaaccttcccttcaaaaggaataaaatataccaaagacttgtaaagacaatgaatataaaggataaagatagatggatgattagacagatgcatttggamgtatttggaatgcctctttggagttatttctgtcactggggtggagagctgggtcatagcattcccaagtctcttttctggctctgtctactattgacta

SEQ ID NO: 13402 - DNA, 201 bp, Homo sapiens
tgggcaccactgggtttgctgctcttggatctttgctctaggaataaggagtcccagagatatctccttgtctctggtatgtaagattatttttgttagcytccagtcttgttgctcagccaaaagcaagggctaattctagcacgtatagttttcaaatcacttttggaaatgtaatatcacccacctttccctttccag

SEQ ID NO: 13403 - DNA, 201 bp, Homo sapiens
aaactgaggtaagaattgttttttttttttctgaaaatatatgatgttctatttatatataataggaaaacgacttcaagcagcaatcgtcacttgccagrcatcaaggcggatatttccattatgtctatgacaaggtggtgggaggggtgggatgtggtttcatacctttctggtgcatgtttgaatgattgtaaaaat

SEQ ID NO: 13404 - DNA, 201 bp, Homo sapiens
aaaaagaatgccgaattaatgttggatggatgtacatatacaagaacttgctatcagtacacaattccaataggaattatatatacacacactgaaaataraatttgattaaataattacactaggtacaagctacattttacttccattgaaggagagctaagtggaaactagtgtgagacaatcatgaatagaaaagtg

SEQ ID NO: 13405 - DNA, 201 bp, Homo sapiens
ttccatgaatcctaagaattgcacagtaaaaaataaaatctgcctaccatttaacagcccgcaatacaaaaatcttactgtgtcaaatgtaatatgcatamctggcttcccaatttggttttcttaaggaggagtaatttagttgtcattaaactctttgggaaaccgttttaataatgttctttggttatcaggggtatc

SEQ ID NO: 13406 - DNA, 201 bp, Homo sapiens
tgatacagagactaatgatcatttacccaaataaaacagataccattcaaagttagacactgagcctctggtaatccctgttcttctccttcatcttgagygagggatactgaaaaagactgggctggctactgtttaatcagggaatgatgaatacttttcattagcccaagaaaagttagtttctattccagaaatatt

SEQ ID NO: 13407 - DNA, 201 bp, Homo sapiens
tgagtgtaatgattcagcaaaacttcattataatctcttcagggcacctcctggaaacctgagaaataaaactgttttattactggtacttgcctttctcraaaactgatagtaaacgtcctgacaagttagtcttaggtatctttccttcagttcaatagcaaatgctgtttaaaagcaaatacacagcatttatagaat

SEQ ID NO: 13408 - DNA, 201 bp, Homo sapiens
tttacagtctttacaaacagaagccagaagtgctatatttgaacatctacatttgttgggatttctttaaaaaaaataaaacaaaaagaagaatcacattktatacgtgttaaatggtgtagtagtaaaccatgtttaaaaaagcttcagttttcattggtgtacaaagctgctacatgtaaatattggaaccacttttta

SEQ ID NO: 13409 - DNA, 201 bp, Homo sapiens
cgagattacgcactgcactccagtcttggtgacagagcaagactccgtctcaaaaaaaaaaaaaaaaaagaggctaagatcttggccacgttttcacagcrgctaacaagcagaatcaggatttgaacctaggccgtggagcaccagagcccattctaaatctgaatgcactctcaaagtgtcttgcagggaggtgagccc

SEQ ID NO: 13410 - DNA, 201 bp, Homo sapiens
tgagcaaacatagacccagccctctgacaccttgctcacagtcaatgggagtttgaaaatagctttcagatgtaacaaccacctttcctcaagtaaaaagycttaaatgcattgtttttaatgtatttttatatatgcagtttttaaattaatttttttattttaaagggaaattgttaggtaatcatttagtcagatcac

SEQ ID NO: 13411 - DNA, 201 bp, Homo sapiens
cttctttttctttattggttgatttattttttaaaaaattaccgtttatttttaataaatacatgtattttccccactcaatccaaaattgtgtttatccrtgtaataatcagtaggcaggctctagattgcttaactttcattaagaaggattaaccttgtgagacacccaggcagtgtggtttttcactgtgtgtaaat

SEQ ID NO: 13412 - DNA, 201 bp, Homo sapiens
cacatgagtcacccacagtcccagcacaatcctgccctgcaggccccatcaccttcttccctgaggaatggccaagatgcaggcatcagctgatgatgatratgattactgttattgcagctattatttttataaatactcccttccttgagatgcaaaaaaaaaaaaatgtaatttgcaaagatgctttgttgggagata

SEQ ID NO: 13413 - DNA, 201 bp, Homo sapiens
agtagaccctcaacatttttccaaagaggcactaatgtaccctgtaaagaaatgacatttttcgtctcaaaaaaaagcaaaaacaaaaaagaaatggctayttttcaccctaaaataaaaaagtgtgtgtgtgtgtgtgagagaaagagagagagagagagagaatgaatctatctccaaatgccaatgagcatgatggac

SEQ ID NO: 13414 - DNA, 201 bp, Homo sapiens
tacatttcctctgccagccccgccccccagccaccgtgacaggaagccccagtagcgccaagatagttgtgactggtcccaccctttcaggaggggcctargttttcaggcagaaggggaattaggttgggccttagaaggtccttcaagtgtacatccacgatcccagcagcagacactggcatctggctctgcccctac

SEQ ID NO: 13415 - DNA, 201 bp, Homo sapiens
tgacaggaagccccagtagcgccaagatagttgtgactggtcccaccctttcaggaggggcctaggttttcaggcagaaggggaattaggttgggccttakaaggtccttcaagtgtacatccacgatcccagcagcagacactggcatctggctctgcccctaccgtatagatgaggtgacaagctggaaggtcccaggg

SEQ ID NO: 13416 - DNA, 201 bp, Homo sapiens
aggggcattcaattttatcctgagagcagtggaaattttaagacagtttttttggtttattggtttggctttgttttctatgtatttttgtttttgtttaraagagtttttaaatagaagagggttggctgggcatggtggctcagcctataatcccagcacttggggacgctgaggcaggcagatcacctgaggtcagaa

SEQ ID NO: 13417 - DNA, 201 bp, Homo sapiens
gtgtggatagggctgtagggcccagtccatggggcatggctgggaccatggttccagggttccagggttccaggactctttcccagggttcagacaggggyttcgttccagggaaggaatgctcctttgagcagctggagcacgttcgggagatgcaggagaagctagcccggctgcacttcagcctggatgtgtgtgggg

SEQ ID NO: 13418 - DNA, 201 bp, Homo sapiens
cgttcgggagatgcaggagaagctagcccggctgcacttcagcctggatgtgtgtggggaggaggaggacgatgaagaggaagaggatggggtcactgagrggctgccagaggagcagaagaagacaatggctgaccgtaacctggaccagctgcttagcaatgtgggttcatgtctgggtgctttggttcctgggggcat

SEQ ID NO: 13419 - DNA, 201 bp, Homo sapiens
atcacttgaacctggaaggcagaggttgcagtgaaccgagattgtgccactgcactccagcctgtgtgacagtgagactctgtctcaaacaaaaaaaaaawtttttttttaattaaaaaaaaagaagagggctaggggcagtggctcaggcctgtaatcctagcactgtggaaggccaagacaggcagatgacctgaggtc

SEQ ID NO: 13420 - DNA, 201 bp, Homo sapiens
acgttcgggagatgcaggagaagctagcccggctgcacttcagcctggatgtgtgtggggaggaggaggacgatgaagaggaagaggatggggtcactgargggctgccagaggagcagaagaagacaatggctgaccgtaacctggaccagctgcttagcaatgtgggttcatgtctgggtgctttggttcctgggggca

SEQ ID NO: 13421 - DNA, 201 bp, Homo sapiens; identical to SEQ ID NO: 1382

SEQ ID NO: 13422 - DNA, 201 bp, Homo sapiens
gaaccataaagttacccatttatgctagtaagtagatgggcagatgagttagtgcagatagacagataaactggtgcataggcagatggcacaaaagatcrggaggtgcctgactgccccctaccctgtgatcatggtcatgtccaccccacccagagtaggcaaagagaagtgccgcccagtcctggctggaggtggaag

SEQ ID NO: 13423 - DNA, 201 bp, Homo sapiens
cactacatttcctctgccagccccgccccccagccaccgtgacaggaagccccagtagcgccaagatagttgtgactggtcccaccctttcaggaggggcmtaggttttcaggcagaaggggaattaggttgggccttagaaggtccttcaagtgtacatccacgatcccagcagcagacactggcatctggctctgcccc

SEQ ID NO: 13424 - DNA, 201 bp, Homo sapiens
cctaggcctgaggcccagccagcgcccaatggatgacaaaaagaagaaacggagtcccaagccctgcctggcccagccagcccaggccccaggcacactayggagggtccctgtgcctaccagccacagcggctccttggccctaggacttcctcatctgccatcccccaagcagcgggccaagttcaagaggtgggtaca

SEQ ID NO: 13425 - DNA, 201 bp, Homo sapiens
tcattcagggtcataaaacaaatgagtgaggcactcagacaggaacccagggaccccctttcaggcactgctctggctgtgttattagcagaaaagacttmtttttgacctcttcacgcctcctcaccccttcccagtgcccaaggggaaccataaagttacccatttatgctagtaagtagatgggcagatgagttagtg

SEQ ID NO: 13426 - DNA, 201 bp, Homo sapiens; identical to SEQ ID NO: 1383

SEQ ID NO: 13427 - DNA, 201 bp, Homo sapiens
agtggtcttagcaaaaggcacaccaggagattatatcccacgcctggctcgagggtcccccacccacggaccctcgctcattgctagcacagcagtctgasatcaaactgcaaggctgcagcaagtcttggggaggggcatccaccattgctgaggcttgagtaggtaaacaaagcagctgcgaagctcaaactgggtgga

SEQ ID NO: 13428 - DNA, 201 bp, Homo sapiens
cccattttatttccttttattatttcaatacatgcctatctccccacactctcatcattagattttagctcctttaaggtcacacagattgggtattcatyttttttcgcacataagttttataaatatttaaagtaaaatatatttaaactataatgcattagaaaaatgcttgctaagtagcatttggcagactgaata

SEQ ID NO: 13429 - DNA, 201 bp, Homo sapiens
gaagggtttaaggataatttctgctcagaagttgccaacaggaagagcaaacaaattggattacacaaataatttcccaaataactacagactggagcaaygggccatgctggtaaaataacttaaaggagacaattgaaactatgtcctctatttaggtccttctctctcaacctcctcaaaaggactaagtacagaatt

SEQ ID NO: 13430 - DNA, 201 bp, Homo sapiens
atatttacatataaatattatatattatttatttcaaattttagacactttttagaccatgcatggaagaattatagttctacaaaaggttgtactctatytactccatttatctttcatgccatgcccttttatttttattagcttttttatgaaagttattgcatgcacctgataaaagatctaaatcagtaagacatg

SEQ ID NO: 13431 - DNA, 201 bp, Homo sapiens
tatctcattcaatctttgtaaaacctcattatgtaggtgggaatcatttcccattttacagatgaggaactgaagcccaaagaaggtaagtgatgactccycggaatggcagataggactctctatctcaaactacttgactgttgacattttatctttgtcaaaatcatggaggtgcttgggtttttatttccctggatc

SEQ ID NO: 13432 - DNA, 201 bp, Homo sapiens
acttccaacaacccactggtctctaaaagtaatagagcccacctccttcatctctcacactgaccccttaccttcatcctcacctctgctgccttggttcragccctcatctcttttacagggatccgccacagcatcccaactgatctggccttaggtcttcttctccaatccattcttcaaaaggctgccactgtgatc

SEQ ID NO: 13433 - DNA, 201 bp, Homo sapiens
tcattggcattaatgcttgtatatgtttgaattcgatactgtaattttagggggtggggggagtgagaactcaagaaagactcacatagcagggatcctgwatgcatgcatcccagtacccaccttctaactcccaaccaaggttaaaagagtataatgttggagaaccagcagaaaaaggccacaaaacagaaaattaat

SEQ ID NO: 13434 - DNA, 201 bp, Homo sapiens
gaagtgagaagagagatttaaaaaggaacaagtgagccttagaaatcaagagtatggccaaaaaaaaaaaaaaaaaaaaaaaagccatgtattgccatgtwttttctttaagaaaggtgtagaaaccaatgacaagagggaaatttataaacaagaaatgaaagaggagcagagcacaaatttgaagtgtgggagagattt

SEQ ID NO: 13435 - DNA, 201 bp, Homo sapiens
gtttcaccatgttggccaggctggtctagaactcctgacctcaaatgatccacctgcctcggcctcccaaagtgctgggattacaggcatgagccactgckcctggccaatagtcatcatttttaaggcaattcatactaaaaaaaagaaatcactactgcatcttccaggaagtatgcaggggctaaaaaataataactt

SEQ ID NO: 13436 - DNA, 201 bp, Homo sapiens
tcttttttaacttttacttcaagggggttcaccaatgccttacagctaaacttttatgatttttttctatttcacaaggacaatcaattctttaacttttytacttcaatcccccctttggtgctctgtataaatgatgtttaataaagagcaccacaatttttttttttttttgagtggctacacattttttttgaggca

SEQ ID NO: 13437 - DNA, 201 bp, Homo sapiens
atggtgcatatttaaatggaaaaatgactttttatttcagagaaatcaccaggattcctggaattccagaacacaagagttaagtctctacttctaaatasacttttgctgcattgaaaaatatcctggcaaatgttcatctgggcagtaagtatcatcatagttaagaaatagctttttgtccattatttgcttatttga

SEQ ID NO: 13438 - DNA, 201 bp, Homo sapiens
tttaacatatccttctgggcatgactctgtatattcctattgtatatatacctggaagtagaactgatgtgtcacaccatatgcatgtgtttagctttacsagataactgccaacaagttttccaaagtcgtttgggccaatatacaatcccagtagtagtgtatgtaagtttagttgctcagtatcttccccagtacttg

SEQ ID NO: 13439 - DNA, 201 bp, Homo sapiens
tgatgtgcaggatggactgtagagaggaaggattgcagagaagatggactacagagcagtgaggacactggtcagaaagagttatagggttaccatatggrgctgtagcaatagaaacagagaagagaaaactaaatgcaagctatagacttgacgattaatatggcgagaattgaaaaaagcggtcaacagtgacaatga

SEQ ID NO: 13440 - DNA, 201 bp, Homo sapiens
ggtctttgagacatagataaacatttagttatatgtcatgtcctatattttgtaccagtaatttaagtctattgttcttttctgaactaaatagctatctmcttcagacattgttatcaccttttatatttcttctgtatcctaaatagcaaattgttgtcagtgagtgaaacagcatgcccagtgaggaaatatttgttt

SEQ ID NO: 13441 - DNA, 201 bp, Homo sapiens
tcacagaaagcaaataattgtttactggtcagttctcacaaatataaattatgtttttaagtctgtgaaattcacatgatggaagatctcatgtgggatcmccattaacaaatagacaaatgaattcaacttagacatttaaacttataggaatattgaataggattaagcaaagcaattgcaaactatccaactttcgtt

SEQ ID NO: 13442 - DNA, 201 bp, Homo sapiens
atcttgatcaatattgaccttcattgaccaatcctgattaacacatttttaaacctgcattcagaatgctactaggtacatttacccaaaatctagatgaytcgtttgtgaataaacatcaaggaatctaccaaagaaagatctggccttcaagagcaggtttttatatgattcaaggcagcttatgaagtataacaataa

SEQ ID NO: 13443 - DNA, 201 bp, Homo sapiens
ttttgggaaaatatgagataaaacagggaaacaaagccattcataaatggtacaaatagtctatatattttatcataatactgcattgctcttcctgatcyatttctttttctcttttctacttttcctgtatcctttctttctaagatgattttacaaaagccttatgtcctaggcaatgtgctatatactttacatcat

SEQ ID NO: 13444 - DNA, 201 bp, Homo sapiens
gggtacatgcttccgtttcttgtgggtaaatacccagaagcagcattgttgggtcatatgataaattcatgtttgagctgtatgtctatccttaataaacwtaccaccacattatatttattattgtagctttatcctaagcctgaaattcaggtagtgagagccttccaatgtcttttccctttcaagattgttttggat

SEQ ID NO: 13445 - DNA, 201 bp, Homo sapiens
cacattatatttattattgtagctttatcctaagcctgaaattcaggtagtgagagccttccaatgtcttttccctttcaagattgttttggatataggascattgaatttccatatacattttagaaatgctttgttgatttctacaaaaagttgtgaatttataaaaagcccactctatcatgtatttctttatagacc

SEQ ID NO: 13446 - DNA, 201 bp, Homo sapiens
aatgctttatatatgttcgttgttgttattataagtagccatgaccttgagaagttcttctaggccactctgttctagttaaaaaacgtcagataaggaaygacacagacacatacatcatgcacactcagtggtctgcaatttctgcttgccttctataacttcaatacagctccacatgatttctaattggctctacct

SEQ ID NO: 13447 - DNA, 201 bp, Homo sapiens
gctccacatgatttctaattggctctacctaagtcctaaaaactaaaaaggctaaaaactaaggttttcttaacttccattttgttaattttactgacacwtatattcattatatctatatatcttgtttttcctcaaaattaacctatattcagtgacaaactgattttttttaaaaaaactccctttctttgattaata

SEQ ID NO: 13448 - DNA, 201 bp, Homo sapiens
tagatgagacttccacctctactctagacagatccaaaccagtgcacatttaaagttctcatgcctgatgttattattattgtccattatcctgtgctatmagctgattattatcactgatacacttatgttactcagtggtctaataagtaaaaaagagagcacagtatacaatttttagaaaagcatcctccctgcata

SEQ ID NO: 13449 - DNA, 201 bp, Homo sapiens
aattgaattgttttttatttatgacacactctcaaaaaaggaatggcttatattccttatcatgtgcaaattttgaaagtttcttgtagttaatcttactmcttctaattgcaggccccaaccctcacctccaaatcctgattttcatgccgccagactctcctgaatcttttcttctcctacaacaaaaaacctgtccag

SEQ ID NO: 13450 - DNA, 201 bp, Homo sapiens
ttcggttcatgaatttatactttaaagtcattacatcagtagctaacatttattgagtgatatgatacttgccaggcacagagttaagtgctctacgtggwtgatttcataaatgcctcaatacaaccctattaggtaatactatttgtccccattttacagatgagaaaacggaggcaaagcttatttacaaaataggcc

SEQ ID NO: 13451 - DNA, 201 bp, Homo sapiens
atgaaaatagtctttcctttgaaccgctttttctgaaagactcctgggagtatggaccaggcagagggttaaatgtggggagcgggtatagcagggaagaragaatggctggcaactcaaactttggagcaaaaggtcatgaaaaagacagtatccaaaagtgaaatggtaaacaaaaactcaaacaaatcatcccaacca

SEQ ID NO: 13452 - DNA, 201 bp, Homo sapiens
caaccaaaggtttgccatggtccccaagcagaacaaaaaagacactaaaaacacagatttctcactaggtatttttataggggataaaagtaaacaatcartgaaagtgtctcatggagaaggaaatacaaatagataattttagtgccagttttatctgtcagtaaaatctgcagcaataagctctgttaataccacaag

SEQ ID NO: 13453 - DNA, 201 bp, Homo sapiens
gtctcattcatacacttagaagaagttgttcagtcaaactgctcccctctaagaaaatgctagaatgccacaaagcactttttatgagtaaagcaggctgsggggaggagaaaggaggactgaaaaaggcagcgaggggaaacaggggaagtctaaggtggtgaaaatctgatagaagaatgtgaaaccaaaactagctta

SEQ ID NO: 13454 - DNA, 201 bp, Homo sapiens
gtcaaactgctcccctctaagaaaatgctagaatgccacaaagcactttttatgagtaaagcaggctgcggggaggagaaaggaggactgaaaaaggcagygaggggaaacaggggaagtctaaggtggtgaaaatctgatagaagaatgtgaaaccaaaactagcttatttaaaaatctccctaaaagatgactgccaat

SEQ ID NO: 13455 - DNA, 201 bp, Homo sapiens
acacttttctgaaagaatgaaatccaaactaaatcacatcgtgtgtagctcagaaagggacatgaagatactcttcttaatgtaaggcaagataggtgatmtatctcctaatggtaaaagctgcaagataagaaagaggtcttgcctgagaaccagctactcagagttgctgcaatcaacccaagaaacactacattgaga

SEQ ID NO: 13456 - DNA, 201 bp, Homo sapiens
ggttacagtttgctgtggttccaacgtccctataaaacccatgttgaaactgaattactattgtgatggtattagaagctgaggccattaagaagtgaagygattcatccttgagggctctgccctcatgaatggatttatgtctttattgtttgagttggttcattatcacaagagtggcttgttataaaaagcaagttt

SEQ ID NO: 13457 - DNA, 201 bp, Homo sapiens
gaaccagaagacaaataaagttctgttcattataaattactcagtctgtgatattctgttacagcagcataaaaggactaagacatggttgttttagttayctgggtcttgccacttaccatgtctctgtgctgctttctggcaacagcagcaaatcccaaattccacttacctggcttctctccagattacctataacaa

SEQ ID NO: 13458 - DNA, 201 bp, Homo sapiens
tcaatctcataattttggcactgtctataaattccttcccaacatcattctgtagtgggggagacagaaaataacaaagcaaataaatgtatgtttagaaytgttaatgtactataagaaaaacaatgtaacaaaagagagttgcagggaaggcccatttacatagtggttggggaaagaatcttcaaggagtgacattta

SEQ ID NO: 13459 - DNA, 201 bp, Homo sapiens
agattgctgccatagtccacaaatgtttgtcattcgtaagctgtggcaataatgtgaatacagaggagggaaactgcaactgaactacaccttgtaaaaaytcctttcatttgctttgtaataacccctgaagaaatgttaagaattattttgaaatcacatatgtttgtaatttccattttttcttgctacatctaagag

SEQ ID NO: 13460 - DNA, 201 bp, Homo sapiens
accatgtgttacaattgtctatagtattcagtgcagtaatgtgctgtacagttatagcctaggagcaataggctataccatacagcctaggtgtgtggtargctatgccatctaggcttgtgtaagtacactctatggcattcacacaacaaaaaactgcctaacaatacatttctcagaatgtatccttgttgttaagag

SEQ ID NO: 13461 - DNA, 201 bp, Homo sapiens
ttgtctatagtattcagtgcagtaatgtgctgtacagttatagcctaggagcaataggctataccatacagcctaggtgtgtggtaggctatgccatctargcttgtgtaagtacactctatggcattcacacaacaaaaaactgcctaacaatacatttctcagaatgtatccttgttgttaagagatgcattactgagc

SEQ ID NO: 13462 - DNA, 201 bp, Homo sapiens
aatgtcacgttctcaaggaagccagccctgaccaccctatgtaacactgtaacctgctccccaactctaccctgccctatgcacagcagtaccagttttcyttaaccatactttttacttttatagatagcactaattatatttaactttcttactcactatgcttacttttcattgtttatctctatccactagaatgta

SEQ ID NO: 13463 - DNA, 201 bp, Homo sapiens
aaatatttgtgcttttgatgaatattacatatcattacatatgacactgtgtcactttacttagctattagacttctcaacttaaagcaaatcatcaggtmatttttattgtcttcaaacaccactagattgataattctgaccaaaacagaagccactgttactgctgttcttgttggtgttgtttttaattgagctggt

SEQ ID NO: 13464 - DNA, 201 bp, Homo sapiens
tttattgtcttcaaacaccactagattgataattctgaccaaaacagaagccactgttactgctgttcttgttggtgttgtttttaattgagctggttgcraatttgactaaattgacttcaatcctgtccaaatgattacatcagctgtgtccacagatacaaactgcctgagccttcctttgatttttaagtacacatt

SEQ ID NO: 13465 - DNA, 201 bp, Homo sapiens
gaagccactgttactgctgttcttgttggtgttgtttttaattgagctggttgcgaatttgactaaattgacttcaatcctgtccaaatgattacatcagytgtgtccacagatacaaactgcctgagccttcctttgatttttaagtacacattttaaaatatttctttataagcaaaaagaaagtgagagaaactttaa

SEQ ID NO: 13466 - DNA, 201 bp, Homo sapiens
ttaatactcatccagaaggttgatttataatatcttgatcactgaagtttaattgattaatatttataaaatattcaaaatgcaaattctcatttatgatkcaaatatgaaaatatttatatcaagattagcatttgctattttgagttcaatccacaattcactaagaatcaatacaagcacacaccaatagaataatag

SEQ ID NO: 13467 - DNA, 201 bp, Homo sapiens
gattcctcaagggtgaggagtatctttaaaacaggcagatttagtatttctaaaagagatataaaaatatttctcaaatttcactaatttccccaatgacmgtccagttctaatgttctctctattaattataaatgctgaaggggtgggaagtgggggggaatcttgccaccaataagagaatccttgtagtagtggcct

SEQ ID NO: 13468 - DNA, 201 bp, Homo sapiens
ttcccacccaactctcatcttgtagctcccataattcccatatgctgtggaagggacccagtgggagactgttgaatcatgagggctagtctttcccatgytattctcctgatggtgagtgggtctcatgaggtctgatggttttaaaaatgggagtttccctgcacaagctctctctctttgcctgctgccatccatgta

SEQ ID NO: 13469 - DNA, 201 bp, Homo sapiens
ataactgtacagaaagaatcaaagaacatatatatatattaagtttcattccaacctacaaagagcctgcacttaaaagtcttaaaggtttcctgaatcatggaatctcaacttacctgccaattaatccagttctctctttttaaatgcagactccaaccttaaacagaaggcatattctagctgacttctaagtgtgtc

SEQ ID NO: 13470 - DNA, 201 bp, Homo sapiens
ctgagtggtaggaaatttttagtgcttagacatttctatagccaagtaaaatgtgtacttcctagtcaaatataaatgccttttgaattatcctgtataawtccctcttgctaaaatgctatgtctctttctttccattcttcactgactggcctaaattctatctcctctgaaagtggagtcctaactggtaaagtccaa

SEQ ID NO: 13471 - DNA, 201 bp, Homo sapiens
catgtgagtcagtaaacctgtatgaaaataatagcagtttatggccaattgttatttagaaaatatgcaacctcacataaaaagttaaactgaatattgtycggattgcataaaattaaaggatataaaatggtcaaatgcagagaaagcttttagaatgagcgatttatttcctaatgatttctgtaaggtggcctgaat

SEQ ID NO: 13472 - DNA, 201 bp, Homo sapiens
ttctgtatgtgagtagtagcattatctagatcctttgatcaggagatcaggggaggcaatccacctctcccttctgctgctgcccctactgcattccatgyggctttcatgcaatctgtcaatccacaatctcatgagcagtgtaagaaaaggtccatctgcacagcatggagggtttctgttaaagcaaacaacctaggc

SEQ ID NO: 13473 - DNA, 201 bp, Homo sapiens
tacaattcaagatgagatttggttggggacacaaagcctaaccatatatacccagtaaacttttcatataaatattatatttttcagttctaaaagctgtktttggttattttatatgtgttccatttctctcctaagtatgttcatgttttcatttaaatccttgatttatttttccatcaagtctatcacctttaccat

SEQ ID NO: 13474 - DNA, 201 bp, Homo sapiens
ccatgcctgactactttttgtatttttagtagagacagggtttcaccatgttggccaggctgatcttaaactccttgcttcaagtgatcctccagctttgkcctcccaaagtgctgggagtacaggcatgagccactgtgtggccccaatgcttcttttgtaaaggaatgcctaacaccaggtgtctaccaacttcagaaa

SEQ ID NO: 13475 - DNA, 201 bp, Homo sapiens
ttaatggttggcaaaaaccttcttttattttaatttgaataacatgtcatctattaagataaaagcaataagatatgacttaataaatcattaactctaawgcagcaatttctgtgtatagacttcctggaggtagtttaaatcattattttgttgtatataatttttaagttttaaaataaatgttcatatcaagcaatt

SEQ ID NO: 13476 - DNA, 201 bp, Homo sapiens
tcctagtcactgttgtatcccaagagactacaacagtgtctggtacaccgtacatgctcagtatacattgttgaatcaataaatgaacgaataagtcacarcgtgagctgttttatctcacaaagtattaagggaattagttaatcattattgttattatttttgagatagagtcttgatgcatcacccaggctggagtgc

SEQ ID NO: 13477 - DNA, 201 bp, Homo sapiens
tacgatgactttgggagactactcacactaaagcagcacacttccccagtgtggaacctccaggtctctgagggcctaattctcatttttggtgccactgtgggaatttccttccttgccttatcagagtatcttgaccttacccctctagaaaactttagttaagcagggaaaactgaatgcgcttattcctaatatcaa

SEQ ID NO: 13478 - DNA, 201 bp, Homo sapiens
ttccattacatatatgtaacccctctgtaattaaggagagggaataagcttttgcacaacaggacttcattctgctgttatcttagacctactacactatytcttctcccactcttcagatagccagttcataccatgttatatgctagtctgtagccccattcttcaaaaaagcatgaaagaagtagggaaaaaaggagg

SEQ ID NO: 13479 - DNA, 201 bp, Homo sapiens
gacttcttgaatataattgaaacaacacgtttgccatttctggccagacagaactcattcccctttcttttgcaaatggtgtctatgcctactctattgcstttatttttctcctttatttctacatatcctttctcctccccagcccagagcaagccatcataatgtttcatgtgtatcttttgtttgtatgagtatgca

SEQ ID NO: 13480 - DNA, 201 bp, Homo sapiens
tatgccttgatgtctagtatattctacttacccactttttcaatgatgtacacctagatctctactaacttgctgcccaaacaatgtggcaacggatagcstgatgcatgcctccttacgtacctgtgtgagaatttttttgagaacatacgtatgcaaaagggctgagttacagtattcatttatcttaattaaatagtg

SEQ ID NO: 13481 - DNA, 201 bp, Homo sapiens
ctgtgtctgctttttaagacaggtggtcatttcatctgcaaataattagaggcttatctctcccattctgatccttccatttttttcttttttaaaagtgytttcccatatctattacttttttcttgtttcatagctttaaaaacatgtactaaatttctccataaaatataagcatttctctaggtttcttgtacctca

SEQ ID NO: 13482 - DNA, 201 bp, Homo sapiens
taagacaggtggtcatttcatctgcaaataattagaggcttatctctcccattctgatccttccatttttttcttttttaaaagtgctttcccatatctaytacttttttcttgtttcatagctttaaaaacatgtactaaatttctccataaaatataagcatttctctaggtttcttgtacctcacattttctaaatta

SEQ ID NO: 13483 - DNA, 201 bp, Homo sapiens
attgtactatgggttaaatgaatcaatcatgtgtgaatggttcttaataaatatcagtagcattaacacatcatattgctagtaatgggagcagctctatrccctgaaggaaaaaataactgaagtctgttagctattatcaccattctcagagtctaacacagtgcctggccatgcagagaaacatcatgctaaacccaa

SEQ ID NO: 13484 - DNA, 201 bp, Homo sapiens
atggcagttttcaatagctcttttatttttccttttaatacacagcattccattcagccaactctaaattcccttttactcatattggagaaattgttctrcattctaatttgcatagtcacttctttatgccaataaaaaaccacacacatttcaatcctgcttgtaccactggttcattaaaacagcgtctggattttg

SEQ ID NO: 13485 - DNA, 201 bp, Homo sapiens
tgcattttttcatatcattcaactaaattcccacagcaactatacaatttataagtcattatcttcatttaaagaggaggaaactatgctttggggaaatgaagtaccttattcatggtcacacaatctaatatgaagaggataacggctcacatttacttcattccaaagcttcaaacagttaggagatactaagaaagt

SEQ ID NO: 13486 - DNA, 201 bp, Homo sapiens
catggccaggtgcccctctgagacgaagcttccagaggaacaatcaggcagcaacattggctgttctgcaatactcgctcttctgcagcctccgttggtgrtacccaggcaaacggggtctggagtggacctccagcaaactccaacagacctgcagctgagggtcctgactgtcagaaggaaaactaacaaacagaaagg

SEQ ID NO: 13487 - DNA, 201 bp, Homo sapiens
cattggctgttctgcaatactcgctcttctgcagcctccgttggtggtacccaggcaaacggggtctggagtggacctccagcaaactccaacagacctgyagctgagggtcctgactgtcagaaggaaaactaacaaacagaaaggacatccacaccaaaaccccatcagtacgtcatcataatcaaagaccaaaggtag

SEQ ID NO: 13488 - DNA, 201 bp, Homo sapiens
aagttgcctgtggtctgagggttcacggttcagcgttcagggatcagctggcatggcaactgtctcaattcctacggctacaagaaaaaacacacctttgmtaaattctctaacaataggcgttatcaaacaaattatcagattgcttcctaactctgatttacaacccaggccactataactctgattgaaaagagaact

SEQ ID NO: 13489 - DNA, 201 bp, Homo sapiens
tgagaaatccactattactctgatggggattcccttacagatgacttgacacttttctattgctgtttttagaattctctctttgtctgtgacttttgacmgattaactataatgtgccttggagaagaccttttggaattgaatcagtttggagatttttgaccttccttatctgagtatctatatctcttgcaagactt

SEQ ID NO: 13490 - DNA, 201 bp, Homo sapiens
caggctggtctcgaactcctagcctcaagtgattcgcccgccttggcctcccaacctgctagagttacaggagtgagccaccgtgcctcacaaccaatttyttaacataagacaacaatgatgtttgctgcatcggttgactcttcatgaaagatttctctgtagcatgtgatgctttttgatggcattttacccacagta

SEQ ID NO: 13491 - DNA, 201 bp, Homo sapiens
actaacagtttaagcttattttagatggttttcttgcttttcatgctttgatttctaaattccaaaagacccttttccccctttatagggagtattctacraaaagcatatctcaaacaaagctttactattattattgtttgtaggatggagtccttctttggtgtaatgtttagacaaactctaaaatgtaatccctca

SEQ ID NO: 13492 - DNA, 201 bp, Homo sapiens
ttttttaactcagaatttctaacagtaagacagattctcattttgatgatgatagctgatttggggaaaatgtttatttccattttaaagtcttcaaaaaygcacatataatatctttccatagtaacagtattataaggggggaagacacgatgccgttttggatttagtttgcacaattcttataaaaggcttcctact

SEQ ID NO: 13493 - DNA, 201 bp, Homo sapiens
tagattccaggttgagggctttgccagtattccatgtgactctactagccccctaccaggtgtatgaccttagatgattagtagactgctctatacttcartttctccatctgtaaagtgggagtgataatcacattacttgcttaatgaaacgttttgaggattacttgtaacatgattaagatagtccttggcacacaa

SEQ ID NO: 13494 - DNA, 201 bp, Homo sapiens
cctcataagcatgtccatttgtctgtccatttgctgtcttcaagaccaattcatatccataatctgatttcatctacctaatacttgtattagtttcctaytgctgctacagcaataggactgtaaactccgtggcttaaaataacacatatttatcacagagtccaggaagtcagaagtccaaaatgggtctcagtgagc

SEQ ID NO: 13495 - DNA, 201 bp, Homo sapiens
ttcatatccataatctgatttcatctacctaatacttgtattagtttcctattgctgctacagcaataggactgtaaactccgtggcttaaaataacacayatttatcacagagtccaggaagtcagaagtccaaaatgggtctcagtgagctaaaatcaaactgtcagcagtctgcatttcttctggagtttcctggaaa

SEQ ID NO: 13496 - DNA, 201 bp, Homo sapiens
acctcttatgcctgcatgtgctccaactgcagtctgcacagctgactttgatgcactttttcaaaggtatatgcaaaaccctctccactcagcttaggctsggatcccaggctggctgcttgccctgtctccatgattccctgctgcctccattgctggcaccgacacaaatacagctttgtatctactcactacaaaaac

SEQ ID NO: 13497 - DNA, 201 bp, Homo sapiens
tccagccaggactctgcagagacctgaactgtataaacaacaaaaaagttagggatcaaattagttttgccactgctacctctgtacctctgggtaaacaytgggctgttcattagcaaaatggaatttgaatttcaaagatgaatgaatattcatttactttgggtaattacatactaaggtattcaaaatatatttgtt

SEQ ID NO: 13498 - DNA, 201 bp, Homo sapiens
tgtgagtgatcaggggcccattggcacataaatatatgtaaccttttaataatgccttctcccaactaagccaagcacaaggatgtgtgacaaactgacayattttgacttttgaaaagatttcaaaaaagatccagatttcttcagtgaaaggtcccctatctctctgaagacgaccctctgaaaagctgtgaacattag

SEQ ID NO: 13499 - DNA, 201 bp, Homo sapiens
ggcagaagagtcacttgaaccagggagttggaggttgcagtgagccgagatcttgccactgcaatccagcctgggcaacagagcgagaccaagagcctccrtctcagtaaataaataaataaataacagcttagttgtgtcaatagctcattaaaactcttcttagaagctttttatcagtagttttgggaaatcagtaca

SEQ ID NO: 13500 - DNA, 201 bp, Homo sapiens
gctactcaggagactgaggcagaagagtcacttgaaccagggagttggaggttgcagtgagccgagatcttgccactgcaatccagcctgggcaacagagygagaccaagagcctccatctcagtaaataaataaataaataacagcttagttgtgtcaatagctcattaaaactcttcttagaagctttttatcagtagt

SEQ ID NO: 13501 - DNA, 201 bp, Homo sapiens
gtgagaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaacta

SEQ ID NO: 13502 - DNA, 201 bp, Homo sapiens
cctctcaatacatgaaggattttttatcacatacttctttgagattccacactttccaaatgtttttcctacaaacagttcttcaacatattaatttcctycattttagcacccatgtatgtacatccaaccattccttctttcatttccaaacacatcaatgtactgagtgtaacaccttgcttgacaagcatgcaggag

SEQ ID NO: 13503 - DNA, 201 bp, Homo sapiens
atgctgatgaatacgtcacacagttcattgccttggtattaattgtagtgactccactttggcataaattaagatttactaactttcatcaagccttatgycctctcaatacatgaaggattttttatcacatacttctttgagattccacactttccaaatgtttttcctacaaacagttcttcaacatattaatttcct

SEQ ID NO: 13504 - DNA, 201 bp, Homo sapiens
ccaaaagcataattaaataacagatataaaattgcacatacttctgaaataatatcaagaacagtgaagtgtacacagactatgatatttgtaacaggggycagctaataaaatagatgatttctgctgagtttgatcttgatttttgttgtttctacacaatgagcttcaaattaatattaacttagtaataaacttgtg

SEQ ID NO: 13505 - DNA, 201 bp, Homo sapiens
tgagagttctgttgattttttcattcctccttcatcaactacatcaaaatggttattatgtttgttcacttttacttctaaaatatttttgacctctctgyctcattttcagctcttctgtcatagcccgagaataggcccacgcctcttctgcctggactacagtgccagctctctaatgaggctcccttctcttgatag

SEQ ID NO: 13506 - DNA, 201 bp, Homo sapiens
tattacctctcacacaggagtggggattttccagcacagagctctttgacaacagaaaaatatgaaaacccttgagaaatggagttcatataggaacgcamatgtttccaggctctataattcaggcagtagagagtagggtgtttgctgagtttcaggttgtttggtggtattcagattctctattccttgagctaactg

SEQ ID NO: 13507 - DNA, 201 bp, Homo sapiens
ttcgtttttactctttttaatctttttgatgatgtgctttttaaaccataagtattttaaatgaaatttctaatgcagaggggaagaaaaggtttctttgyatgttcatttgtttctagctactcttgatgtaataagagaccttcttttaaataattacccttaggcaggaagaccatcataacatagtatttctccact

SEQ ID NO: 13508 - DNA, 201 bp, Homo sapiens
aatgtagtccatgttcttcctctttttattttggcctacaatatttgcttttctttgaaagattgccatggcagggggtgactggcgagaggtgggtatcwtcttctcaaaaaaggaagatcaccatcattgcccactttctcctttcctcattcttaatgattctccttcaatatggttaacttatggctccacagtcat

SEQ ID NO: 13509 - DNA, 201 bp, Homo sapiens
aattgattgtaagatgtgaaaacacgcggaggaggagaaccaggagcactcagtgtcacaggtaaagaaagaggaaagcctttggaaagggatgaattgartggcctaagaaaacacttctatattttttaccatctggttagttacagacgcttgtaaaagggagcgaaggagcagaatccagcttactgcaaatgagaa

SEQ ID NO: 13510 - DNA, 201 bp, Homo sapiens
cttataatgatctctaaactatacatccttctaaagaacttggaatcactgtttcacagggcctttcttgcccataccataaaactattagattatgacgmtattttattcattcactcacagaacaaacagtagtaagctttaactatacacaaagcccggtgaacaacaacaaaaaagttagtcttgcattttaaagag

SEQ ID NO: 13511 - DNA, 201 bp, Homo sapiens
atgggttcaaggagattctgtgagccagctaagaaatttaactttagttgtttaactttttttgtatgagaaaactagttctgagttcatacaactcactwacataagtcactgaaagcagaaagtaaactgtcttgcttaagatcaacaattatttcattaaacaaataaatgaacagatacatcaacaaatgaataaat

SEQ ID NO: 13512 - DNA, 201 bp, Homo sapiens
aagtaattatggaagaagtattagagtctattgtatgatatgaatttcaattggtctactctttaacactttctttaatttagaaattttgtttatatgtmcatcatttaaatatgtcttacaatatgggcaggataaaactaatattcaagataaagcatttactaattttgttataaaacatgctgaacgtttgaatac

SEQ ID NO: 13513 - DNA, 201 bp, Homo sapiens
ataaaactaatattcaagataaagcatttactaattttgttataaaacatgctgaacgtttgaatacacacaatggttcacacagtattgaattaaatgamagatatctgaacatcatatttgtatggaaaaaatgcatcataacatgggtcatatctcatgataaacttggagcctgaaaaccaacagcccaagaagaaa

SEQ ID NO: 13514 - DNA, 201 bp, Homo sapiens
attcaagataaagcatttactaattttgttataaaacatgctgaacgtttgaatacacacaatggttcacacagtattgaattaaatgacagatatctgamcatcatatttgtatggaaaaaatgcatcataacatgggtcatatctcatgataaacttggagcctgaaaaccaacagcccaagaagaaaacactttaatt

SEQ ID NO: 13515 - DNA, 201 bp, Homo sapiens
catttactaattttgttataaaacatgctgaacgtttgaatacacacaatggttcacacagtattgaattaaatgacagatatctgaacatcatatttgtwtggaaaaaatgcatcataacatgggtcatatctcatgataaacttggagcctgaaaaccaacagcccaagaagaaaacactttaattgctttcactttgc

SEQ ID NO: 13516 - DNA, 201 bp, Homo sapiens
taaattcatgtcattaattcactcattctgtttggaattctgtaattagaaaggcaggagtacagtaactcaacaaaaggtctcgtttgtgcccaaatggsccccaacagtgaaccacactgcataatggggagggaagtactatcagaggggaaactagaagtgtctgaagggaatggaataagtaaaaatgaaaaaatt

SEQ ID NO: 13517 - DNA, 201 bp, Homo sapiens
aaggcaaaattatcagattgtgatgcactaaaggcatttcctatgctttgcattattcctaaagttgtgtgtgtgtgtgtgtgtgtgtgtgtgtgtgtgtktgtgtcaccaaatgtcaaggcttcccatctggtcttaattcctgagaataccgactaaccatgtgactctgaagctgagcagaaacaactcagcaggtga

SEQ ID NO: 13518 - DNA, 201 bp, Homo sapiens
aaacggcagtttaagggggtagagcctgggaacttccatttttaactagctcctctaattaactgctggcatgctaaagttaaaaaatgcctgctatagakctatagctaggccatgacaggttgtttaaaataagccattatcaaagaggctctttggcaaaattactagaaatctcctgccttacaaatattcttgctt

SEQ ID NO: 13519 - DNA, 201 bp, Homo sapiens
ggttgtttaaaataagccattatcaaagaggctctttggcaaaattactagaaatctcctgccttacaaatattcttgctttgagtaatagctagtttttwcattttccatttttaagctccacacccctgcgacctacttcttaactcacagactgagtcttgcttgcaattttctggggtttttagcactgtctgggat

SEQ ID NO: 13520 - DNA, 201 bp, Homo sapiens
gttgtttaaaataagccattatcaaagaggctctttggcaaaattactagaaatctcctgccttacaaatattcttgctttgagtaatagctagtttttayattttccatttttaagctccacacccctgcgacctacttcttaactcacagactgagtcttgcttgcaattttctggggtttttagcactgtctgggatt

SEQ ID NO: 13521 - DNA, 201 bp, Homo sapiens
ttatcaaagaggctctttggcaaaattactagaaatctcctgccttacaaatattcttgctttgagtaatagctagtttttacattttccatttttaagckccacacccctgcgacctacttcttaactcacagactgagtcttgcttgcaattttctggggtttttagcactgtctgggattcacccttatgacatacca

SEQ ID NO: 13522 - DNA, 201 bp, Homo sapiens
tcttaactcacagactgagtcttgcttgcaattttctggggtttttagcactgtctgggattcacccttatgacataccacacactggaaacatgagggawatcttgatctatttcttgttcttgtttctaaaaatacaatgaaaggagggccatactggtaaatgataaggtgcaattttccttagttgtacctggtcat

SEQ ID NO: 13523 - DNA, 201 bp, Homo sapiens
ccttatgacataccacacactggaaacatgagggatatcttgatctatttcttgttcttgtttctaaaaatacaatgaaaggagggccatactggtaaatrataaggtgcaattttccttagttgtacctggtcatctaaaattatgtttaagtgatactgagctgcccttccatagataaagtaaatttaaagcgaatat

SEQ ID NO: 13524 - DNA, 201 bp, Homo sapiens
cttatgacataccacacactggaaacatgagggatatcttgatctatttcttgttcttgtttctaaaaatacaatgaaaggagggccatactggtaaatgwtaaggtgcaattttccttagttgtacctggtcatctaaaattatgtttaagtgatactgagctgcccttccatagataaagtaaatttaaagcgaatatt

SEQ ID NO: 13525 - DNA, 201 bp, Homo sapiens
cgccaccatgcctggctaatttttgtatttttcgtggaaacggggtttcaccatgttagccaggctggtcacaaactcctgacctcaagtgatttgctggyctcggcctcccaaagtgctgggattacaggcatgagccaccacacctggccaataatgacttttttgataaatactaataatatggatgtgattctcaga

SEQ ID NO: 13526 - DNA, 201 bp, Homo sapiens
actagggcaggaatatgaagtctttgtcctttgaaactgagggaaagagttcacaaacaactgtaataagatttatttattagttatattatttataaatkaacatattcaaatatactcaaaagtaaagtgaacgctataaagacatccatgtatctgccaatctggatgcatccattttgccaatctggatgcatctac

SEQ ID NO: 13527 - DNA, 201 bp, Homo sapiens
cactgcaacctccacctcccaggctcaaggaattctttcacttcagcctcccaagtagctgggactacaggcaagcaccaccacgcccagctatttctttmttttttttttttttttgtacttttagtagagacagggtttcactatgttacccaggctggtctcgaactcctggcctcaagtgatctgtctgcctcagcc

SEQ ID NO: 13528 - DNA, 201 bp, Homo sapiens
tacattccaaatattactagggtgctttgccatggggagaaaaatactttcttccatggggagaacaataatgggaaaatttgaaatactgtgttggtatraagtgaatgaccccattgaattggaaatcaattcttttgcaacttactttctaattcgtgctttcaacaataataaagaaggatttaatggatttataaa

SEQ ID NO: 13529 - DNA, 201 bp, Homo sapiens
caaggaatgttgcaaaatgtactgttgttaaagaaaagcctattcatgtatttaaaagaatagttaataaagggtatcgaatgtctataatatttatattmtaatgggtacatttaaaggagtgatatgacagctttattgtcaaataccaatattttccatccactagaaaaattaaaacaatttttgacaaaatagtgc

SEQ ID NO: 13530 - DNA, 201 bp, Homo sapiens
ctaatgggtacatttaaaggagtgatatgacagctttattgtcaaataccaatattttccatccactagaaaaattaaaacaatttttgacaaaatagtgytagataccaacttaaaaatacacaaggaggtacaaagcttcagaattctttttgagttcaaatgaagaaaaatgtttgaagatcactcttttaaaataat

SEQ ID NO: 13531 - DNA, 201 bp, Homo sapiens
cacttccctgcttccagctccctttcctggttggggtagcgagccactctcgccacttccagtttcctagttggggtggtgagccactctcgccacctccrgttttcttttccgagctgacttagcgagccactctcgtgtcctgtctctgttggggtgtgagtttcattcaaatcaatgagccactcttgttgtccccag

SEQ ID NO: 13532 - DNA, 201 bp, Homo sapiens
ttcctggttggggtagcgagccactctcgccacttccagtttcctagttggggtggtgagccactctcgccacctccggttttcttttccgagctgacttrgcgagccactctcgtgtcctgtctctgttggggtgtgagtttcattcaaatcaatgagccactcttgttgtccccagcccctctgggtcagattagttgt

SEQ ID NO: 13533 - DNA, 201 bp, Homo sapiens
cttaccacggttcagatgtctgtgcagtgctcctgatgccatccaggaatcccctttactggttccgttgcactgtctggaagggcaccgggacatgggarggcctatccccttcagggctgaagctctcccattggcaccaagtttcccaggtctcctctgtcccggggcctcagtcccacaggcaaaggagacagaaat

SEQ ID NO: 13534 - DNA, 201 bp, Homo sapiens
aagtttcccaggtctcctctgtcccggggcctcagtcccacaggcaaaggagacagaaatctgccatctccagtcccgggtttcagcaccagaaatgttgyagtgaattaagggaccagagagactgaatggggggggcaggagagtttatttaaggtgtacactggcttagtggacatgtatcctgaaagactgagcact

SEQ ID NO: 13535 - DNA, 201 bp, Homo sapiens
tctataaagaagaaagtattatttctgattaatgtatctcataattaattcggttcatgaatttatactttaaagtcattacatcagtagctaacatttaytgagtgatatgatacttgccaggcacagagttaagtgctctacgtggatgatttcataaatgcctcaatacaaccctattaggtaatactatttgtcccc

SEQ ID NO: 13536 - DNA, 201 bp, Homo sapiens
tggaattttattttattccttttgtacctaggtatcacactttgtatatgcagccttctttctctcaagtcagttttttttattaccgaggtaacctccayagtaacacttcctatctttaagctccctgcgaagttggaaatacaagctatatacacacttgaagaatagtatgtaagaaaagcaattataagaacaaga

SEQ ID NO: 13537 - DNA, 201 bp, Homo sapiens
caggaggatcatttgaggccaggagttcaagaccagcctggccaacatggtgaaaccccgtgtctactaaaaatacaaaaattagacaggtgtggtggtgygtgcctgtaaccccaactactcgcgaggcttaggcaggagaattgcttgagcccaggaggcagaggttgcagtgagccaaaatcgtgccaccgcactcca

SEQ ID NO: 13538 - DNA, 201 bp, Homo sapiens
accagcctggccaacatggtgaaaccccgtgtctactaaaaatacaaaaattagacaggtgtggtggtgtgtgcctgtaaccccaactactcgcgaggctkaggcaggagaattgcttgagcccaggaggcagaggttgcagtgagccaaaatcgtgccaccgcactccagcctgggccagagagcaagacgcagtctcaa

SEQ ID NO: 13539 - DNA, 201 bp, Homo sapiens
ttttttgtttgttttttcagaaccaccatgaatggtgacagcctctgtccaattcagtagcaaaaaccaaaaacacaggtgaaatatttggttagataccwgttttccttcctcccatccacctcctgcctcatgcatgcacgcatgcactatgtcactattgcaggccaccttctatgcctctgccttcttcatcttcat

SEQ ID NO: 13540 - DNA, 201 bp, Homo sapiens
tatcttcaacaattttataaatctttccctggacagctataatgtgaccaactttaagttgtgacatccctctattttttcaatcaccttgaaaaacagtycagtccttcatccctttccttctagctccacacttggtcccttcatgataagacccctggcaccaatcctccctatttaaaataaaattactatatggta

SEQ ID NO: 13541 - DNA, 201 bp, Homo sapiens
agtggtgacagatactgtgttataccatggagaatccatttcttaaatgtttacagcaatttgtgaaagctttcaaagtaataacatatataatctcttaytaaaatacaaggtgatctggatttgctgagtgctaaagtaatcgtggaagttacattaacttttatattgcctcactattttcaagtaaaccaaaatgaa

SEQ ID NO: 13542 - DNA, 201 bp, Homo sapiens
acttttacttcaaggggttcaccaatgcctattacagctaaactttttattattttttctatttcataaggacaatcaattctttaatttttctacttcartagtacattatagaatcctagcccataatactcaatgtcaaacatgtagcgctgtgtgtgtctgtgtgtacacgctcatgtgcttctgaaacaacgtggt

SEQ ID NO: 13543 - DNA, 201 bp, Homo sapiens
attttttctatttcataaggacaatcaattctttaatttttctacttcaatagtacattatagaatcctagcccataatactcaatgtcaaacatgtagcrctgtgtgtgtctgtgtgtacacgctcatgtgcttctgaaacaacgtggtaagaccaaagactagattttaatgcaacttaattacaaaagagaaagagac

SEQ ID NO: 13544 - DNA, 201 bp, Homo sapiens
taaactttcaaagaaaattcatgccaagaacatgtgaaaaatgacatcacaaatagccaccatttaaataaaatacttttaaactataaaacacagaataytgctaagcaaaattaaaaaaaatacctttactatgggaaaccttatttcctttttctagaaaatgtgactttttatgctatgttcatgtggcgagaatca

SEQ ID NO: 13545 - DNA, 201 bp, Homo sapiens
gccaagaacatgtgaaaaatgacatcacaaatagccaccatttaaataaaatacttttaaactataaaacacagaatactgctaagcaaaattaaaaaaawtacctttactatgggaaaccttatttcctttttctagaaaatgtgactttttatgctatgttcatgtggcgagaatcagtatggttaggaaaaatgattt

SEQ ID NO: 13546 - DNA, 201 bp, Homo sapiens
tcaaattaatattaacttagtaataaacttgtggatggcaaacatgagcatctctcacatgcaaaaaaaaaaaaaatagttcaatgaatgaggtgatgctrggaaagaatggcaaccacacttctcccagggaacccagacctcctaacttcaaaggctctcatttacagcacgcagttcattcatataaaagtaaacgtg

SEQ ID NO: 13547 - DNA, 201 bp, Homo sapiens
ctcaccatgtaaagatcatgaaagggtctttgactgttatcaaaactccatggatgcttttctattgtaaagtagaacaaacactggccataatttacttyagactgtgtctgaaatatctgaaccaaaaccaaaaccaaaaaccctgactaaaattacatcaccacactctctaatatggaagaagcacagacatgacag

SEQ ID NO: 13548 - DNA, 201 bp, Homo sapiens
cttttctattgtaaagtagaacaaacactggccataatttactttagactgtgtctgaaatatctgaaccaaaaccaaaaccaaaaaccctgactaaaatyacatcaccacactctctaatatggaagaagcacagacatgacagctgatcttttacctacctccattaatggtcacttcgccaaggcagttgtttggtac

SEQ ID NO: 13549 - DNA, 201 bp, Homo sapiens
tcaccacactctctaatatggaagaagcacagacatgacagctgatcttttacctacctccattaatggtcacttcgccaaggcagttgtttggtactttyggtgcacaacgtttatggcagttgaatctgcaatctaatcccagtgattttcaaacaaaacaaaatgagaatttgtcataaagaaaagtggtaaccagaa

SEQ ID NO: 13550 - DNA, 201 bp, Homo sapiens
aaggcagttgtttggtactttcggtgcacaacgtttatggcagttgaatctgcaatctaatcccagtgattttcaaacaaaacaaaatgagaatttgtcakaaagaaaagtggtaaccagaaaatacttatgtcagatgaatgagggtgatcaaagttcgacaggtgacaaaatcatccttacctttgcactgcaagccct

SEQ ID NO: 13551 - DNA, 200 bp, Homo sapiens
cctgtagccaagggtggctcaaggtcttatccacactgtagcgctttctcatttttacttgcagcaaattgttgataagatcaatggctgaaaaaaattacagtaaaaatagatgacaaatctgtaacatatgcataattcatttatagtttatttcacatctgctatttcacacagttaaatgcagcatagtgacaagg

SEQ ID NO: 13552 - DNA, 201 bp, Homo sapiens
ccttctccttcttccttttcctcttcctcctcctcttcttcttcttctccttctccttcttcttctgcttcttcttcttctccctcttctttttcttcttkctctttctcttcctcttcctcttcatgtccttctcctttcttcttcttctcttgcattccatgtcaagctgaagctggctagatttctcctcctccttct

SEQ ID NO: 13553 - DNA, 201 bp, Homo sapiens
aatggtttcaaaaattacctttatcacataatacattttattatcaaattctggtttgaaaaagggactgttattaataagagaagttaagtgacaatgcycgatgtcaaatgaaaggcttacagtgagagacaaagaggacattaataaaatcaacatgatctgcttctcagacatagctcactcccgtgactgatatgc

SEQ ID NO: 13554 - DNA, 201 bp, Homo sapiens
gaaaagcaatacagtaacagaaatcagtcaattgtcaacttaactttgaaacgtgaatcaagttgttctctcttacgtacgtacacaacctcattcctcawctattaagaaaatctcagggtacaggattccaatgttcctgaatgggtcagttcttcagggaaaacttagttaaggacttacgaagtataagatagttat

SEQ ID NO: 13555 - DNA, 201 bp, Homo sapiens
gaaacgtgaatcaagttgttctctcttacgtacgtacacaacctcattcctcaactattaagaaaatctcagggtacaggattccaatgttcctgaatggktcagttcttcagggaaaacttagttaaggacttacgaagtataagatagttatcactgttttattctctgcctagaatgcagtgtttcctataaaattct

SEQ ID NO: 13556 - DNA, 201 bp, Homo sapiens
aacactgtcattaacaccctggctgcattctccctcctagcgccctgtcttggattgacattgctatcacatcaccccacagatttctcatgtaaatgggraagtgggtaaacaggaagccataccagaaggggctcatcaggggcacttgtagagagttcagcagatgatgtgcggatggtgctgaccccagtgagggaa

SEQ ID NO: 13557 - DNA, 201 bp, Homo sapiens
taacatctgcaactgggttcatttaaagccaaattcaaaatgcctaaacccaatctctttatctttcttgctatcctgtaaccacagtaagcagtgagctraagattttctaaacgtttcaaccacccataaaaacaaatgtatgcggccgggtgcagtggctcacacctgtaatcccagcactttgggaggccgaggggg

SEQ ID NO: 13558 - DNA, 201 bp, Homo sapiens
agttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaac

SEQ ID NO: 13559 - DNA, 201 bp, Homo sapiens
caatgccttacagctaaacttttatgatttttttctatttcacaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttga

SEQ ID NO: 13560 - DNA, 201 bp, Homo sapiens
acaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttgagtagtagtatgctttgttaccattgcctctacagttgactg

SEQ ID NO: 13561 - DNA, 201 bp, Homo sapiens
gacaggtgagaaattccttgtctccaggtcattccaggggcactctggtgcaggaaggaggattcctgcaccaggaatgcgctggtccagggtccgtaggrgagagaggggaagaaaactgggaagtctcaaggacaaggaggggcgcggcgaggaaagggcaagatacctggaaatgtcatgagaaggatggaaatgggt

SEQ ID NO: 13562 - DNA, 201 bp, Homo sapiens
cccccaccacttcaacgtcctactatcagcatcccgggaatgaaaaataggaaggtcgcaactttcaggttttgtcgttggaaaatgtgtttccatgctcmtacagaagtggaactaaaagatgacaaggccttgggtacctgcactcctggtcagttgttttgacaactggccgagtcaatcacactctcttaaaagctt

SEQ ID NO: 13563 - DNA, 201 bp, Homo sapiens
aaaattgtacagaattacctttgctttttgagaaattttgttttacattgtatacgtgcttatgaagcattgctgtttcattaactggtctgcatccaaayggagaggattgtatacaaggctttcacagtgcctaggagtgctcctgctgacccacaatagacattccacaatactgatgtggaaaaggagcatgatatg

SEQ ID NO: 13564 - DNA, 201 bp, Homo sapiens
atagtatatataatttttattagtaaattataccttaataatgctggggagggagaaagaatcttgtaggatcacctgcagtgttacaaagggaactcaaygtgagacaggtaattcaaacagtcagaactatgaaaatatcaaatagtaatttacaaaaatgtaaaagaaaaacacttattatgaccccaatgacaccaa

SEQ ID NO: 13565 - DNA, 201 bp, Homo sapiens
ctccttttttagctaaccgtattttctccagtgaaaagaacacaataaagtacaacttgaaactatgatacacagtgtcacccttctgcatctaagtccaygtattttgcctttgtcatgactgtgaagagcactttacgctacagcttcaaagcaggcttttctgtttaactacttgaattaataaaggtattatgtacc

SEQ ID NO: 13566 - DNA, 201 bp, Homo sapiens
aatcttgccaggaaaggaaactgaccagccttgtaataagtatctcagaagcaagacagcttaaaaacagtgctagaaacatggctgaaaatcactactgytccacctcccatgaatgattgacgtgcaccaagggctgggagaagccctcctcaaggttgactgcagaagttacacccacttcaggcttacagcacgcaa

SEQ ID NO: 13567 - DNA, 201 bp, Homo sapiens
cgttataatgccctatattcctgccctttgggccccaaatttggctctcagctctagggcagtcaacacaagatggaaaaacgttaataacacacttcacrctgtcaataagattaaaaacataggaatggctcaagagacgaacaactattcttgggattaaaatttaacagagaattttcccccaggttcctcaaaaga

SEQ ID NO: 13568 - DNA, 201 bp, Homo sapiens
acagttgttaattgtgtagctgatgttataatttcctttagaaggtatttttgaggatgcatcattcactattttttggttttttattcgcccacagaggygggaataaacatttctttcctacatggctgctccaagattgagatattattctgaaagtgctcagtatggagccttgcttaataaacattcatttaatca

SEQ ID NO: 13569 - DNA, 201 bp, Homo sapiens
ctgtggagaaaaaggaacgcttatacactgttggtgggaaatgcaaactaattcagccactgtggaaagcaatttggagatttctcgaagaacttaaaaarctaccatttgacccagcaatcctcctactgggtatatgcccaaaagaaaataattcattctatcaaaaagacaaacgcacttacttgttcactgcagtgc

SEQ ID NO: 13570 - DNA, 201 bp, Homo sapiens
aaaatatctatgatcctactagccagataaaaccacttacaattttagataataagagtatctttctagatttctatgtatctatacaaatttttaattgrctcattttataagtctattttataagcttattttactcaaccatatatcgtggacatctttcatgtaaataaaaatatatttccacatccacattttaat

SEQ ID NO: 13571 - DNA, 201 bp, Homo sapiens
actttgttctagatgcaaggggaagtataccatcctcagttggaagccagaagccaaaggagttccagggttgtattctgtatcctcttggagtacagagyaaagaaaggcagataatggatggggacatatggagaatattctagtggatatcattgaaatgttttacactgcagcatgatttaatgagacctacatttg

SEQ ID NO: 13572 - DNA, 201 bp, Homo sapiens
ggcaattactgaaaactgcctgtgaggctatatttaatttctgaatgcattcaccaggcagctagtgagtgctctgtatgtaccaaccactgcttctgagrcttagatttaaaagaaatacctgcatatctttgacctcatggaacccagaatctatgagagaagagaatcactatgcaaacatgttgcatgaatatttat

SEQ ID NO: 13573 - DNA, 201 bp, Homo sapiens
catgaacacagggaggggaacaccacacatcagagcctgccggatgtgtggacaaggagagggatagtgttaggagaaatacctaatgtaaatgatgagtkgaagggtgcagcaaaccaacatggcacatgtatacctatgtaacaaacctgcacgttgtgcatgtgtaccctagaacttaaagtataataataatttaaa

SEQ ID NO: 13574 - DNA, 201 bp, Homo sapiens
tccatcaataatagactggatgaagaaaatgtggcatatatacaccatggaatactaagcagccacaaaaaaggatgagttcatgtcctttgcaggcacayggatgaagctggaaaccatcattctcagcaaaatatcacagggacagaaaaccaaacactgcatgttctcactcataagtgggagctgaacaacgagaac

SEQ ID NO: 13575 - DNA, 201 bp, Homo sapiens
gaagccatgagtgactgtccatcaataatagactggatgaagaaaatgtggcatatatacaccatggaatactaagcagccacaaaaaaggatgagttcaygtcctttgcaggcacatggatgaagctggaaaccatcattctcagcaaaatatcacagggacagaaaaccaaacactgcatgttctcactcataagtggg

SEQ ID NO: 13576 - DNA, 201 bp, Homo sapiens
agtcctctggaaaggaacttgtgcacatctcaatggcacatctggtagctgcaaatggtgtggattagcataatttttccagcaatgatgcaccaaaagtwtaatgcaaaataagacttatgcctgctgtcaattgtttgttcttgcaaatgttaatataaaactttctagtggtggctataatgcttactatcagctcaa

SEQ ID NO: 13577 - DNA, 201 bp, Homo sapiens
tgtactcagccatgcaatgaaaaaacttattctatcaccatctgctgatatcctttcagccaattctcttaataaaacatacaagcaaagaaatgcaaggyagacggcaggatgtcaccacacccactataaacatatactgaataagataatcttcaatagattccatagttattttggaactgaccaaaaggtagactg

SEQ ID NO: 13578 - DNA, 201 bp, Homo sapiens
cctttagaatatttctacctggtggttgctgtggaacaaatcaatctacaaaaggagtcaaaacagaaacatattcaagaaaattcaggctattgacatayacatctgtatttagaagctgttatttacttgagatcaaagagccatttgtcagtttccctttgacacttgattacattttacatatttgtgtttttcttg

SEQ ID NO: 13579 - DNA, 201 bp, Homo sapiens
aacagtttccaggatcttattctcataatctatttatatgcctggaactgagctatataatcacctctgctaaactgttagattgacagaacccattgagraagaagtttatgtgttctgactttgacaaactgaatttgaggttgtttcaggagaggaaattcaagctattcacgcaattaaaaaacagaagcatacaat

SEQ ID NO: 13580 - DNA, 201 bp, Homo sapiens
cttcaatatggttaacttatggctccacagtcatcaactccagctgattttcacttattattattaccgaggtggggcaaataaaagcaatcaggtgaaasccttggttcagatttcctccatatttcatgaaatccatcaaacaaatgcccagattatatttcactgtaagatgagcaaaagcacacctcttcagctgca

SEQ ID NO: 13581 - DNA, 201 bp, Homo sapiens
tgcaaaagatgtctcttctgaaatcagtctgaattgttttaaaaaggagtgtcaataaaattaaacccaacctatacactgatttcaagaacaataaaaawaaatagtagccttatgctgtaaagaagtctgtatgaagcgtatggaggtacatacacttggagagatttggcactgaatcttaccttcactgcatttttt

SEQ ID NO: 13582 - DNA, 201 bp, Homo sapiens
tcctctctgatgcaaaagatgtctcttctgaaatcagtctgaattgttttaaaaaggagtgtcaataaaattaaacccaacctatacactgatttcaagamcaataaaaataaatagtagccttatgctgtaaagaagtctgtatgaagcgtatggaggtacatacacttggagagatttggcactgaatcttaccttcac

SEQ ID NO: 13583 - DNA, 201 bp, Homo sapiens
aggaaggtttctgacactctgcttagtgcagagcctggcatataggaaatgtcccaaaagtagatgatggagttaatgaataaatgagccaacaacccagraatttggaagaggcagttacaaattagttttagaatacttagtctgtgttttaaactataaagaatctatgaaggaaacagggtgggattagtcatagac

SEQ ID NO: 13584 - DNA, 201 bp, Homo sapiens
agagagagagagagaaagagaggcataaagagtattttaagaaataatggatgaaaacttcccaaatttgataaagatggaattttgtgacatcaaaaacygaaaggattgggaacaaagctgtaaaaggggtatagtttttgtatgttactgaagttaatctgacataaaatcaaattagattttgaaaagaaaatgaaa

SEQ ID NO: 13585 - DNA, 201 bp, Homo sapiens
ctttataagttacccagtctaaagtatttctttatagcagtgcaagagtggagtaatacacctctatgcacacaaactagaaaatccagataaattcctcraaacagacaccttcctaagattgaatcaggaagaaactgaaactctgaacagaacatgagttaaaaaactgaatcagtgaagtaaaacaacaacaacaac

SEQ ID NO: 13586 - DNA, 201 bp, Homo sapiens
agaagcttataccaagttgttaatggcccagtctccctctagttactcattctgccaccatggtccaatatggctgtggagctttgtccatcagatatccrttctggtcagaaagatggaggaaaagagaaagaagaaaggcacccctttgctgttaagataattttccataatgaccatataacatttctggctacaaca

SEQ ID NO: 13587 - DNA, 201 bp, Homo sapiens
aggccacaggtgagtgagctagacaaggttacgattaagtgtagccggaaagaagttaaagaaagaaatggcaggccacatgattccatgaagtactcatmaaattcataataaaatcacaatcacaggatggttaccttacattctggcttagtttctgatgagtatagttaaaataattccatatacttccttacccag

SEQ ID NO: 13588 - DNA, 201 bp, Homo sapiens
ggcagaattgaacagcctttcctttcccatcaagtaggaaacatttcagtataagaatatttataatatagtattctactttacaattgactccatatccrttttctgagtgatctcaaaataactttactttggttgacttatcttcctatacaatgaaattgctatttgttgaattcaaccaatttcaatttcatatat

SEQ ID NO: 13589 - DNA, 201 bp, Homo sapiens
attaccgaggtaacctccatagtaacacttcctatctttaagctccctgcgaagttggaaatacaagctatatacacacttgaagaatagtatgtaagaaragcaattataagaacaagattaatttttgctacaacttattaactataaaatatttctttaaaaatatatctcaaaaggttagggtaaaaaacaatctaa

SEQ ID NO: 13590 - DNA, 201 bp, Homo sapiens
agttaagttagcagctgaatgagatctaaagccagttctctcactcacagtccagtagttattagaatgtttggtttttttttttttttttggttggttgkttgttttttgagatggagtcttgttctgtcatccaggctggagtgcaatggcccaatctcggttcaccgcaacctccatctcccaggttcaagcgattct

SEQ ID NO: 13591 - DNA, 201 bp, Homo sapiens
acaaatttcaaaattcctgcggatttgaacttttacctggatggccttactagtggaagatgaccaaaattaaagtctcagactgacaaagattaggggayctaataggagatcaccctggtagaagaaaatatagattctttttggaatcccaacataaactcaggtacaagtgaaatagaatgaattggcggcccatta

SEQ ID NO: 13592 - DNA, 201 bp, Homo sapiens
tgacaaatttcaaaattcctgcggatttgaacttttacctggatggccttactagtggaagatgaccaaaattaaagtctcagactgacaaagattagggratctaataggagatcaccctggtagaagaaaatatagattctttttggaatcccaacataaactcaggtacaagtgaaatagaatgaattggcggcccat

SEQ ID NO: 13593 - DNA, 201 bp, Homo sapiens
cttatcctagagatagactcagtcaaaatctctgcaagggtcccaagcattactttggggagaattttggttttaacgtacatgcttggtaaagaaccatkgaagaactgccaattttcagtaatgatgaactaaattttcagaacaatctttctccactggaaaaaaaaatctaaaaagtactatttaaaaaaaaataaa

SEQ ID NO: 13594 - DNA, 201 bp, Homo sapiens
ggagaattttaaaagcatacgggtcttatcctagagatagactcagtcaaaatctctgcaagggtcccaagcattactttggggagaattttggttttaaygtacatgcttggtaaagaaccatggaagaactgccaattttcagtaatgatgaactaaattttcagaacaatctttctccactggaaaaaaaaatctaaa

SEQ ID NO: 13595 - DNA, 201 bp, Homo sapiens
ttcctttattcctaagatacatttttcattaacagttatcaaacctgtgagtcacaggccaagtcaacaaagccaagagacaaaccctggcgacacagagygccggaaaaaaaacaaacttacccctggttgatacggctttgtgtaccaagatagtccctcaagagacatttttcagctggtttctgtcacttgtaatca

SEQ ID NO: 13596 - DNA, 201 bp, Homo sapiens
atgtagccttctattcctttattcctaagatacatttttcattaacagttatcaaacctgtgagtcacaggccaagtcaacaaagccaagagacaaacccyggcgacacagagtgccggaaaaaaaacaaacttacccctggttgatacggctttgtgtaccaagatagtccctcaagagacatttttcagctggtttctg

SEQ ID NO: 13597 - DNA, 201 bp, Homo sapiens
agtttcttcctctataaattagcttttcatattcattgcttattttaagacattacaaataactccatccatttaatcacatgcttattagtgttgtccaygctgtcctttgatgagcagaaattctataagtgatgtcatcaaattcatcaattatgtattttataattttgcttacaaagtttgtttaatatggccttc

SEQ ID NO: 13598 - DNA, 201 bp, Homo sapiens
gggcattaaaagtttcttcctctataaattagcttttcatattcattgcttattttaagacattacaaataactccatccatttaatcacatgcttattartgttgtccacgctgtcctttgatgagcagaaattctataagtgatgtcatcaaattcatcaattatgtattttataattttgcttacaaagtttgtttaa

SEQ ID NO: 13599 - DNA, 201 bp, Homo sapiens
atcagatagttgtaggtatgcggcattatttctgagggctctgttctggcaaagacttggaaccaacccaaatgtccaacaatgatagactggattaagamaatgtggcacatatacaccatggaatactatgcagccataaaaaatgatgagttcatgtcctttgtagggacatggatgaaattggaaatcatcattctc

SEQ ID NO: 13600 - DNA, 201 bp, Homo sapiens
tccatccttctttcatgactgtgctgcttttcctcttcgtgtgtttgacagactgcactaccctcatgagtgggatattgttgcttgttgatggacttgaraagtcaaaatattgtagggaaaaaatgttttcaggtacattttatgtattttcatgcataaaaccttatgtcagctaatccaagtgaaactttacaaaat

SEQ ID NO: 13601 - DNA, 201 bp, Homo sapiens
gcagttgtttggtactttcggtgcacaacgtttatggcagttgaatctgcaatctaatcccagtgattttcaaacaaaacaaaatgagaatttgtcataamgaaaagtggtaaccagaaaatacttatgtcagatgaatgagggtgatcaaagttcgacaggtgacaaaatcatccttacctttgcactgcaagccctgcc

SEQ ID NO: 13602 - DNA, 201 bp, Homo sapiens
taaacgactctgatggtgatttttgctacattttggaaaacaataaaggaagcaagatgtaagaggctatttgatttatatatttatatattttaagataycggtttactcttgtatttagtactttgatgtttaataatatgaaatcatactgtatttctgttaattaatataatttacttgccttccccatttctattt

SEQ ID NO: 13603 - DNA, 201 bp, Homo sapiens
acattttggaaaacaataaaggaagcaagatgtaagaggctatttgatttatatatttatatattttaagataccggtttactcttgtatttagtactttsatgtttaataatatgaaatcatactgtatttctgttaattaatataatttacttgccttccccatttctatttgagttaccttgcttgtataatcttaaa

SEQ ID NO: 13604 - DNA, 201 bp, Homo sapiens
gtacagcttccattttccttgagagtatttggaaattcacattttcttttgaacattctctgaattttttttccaatttgttaatgggttttgaattctgwtcttattgcacaagctcaggaactatgctaggtatcatttttaaaaatgttctgtgatataacagtcttaggcttgaagggatatagaaattaactcaaa

SEQ ID NO: 13605 - DNA, 201 bp, Homo sapiens
cacagtgttttgacagattataggagatggaactcagaggatgctgacacgctcaccgagggctttcatttctgtttcttcagtctcaggagtgtcactgyggctagcacttggattgatcaggtgtgtggggtactgcagcccctgctcgcctgcatacttctcccacctcaggtcatcactttcatgggtgatgtagcg

SEQ ID NO: 13606 - DNA, 201 bp, Homo sapiens
ggccgctttcaccagctgaaggatgttttcagaggtagggtcatggcgaaaaagcaggatcttatcatacattccgtagaaaccacattcagggaactgcraatacaaataccatgagagtgtaaatgtcaaaatccttccaaatattttgttttaaatatttcagggcacaaatacaagctaattagaaaagttcaaagt

SEQ ID NO: 13607 - DNA, 201 bp, Homo sapiens
ttttgaaatctggtcctctgaggtctgttatgatccttggtttatttatttatttttggttttgccttttggttttgggctgtgtgtgtgtgtgtatatgygtgcgtgtatctcttctatcaaattatcctggtagagaaaaatgtttagaaacactaaattgttattaaatcctatgaagttgcatgcatttgagcaaat

SEQ ID NO: 13608 - DNA, 201 bp, Homo sapiens
tgaataaaaatggatagaaaacacttgaaacaaataaaggttttaagggaaaaatggaaggtgacaagatgctacatggaagctagcaatgcttccaactrgctttttgctgagagaggcttttatacttgcctgaggaaaaggatcagctgaggctagcaacacattttctggtttgaggtcacagtgaacgatattttt

SEQ ID NO: 13609 - DNA, 201 bp, Homo sapiens
cgcaaagccacgagtatctgtaaagaagaatcaccaaaatttcattccagtttattaatttcaaaatgtcttctaccagttaaaaggccaagaaaaaaaamtgacaatggacattcaaatttctttatgttaaagacactgaaatgagctagattaacataggtttctaaagaaatttcaatgaaaaaattaccatatgat

SEQ ID NO: 13610 - DNA, 201 bp, Homo sapiens
ctctacattacagaattgattatagaaaaattactaatctatataatttaatatttctaaaatatcacagaaaaaatatccaaattctattttgctttccraaatttactaaaaaattaaaatgaattaaaaaaactattttatgatgcttttattttccagtaatcacattagcaagttttatattagtaggtacatact

SEQ ID NO: 13611 - DNA, 201 bp, Homo sapiens
tgtacatttatcaggattacacatacagatgcttttgaaatctggtcctctgaggtctgttatgatccttggtttatttatttatttttggttttgccttktggttttgggctgtgtgtgtgtgtgtatatgcgtgcgtgtatctcttctatcaaattatcctggtagagaaaaatgtttagaaacactaaattgttatta

SEQ ID NO: 13612 - DNA, 201 bp, Homo sapiens
acttcgttatgtgctctggcaacctgcccttttcacttgacaagatcatttccagcatgtctccatggagtttttccataacaacaaacactctttcaggmgtctcaaacatacactccaaatttacaacaccagggtgatgaaggttctattaaagataaataaagcacttgaagaaaatgagttttttgatactgtttg

SEQ ID NO: 13613 - DNA, 201 bp, Homo sapiens
ggtctcaattttggtggccaaggattgttgggaactctgttaaatctcatattctttgctgcaagtttgggtcttatcagtccatttatttccctagaggygtaaaaaatgtaaatttccacattataacaaatacaaatcccatggaacccagaaatcaatgcaaaaaaatagcagtgtaaactatgaaaaataagttgc

SEQ ID NO: 13614 - DNA, 201 bp, Homo sapiens
aagtactttgtgttctaaaggctatcaggtctcaattttggtggccaaggattgttgggaactctgttaaatctcatattctttgctgcaagtttgggtcwtatcagtccatttatttccctagaggcgtaaaaaatgtaaatttccacattataacaaatacaaatcccatggaacccagaaatcaatgcaaaaaaatag

SEQ ID NO: 13615 - DNA, 201 bp, Homo sapiens
ccccattcttacattctcatctggctaaatcctagtcatccttcagttttcagcttaaacttcattggacttctcttaacttcccttttctcttccgtgtrgataaatatctcccccatgtgcttgtctttaccgtggtaatgtatgataactggtgaatcatttagttttgacttgaacaactgcagggctgtgctgagc

SEQ ID NO: 13616 - DNA, 201 bp, Homo sapiens
tcagtacctaaaactcctacttttcaaatcggcttacttttctccaactctgcttctgtgaataaagccaccatcatctcttacctaaatttctgcttcartgtctctttcccctgcttcactcttcttccttttccaatatattctcaatgctatagcaaaacttgaaccaatgctcgcatggataacggcatgaccctt

SEQ ID NO: 13617 - DNA, 201 bp, Homo sapiens
atttcaattttgtcatattcctacacccaaaacatgggtgtcatccttgcttctttccacttttctgtctccaaatattcagtacctaaaactcctacttytcaaatcggcttacttttctccaactctgcttctgtgaataaagccaccatcatctcttacctaaatttctgcttcaatgtctctttcccctgcttcact

SEQ ID NO: 13618 - DNA, 201 bp, Homo sapiens
acacacactggggcctgtcaccgggttgtaggagggagagtatcaggaagaaaagctaatgcatgttgggctttatacctaagtgacaggttgatctatayagcaaatcaccatggcacgtgtttacctatgtaacaaacctgcacatgctgcacatgtatcccggaacttaaaagttgaaggaaaaaacaaaaagaagaa

SEQ ID NO: 13619 - DNA, 201 bp, Homo sapiens
ctgcactcctggtcagttgttttgacaactggccgagtcaatcacactctcttaaaagcttatctgacaggtgagaaattccttgtctccaggtcattccrggggcactctggtgcaggaaggaggattcctgcaccaggaatgcgctggtccagggtccgtaggggagagaggggaagaaaactgggaagtctcaaggac

SEQ ID NO: 13620 - DNA, 201 bp, Homo sapiens
tattgatcattatactagttatttggtatagtttgagagcttattcaatgattccagtctaatacacacacacacacacacacacacacacacacacacamaaagtttcatataattatccattacactcttctttaaaagatttataaataattaaagattgtggttttctaaaggttttataatggggcatggacttcc

SEQ ID NO: 13621 - DNA, 201 bp, Homo sapiens
gtagttcgttatttaaattcaatttttaaaagtgttactgagtttttctaattacttttattatgtatatcataagaaatttagaaaaggaaaaataaaawaaaatcatctatctcacttcaagctagacataacgactgttagaattttcgagaatttgtttatattttaactaaaaagggaaaaagaaatataagggtg

SEQ ID NO: 13622 - DNA, 201 bp, Homo sapiens
aaaaacaacgcatcctaaaaattacaaattgtttaatttcacaaatttagaaattttttgaatttagaagtttgaacttggaagttttgaatttagaagawtttttatactgtttttgctttcgaagtcagtggtatatccctcttttcaattccagattttgcagttctacatttatgtgtatttttgcacattaagaca

SEQ ID NO: 13623 - DNA, 201 bp, Homo sapiens
agagcttaaatccagatttactgactcttaacttcagaaaatctgttttccattaacgtttcccaattataaggtttttaaggtttctacaggcatgtgtrtgtacacacacacacacacacacacccatcaagactattagcttaaatgaaggtttatttttcctttgaacaggtaatatttgcttaggtgataggagag

SEQ ID NO: 13624 - DNA, 201 bp, Homo sapiens
accagcctggccagcatctctactaaaataccaaaaattatctgggcatggtggcggacacctgtaatctcagctactcaagaagctgaggcaggagactcgcttgaacccgggaggcagaggttgcagtgagccaagatcatgccactgcaccccagcctgggcgacagagtgagactccatctcaaaaacaaacaaaca

SEQ ID NO: 13625 - DNA, 201 bp, Homo sapiens
taaagaatggatgaggagacttgtagtatagcaaaactgacaacgtctatctaggaccatggggttaacagtggagatggagagaaataaacagattttagatatattttgaaaacacaatggacaaaacttggattacatggtggagagaggatggagagacagtagtattgagaatggtttctcagtttctgaaacaag

SEQ ID NO: 13626 - DNA, 201 bp, Homo sapiens
gagaccatcctggaaaacatagggagagcccatccctactttaaaaaataaaaataattaggcaggcatgttggcatgtgtctatagtcccagcaacttgraggctaaggtgggaggatcacttaagcccaggagtgatcctatgattttgccactgcactccagcctgggtgacagagcgagaagaaagaaagagagaaa

SEQ ID NO: 13627 - DNA, 201 bp, Homo sapiens
aacttagcataacatcctcaagattcatcaatagtctatcatgtatcatgtattacttcttttttaaggttgaacaatattccactgtgtgtgtgtgtgtgcacgtgtataccacgttttgtttagccattcgtccatcaatggaacttgggttgcttcgaccctttggctactgtattacgttgttctagcattgctata

SEQ ID NO: 13628 - DNA, 201 bp, Homo sapiens
aaacttagcataacatcctcaagattcatcaatagtctatcatgtatcatgtattacttcttttttaaggttgaacaatattccactgtgtgtgtgtgtgtgcacgtgtataccacgttttgtttagccattcgtccatcaatggaacttgggttgcttcgaccctttggctactgtattacgttgttctagcattgctat

SEQ ID NO: 13629 - DNA, 201 bp, Homo sapiens
tcaatttcagctcaaaatagattgaaacacccaacagattgctgccatagtccacaaatgtttgtcattcgtaagctgtggcaataatgtgaatacagaggagggaaactgcaactgaactacaccttgtaaaaattcctttcatttgctttgtaataacccctgaagaaatgttaagaattattttgaaatcacatatgt

SEQ ID NO: 13630 - DNA, 201 bp, Homo sapiens
attccaatctttccccatgttttaatcagataattagattttttttcctatagagttgtgtaagctccttatatattctggttattaatcctttgtcagaygggtcatttgcaaatattttctcctattctgtgggttgtctcttcactttattttttcctttgctgtgcagaagctttttaacttgatgtgatcccattt

SEQ ID NO: 13631 - DNA, 201 bp, Homo sapiens
caactctcatcttgtagctcccataattcccatatgctgtggaagggacccagtgggagactgttgaatcatgagggctagtctttcccatgctattctcmtgatggtgagtgggtctcatgaggtctgatggttttaaaaatgggagtttccctgcacaagctctctctctttgcctgctgccatccatgtaagacgtga

SEQ ID NO: 13632 - DNA, 201 bp, Homo sapiens
aaaaatcagtagcatttctatacaaaataacattcaagctgagagccaaatcaagaaagcaaccccattcaaaacacacacacacacacacacacacacayatacacacacacacacagtacctaggaatacatctaaccaaggagttgaaagatctctaggaggataactacaaaacattgctgaaagaaatcacagata

SEQ ID NO: 13633 - DNA, 201 bp, Homo sapiens
gacaccttcctaagattgaatcaggaagaaactgaaactctgaacagaacatgagttaaaaaactgaatcagtgaagtaaaacaacaacaacaacaacaacaaaaaaaaaactaccaatcagaaaacgccctaaacagatggattaacagccaaattctatcagacacacaaagaagagctggtaccaatcccaccgaaac

SEQ ID NO: 13634 - DNA, 201 bp, Homo sapiens
agacaccttcctaagattgaatcaggaagaaactgaaactctgaacagaacatgagttaaaaaactgaatcagtgaagtaaaacaacaacaacaacaacamcaaaaaaaaaactaccaatcagaaaacgccctaaacagatggattaacagccaaattctatcagacacacaaagaagagctggtaccaatcccaccgaaa

SEQ ID NO: 13635 - DNA, 201 bp, Homo sapiens
caaaagaatcagtagtttacaaatgaataatccttttaagaagggatgagacaatgttgaagataaagcccacaatgtcaaaccattcacatcaataaacraaaaaaaaaattcctcgtttatgccctaattgaagaagactgatgattaacagcagacataacaccacagacatttcaagtggttcaacttgcacaattc

SEQ ID NO: 13636 - DNA, 201 bp, Homo sapiens
tgccacattactcaatccacattattcactgtaaaattgaaaacatggtttattatctaattattgggtacagggatctatatataagaggatatatatawaaatgcaagatataattcatggaaaatgcatattattaagaaactatgcataaatttcaaaatttttgcaccaaactaaactcatactaacttgctataa

SEQ ID NO: 13637 - DNA, 201 bp, Homo sapiens
tgtgtgtatgcttggaagaagtcactaccatgaagcaggagaaattcactctagtaaaagtggcacacatttcagtggggtcgaagatgtaaagtagataacttgccacttcatcaaagatgatttacaagtttataccaaggtatgaacctaatccacaaagggatcgttatttaaaaaaatgtaaagaggatagtgaca

SEQ ID NO: 13638 - DNA, 201 bp, Homo sapiens
tatggtgatggcttctttctttaaaccttatgaaacaaactctgttagctttcaacttttcttctgtagcttcctcacctctctcagcattcacagaattraagagagttaggaccttactctggattaggatttggcttaagggtatgttgtggctgctttgatcttctatccagaccactaaaactttctccctatcag

SEQ ID NO: 13639 - DNA, 201 bp, Homo sapiens
aaccgtggcttaaaatattcagaaaccatgctgcaaacagatgtgctgtcacacaggttttattccatttatggagcacagacagaacagatttagcatamatcttaaaggccccaggattttcagaatggtcaatgagcactggcttcaacttaaagttaccagctgctttagcccctaacaagggagtcagcctctgct

SEQ ID NO: 13640 - DNA, 201 bp, Homo sapiens
gtccaggctggtctcacacttcttgagctcaagtgatccaccacctcagccttccaaagtgctgggattacagacataagccaccataccagcccaatttmttttcttttcttttttttcttttccttttttttttgagacagagtcttgctctatctcccaggctggaatgctgtggcatgatcttcggctcactgaaac

SEQ ID NO: 13641 - DNA, 201 bp, Homo sapiens
ctttgccagtggagaatctagtctcaatattgatggctgttgattgatcacagtggtgattgctgaaggctgaggtggctgtagcaatttcctcttttttwaaaaaaaaaaaaattgagacagggtcacactccatggcccaggctggagtgcagtggcaatttcttggctcactgcaacctctgcctcccaggctcaggt

SEQ ID NO: 13642 - DNA, 201 bp, Homo sapiens
attttcaggtttctcaatgcatataaaagctatgcttacactacactgtagtcaattaagtctgcaatagcattatgtcttaaaaaatgcacatgcctcawtgaaaaaaaaaatactttattgctaaaaaatgctgacaatcgtctccagtggtctcttgacaggggatgatttcagggtgaaactgttccacctcagatc

SEQ ID NO: 13643 - DNA, 201 bp, Homo sapiens
cattagactctcaacaagtaattcaccagtagtacaagaagcccaaatatgcctccttgtgctactttacccatacacaatccaactaaaaaaaaaaaaaatgcatcctaatgtttaaaatagagttaccacagtaacaaagtgaacagttaaaaagcaatgaacttaatcaatgcaagtcattgttagaaagatcatccc

SEQ ID NO: 13644 - DNA, 201 bp, Homo sapiens
gaattgcttgaactcagaaggcgaaggttgcaatgagccgagatcaggccattatactccagtatgggcaacaagagcgaaactaaaaaaaaaaaaaaaaatgtatgcaaaaggcaagagaacaatctaacaacattgttatacaagattcccaagagtaaactgttcaaaaagcaatgttctccagctagtaaatctagc

SEQ ID NO: 13645 - DNA, 201 bp, Homo sapiens
tgcccaggctggagtgcaatggcacaatctcggctcatcgcaacctccgcctcccaggttcaagcgtttctcctgcctcagcatccccagtagctgggatyacaggcatgcgccaacacacctggctaattttgtatttttagtagagacggggtttctccatgttggtcaggctggtctcaaactcctgacctcaggtga

SEQ ID NO: 13646 - DNA, 201 bp, Homo sapiens
tagttttgctttttgaataaagaaagagttgatccctcttattgatataagcattaatcaattgactgagtttaacaatccctggaattagccagccccaygggattttttaatttggcttaacctatctacaacatcatgatttcccaatgtctatgctagtttttaatctcattgctcatatttctgtaaagttttctt

SEQ ID NO: 13647 - DNA, 201 bp, Homo sapiens
acccctcagaaataataccacacatctacaaccatctgatctttgacaaacctgacaaaaacaagaaatggggaaaggattccctgtttaataaatggtgytgagaaaactggctagccatatgtagaaagctgaaactggatcccttccttacaccttttacaaaaattaattcaagatggattaaagacttaaatatta

SEQ ID NO: 13648 - DNA, 201 bp, Homo sapiens
agccccaaatctccttaagctgataagcaacttcagcaaagtctcaggatacaaaatcaatgtgcaaaaatcacaagcattcctatacaccaataacggayaaacagagagccaaatcatgagtgaactcccattcacaattgcttcaaagagaataaaatacctaggaatccaacttacaagggatgtgaaggacctctt

SEQ ID NO: 13649 - DNA, 201 bp, Homo sapiens
ctcagccccaaatctccttaagctgataagcaacttcagcaaagtctcaggatacaaaatcaatgtgcaaaaatcacaagcattcctatacaccaataacrgataaacagagagccaaatcatgagtgaactcccattcacaattgcttcaaagagaataaaatacctaggaatccaacttacaagggatgtgaaggacct

SEQ ID NO: 13650 - DNA, 201 bp, Homo sapiens
cggagcagaaatgaaggagatacagacacaaaaaacccttcaaaaaatcaatgaatccaggagctggttttttgaaaagatcaaaaaaaattgatagaccrctagcaagattaacaaagaagaaaagagagaagattcaaatagacacaataaaaaatgataacagggttatcaccactgatcccacagaaatacaaacta

SEQ ID NO: 13651 - DNA, 201 bp, Homo sapiens
atcacaaagaagctaaaaaccttgaaaaaagattacacgaatggctaactagaataagtagtgtagagaagtccttaaatgacctgatggagctgaaaacmatggcacaagaactacgggacgcatgcacaagcttcagtacccgattcaatcaactggaagaaagggtatcagtgattgaagatcaaattaatgaaatga

SEQ ID NO: 13652 - DNA, 201 bp, Homo sapiens
cttgaacttgggaggtagaggttgcagtgagctgagattgtgccaatgcactccagcatggatgacagagcgaggctctgtctcaaaaaaaaaaaaaaaaaggagtaaaaacaatgcaaaaaccattatattatgtaggtatacacatatgactctacatgatccatgaattaccctcaaatttatttttctgatgagctg

SEQ ID NO: 13653 - DNA, 201 bp, Homo sapiens
caatggacctaaattttgaaatatctttttaaaatgtatttggaaaaatgtggctaccaaatatgatccaattcataggttcttcagattttgagataacrctttagaatgcaaaaaatgagatattcataatgtggagcattaattcagaatttaagattatagctatttgggggacagaggaacaaaacaaaaactttt

SEQ ID NO: 13654 - DNA, 201 bp, Homo sapiens
aagtttcatgagactagtgagccttgagactatcttttcccttgagtacacaatatcatattggttcttactatacaatgcctttcaagaaaccctctccwttgcccactgttcatcatagtcttaatctggctattgtcctgacttttgattctccttgatagctttctcaaccagcaaatccatgacacaatgcatgct

SEQ ID NO: 13655 - DNA, 201 bp, Homo sapiens
tttttaaagaataggaaaggagttgggagagattataactgaaaagggaaacaggagagctggcaatattccttttctagacctgggggtgactgcatggktttgcatgttataacaatttattaaaccatactttcagctttgtagactttcctgggtatatgttatatttcacagtgaaaacaatattagaagaagaaa

SEQ ID NO: 13656 - DNA, 201 bp, Homo sapiens
ttttctgccaaaattatagtttcctaacggagtaaataaaaaaactctccctaccaagagagggagattaaagcatggaagagagaaagaaaaaaaaaaaagctacttcaatgagtggagtgtgcattgtggaagaaaaagagggaagtggtaaccacagaaggtggagagagaataattatcagcagcaagactgagcca

SEQ ID NO: 13657 - DNA, 201 bp, Homo sapiens
aagaacccatgagggcatcaccaacttaatatgatgaggtcaaaggccaaaaagtgatgcaattaacacagcgatttaatttcacttttctgtttgtgtgmaatcatcaaagagcagcctacggtacataaaaaaagtaaaaagaatatgtttagaaacgaacttttctgatttcctgttttttcataacctttactttct

SEQ ID NO: 13658 - DNA, 201 bp, Homo sapiens
acaagtaagatatatatctacccagtttttccagttcaggatcacgaatggccagagcctattccagcagctcaaggccaaggcaggaaccagccttggamaggacatcatcctatcccaggatgcatgaacgcgcgcacacacacacacacacacactcacactcactcagactggggccatgtagacatgctaattcac

SEQ ID NO: 13659 - DNA, 201 bp, Homo sapiens
tatgaatttttaaaaaatactaagtctgccagagctccaaattatatacagtaactcctcattcaatgtcattggtaggttcttgggaactgcaactttaygtaaaataatgtataacaaaaccaattttaccataagctagttgatataaacaaaacttaagttcctacagcatatttctggttacaaaaacatcaccaa

SEQ ID NO: 13660 - DNA, 201 bp, Homo sapiens
cattcttccacataaaagtccactggtacacactgtcatctgattcaggtttctgtctaaatatccttctattatttatctcattgtgtgtgtacatatayacacacacacacacacacacacataatccctctactcattaacatgtgagctcacttggggagcgactgtgtgtgtgctttggttcattactgtatcccc

SEQ ID NO: 13661 - DNA, 201 bp, Homo sapiens
aaaatagcaagttacacttgaccccatgaaaggctgaaataaaaaatgagatattgaggaaaaaatctatagatgttcatgttctttgctttaggataccrtaaaaaatgagtatcaaggtaaaatgttatactgtgactatgcataaaataatcgctttcatttttcatgcatataatcgatcaatatatatctatgcta

SEQ ID NO: 13662 - DNA, 201 bp, Homo sapiens
acagtaaaaaatagcaagttacacttgaccccatgaaaggctgaaataaaaaatgagatattgaggaaaaaatctatagatgttcatgttctttgctttasgataccgtaaaaaatgagtatcaaggtaaaatgttatactgtgactatgcataaaataatcgctttcatttttcatgcatataatcgatcaatatatatc

SEQ ID NO: 13663 - DNA, 201 bp, Homo sapiens
gcttctttctttctttccttccttccttccttccttctttctttctctctctctttctttctctctgtctctctctctttcttttttctttttttttttttggagacagagtctcactctgttgcccaagctggagtgcagtgatgccgcaatcttggctcagtgcaacttccacttcccaggttgaagtgagtgattctt

SEQ ID NO: 13664 - DNA, 201 bp, Homo sapiens
cagtccggcctgggcgacagagcgagactccgtctcaaaaaaaaaaaaaaaaaaaaaaaaaaaaaaaaaatactctgccagtttacttttgctaaaaggtraggattcaataaaagtcctgaaattaaattattctggtcaataatggaatacatcaggcagttgaatattgcaaccttctcattaaatatgattctcaag

SEQ ID NO: 13665 - DNA, 201 bp, Homo sapiens
aaagggtgcttttccatagttgggccaatcacaaaaggcaagcaatactagaaacaaattaatccatgactcagtcaagtggaacaaaacggaaagagagwcatggcccaattaggaaatgaaaatactcggccgggcgcggtggctcacgcctgtaatcccagcactttgggaggccgaggcgggtggatcatgaggtca

SEQ ID NO: 13666 - DNA, 201 bp, Homo sapiens
ttactttttttccttttctatattatttgatattatttgttgatacttctttttatcttctctcctggtttatttgtataattatcctatttcacacacamtgaccttaaagctgtatatttccatttctcctcttcctgcctttatgctatttttctatgtcttttacatacacaaatgttagaaaaaccaaaatagaat

SEQ ID NO: 13667 - DNA, 201 bp, Homo sapiens
tctttaaatccctgtgtctttataaagttgttgtacacacgtatatatgactccctcatctttttgtgcagtctgacaatctctactttttttttttttttattttttttgagaccgaatctcactctggcgcccaggctggattgcaatggtacgatcttggcttatggcaacctccaactcctgggttcaagtgattct

SEQ ID NO: 13668 - DNA, 201 bp, Homo sapiens
agaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaactacct

SEQ ID NO: 13669 - DNA, 201 bp, Homo sapiens
gagaaatggtcagtgatgttggaaaaaggatataaaatttaagttaggaggaataagttcaagatatctattgtataatgaggtgactatagataataatattatattgtatttttgaaagtcactaagataatagaaaaatttaagtgtacttaccacaaaaaaaaggtaagtaagtgaggtatgcatatgttaactacc

SEQ ID NO: 13670 - DNA, 201 bp, Homo sapiens
aaaaacaaactcaaaacagattacagacataaagataagacctaaaactataaaattactagaagatgtggagacaactccatgacattggtatgggcaaygatttttttatatgaccccaaaagcacaaacaaaaaaaagcaaatatagacaaacgttaagacatcaaactaaaaagcctctgcacagcaaaggaaacaa

SEQ ID NO: 13671 - DNA, 201 bp, Homo sapiens
attatatttattattgtagctttatcctaagcctgaaattcaggtagtgagagccttccaatgtcttttccctttcaagattgttttggatataggaccaytgaatttccatatacattttagaaatgctttgttgatttctacaaaaagttgtgaatttataaaaagcccactctatcatgtatttctttatagaccatg

SEQ ID NO: 13672 - DNA, 201 bp, Homo sapiens
ttgagctgtatgtctatccttaataaacataccaccacattatatttattattgtagctttatcctaagcctgaaattcaggtagtgagagccttccaatrtcttttccctttcaagattgttttggatataggaccattgaatttccatatacattttagaaatgctttgttgatttctacaaaaagttgtgaatttata

SEQ ID NO: 13673 - DNA, 201 bp, Homo sapiens
ccctttgtcagatgagtaggttgcgaaaatcttctcccattttgtgggttgcctgttcactctgatggtagtttcttttgctgtgcagaagctctttagttaattagatcccatttgtcaattttggcttttgttgccattgcttttggtgttttagacatgaagtccttgcccgtgcctatgtcctgaatggtaatgcct

SEQ ID NO: 13674 - DNA, 201 bp, Homo sapiens
gtgtaatgatatctcattgtggttttgatttgcatttctctgatggccagtgatggtgagcattttttcatgtgtcttttggctgcataaatgtcttcttwtgagaagcatctgttcatgtcctttgcccactttttgatggggttgtttttttcttgtaaatttgtttgagttcattgtatattccggatattagccctt

SEQ ID NO: 13675 - DNA, 201 bp, Homo sapiens
gtgggagaggagctgggagagtactgctgtcgatggttataggtaagcgcaggagatctaaacataattgagtgtgcgtgtgtgtgtgtgtgtgtgtgtgkaattgatatactaactgaacaatttaaagggtcaatgactttgggaaaatggcactatgtcgttcaaaactagaattaaactgttagagaatagctcctt

SEQ ID NO: 13676 - DNA, 201 bp, Homo sapiens
caaattagccagaagcagcttggttagttttcactcccaaagcagttaaaagatgatgaaaagtctgagcagaaaatgatataagcaaagaaaaaaaaaaatcttgatgttgtctgaagaaataaaattaaccttgaaatttttccctattttttctctcatttttactgcagtcctgtgtcagaaaatgttcctgctggt

SEQ ID NO: 13677 - DNA, 201 bp, Homo sapiens
aagattcaacatttatctttcaaacttttaaaactgtgactttatttgaggaattcttgtagtccttttctagtctctatttaactacctacaagatacayacacatatagacataaacacacacatatatacactgataattattagagatcaagccaaaaccaaccaaacaaacagtgttttgagtcatgtaaatgtag

SEQ ID NO: 13678 - DNA, 201 bp, Homo sapiens
tttccctgagctctcacaggcacttctgctactgccatgtgaagaaggtccttgcttccccttcaccttctgccatgattgcaagtctcctgagccctcccaaccatgtggaactgtgagtcaattaagcatcttttctttataaattacccagtctcatgtagtatctttatagcagtgtgaaaatggactaatacacag

SEQ ID NO: 13679 - DNA, 201 bp, Homo sapiens
tcctgttgtgccatcaaggccctaacatggcacttacataaattagaccagaccgttaaacttccattctaagaagcaaatataaggaatttttagcttcwcagtaaccagagcatagagacaaaagtcccctttgtgtggttttcattgccctcgtgttcttttcctgttttcatgggtgacagttataatactgtcttc

SEQ ID NO: 13680 - DNA, 201 bp, Homo sapiens
gaacagaaaatcaaacaccgcatgttctcactcataagtgggagttgaacagtgagaacacatgcacacagggaggggaacaatcacacaccggggcccgytgggggatggagggctaggggagggataacattaggagaaatacctaatgtagatgacgggttgaggggtgcggcaatccaccatggcacatgtatacct

SEQ ID NO: 13681 - DNA, 201 bp, Homo sapiens
acctagcataatatgatctgaggctgatattctatatttctggtctcagacttaaatcctcttaacatctcagaatcacaagagcccaaaattgggatacygaagatattctttcacatttcccctttcagatcagtttatcaaatgaaataaattcctttgaaatttattaggattgtaataaattaatgattaatctgg

SEQ ID NO: 13682 - DNA, 201 bp, Homo sapiens
ttattctatggccttgacatttcctaaacgattgctcagtaatacaatgcgtgatgtattttaaaatctgctacttggtaaagaatttgggcattttttttgatgcaaatgagaaacatctattatttacttagaaacaacttctgcaaagtatttgaactcaacaagcagtgcaattctggtattcttactaactggtta

SEQ ID NO: 13683 - DNA, 201 bp, Homo sapiens
aatttatgagttaccccccttataaaagtgggtcattttagaaatgtaaaaatctctttaaatggagttcagaaaaaacttcctgttcattttttttttttaaatatagaggtcctttagttcaagtgcacctgttggatgattccattggagactttagtccaagtgcacctgttggatgattccattcctgccattaaa

SEQ ID NO: 13684 - DNA, 201 bp, Homo sapiens
gatctttggtttaatattttagaaagatgagcaattataactcaaagaatgagcaaaagatgtatctttatcctcatctgtgtgtgtgtgtgtgtgtgtgkacagtcttttctatgcaatactggaccagctaactataactcaagttcagatgtttatgcttaggaaaaaaacatttctattttggactgtataagctct

SEQ ID NO: 13685 - DNA, 201 bp, Homo sapiens
tgagaatatgtggtgagttgaaaagctcaagaagcaaaaggaaaaaaaaaataggagaagttagattactggaaaatttattttgcttctgagtaatcacagttttattacatttatgtgtttccataactgagatgaataatattgtcacatgggatgaagggaagaatgaataagctgtctgtgtcactgttataaaga

SEQ ID NO: 13686 - DNA, 201 bp, Homo sapiens
gtttaatgctaacagacaaaatagaaaaagctattcaattatatttttgtttttatcttttctagaaaaatagaccatctttaaactaaaagaaaaaaaaataggaagaagtaacatatcaagaagaaaacaaagtctaggatggatgagaaaggggctttaaagaaattattttcaataggcccaaatgaattatagatg

SEQ ID NO: 13687 - DNA, 201 bp, Homo sapiens
acactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgtaac

SEQ ID NO: 13688 - DNA, 201 bp, Homo sapiens
tacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgtaa

SEQ ID NO: 13689 - DNA, 201 bp, Homo sapiens
ctacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgta

SEQ ID NO: 13690 - DNA, 201 bp, Homo sapiens
gctacactaggtaatacagaatctgaactgaggcagtcctgacaccagaaccatataaactctctcagccaccattactcaacttgtatttttttgactatttaaacactatggattataagctgcacctttattttatgtatcactgaaaaatattttttaaagagtacaattaaatacatataacacacaaccccttgt

SEQ ID NO: 13691 - DNA, 201 bp, Homo sapiens
agacatttttggaattaatcagaaggaatataaataattaaactaaagattttcagtgacactcctccaatttatgctaggtaaatttgttttttttttttctttcattttttgaagaggattaacattcataagcagttagcacccttgacttatgtttaaatgccatatttctaaagttcaattttaatattctcctgt

SEQ ID NO: 13692 - DNA, 201 bp, Homo sapiens
cttttgaataactatttttttttttaaaaaagcagtataacctatttggattctaataatgttatctactaactcattcagtaaataatttttatttttaytttatttattattattttttgagacagagtctcattctatcacccaggctggagtgcagtggcatgatcttggcccaatgcaacctctgcctctcgggtt

SEQ ID NO: 13693 - DNA, 201 bp, Homo sapiens
ttatctttaatctggccatgttgatttattttcaacatgtctctatatggttaagtctctatacagtaagagaatgaatgaaaatatgtcttctccatgtkaaaaaaatcaatatgggaaaagacataaaaaacatacagatcacagattaatagaggataacagtcataatacataaagactataagcaaccaataagca

SEQ ID NO: 13694 - DNA, 201 bp, Homo sapiens
ctctgtagagcctcttaacttcaaagctaaattagtagatacctccttaaagtcacttaaaaacatttaagataactttagtaaagttatttaattttttwaaaaaaatccataatgtaaaaaatgctgtgtcatcaattatatcctatggtcacacaggtcatccaatatcttaaattctgcttcattttccaccttgac

SEQ ID NO: 13695 - DNA, 201 bp, Homo sapiens
tttttttcctgggtagccacattcatgaggacatataaactgttgaagtgaacataagtaacctttttttcatattttttatttattatttatgtatttayttttgagaccgagttttgttcttgttgtgcagtctagagtgcaatggctgtgatctctgctcactgcaacctccacctcccaggttcaagtgatactcct

SEQ ID NO: 13696 - DNA, 201 bp, Homo sapiens
tttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaacctttt

SEQ ID NO: 13697 - DNA, 201 bp, Homo sapiens
atttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaaccttt

SEQ ID NO: 13698 - DNA, 201 bp, Homo sapiens
atatttgaaaagacacaaatattttagaggctgaattttctctagtttctagaagtctaatttatagtaccaattccaatcttctactctcctctctccttctcattattatttcttctatagaaatctttcttttttttttttcctgggtagccacattcatgaggacatataaactgttgaagtgaacataagtaacct

SEQ ID NO: 13699 - DNA, 201 bp, Homo sapiens
tattattaaaatggcaacatcatcactctttttgagaaggcaagaaggaattcatctgattagattaaatcaagtatcagaataccatgtctaaggggttsagtaaaataatgtatctaaatatttgaaaagacacaaatattttagaggctgaattttctctagtttctagaagtctaatttatagtaccaattccaatc

SEQ ID NO: 13700 - DNA, 201 bp, Homo sapiens
ggtaacattcttgagattcagcttacatcttgggaaaaacatgtcctgtaacttacgcttatctattttgtgaccttgcagctgcacagcaagaagaaaarcagaaacttagagaccttacaatatatgtgggaaacagataaggtgtcttacagtttctacagaaaagcagttaatattcttttctaacttttacttcaa

SEQ ID NO: 13701 - DNA, 201 bp, Homo sapiens
agtttatttaaggtgtacactggcttagtggacatgtatcctgaaagactgagcactagacaaagaagttgccttttaagcagtttttggcaggaactacktgatgcaggaatcaggcttacagaagcaagaactaaagcagttaatcattaggtaacattcttgagattcagcttacatcttgggaaaaacatgtcctgt

SEQ ID NO: 13702 - DNA, 201 bp, Homo sapiens
ttcagcaccagaaatgttgcagtgaattaagggaccagagagactgaatggggggggcaggagagtttatttaaggtgtacactggcttagtggacatgtrtcctgaaagactgagcactagacaaagaagttgccttttaagcagtttttggcaggaactacttgatgcaggaatcaggcttacagaagcaagaactaaa

SEQ ID NO: 13703 - DNA, 201 bp, Homo sapiens
accagtttttcctgtggctttccttttgtctctgtgtttgctgatgaagtttttatttgtggtttggtttttgttacaagtttttctaattttttttttttaattttgtgtttactggtgaagtttttactttgtgtttgtagttgctagtgtagttgatttttttttggctcgagctgcgagagtttgtaataagctgtt

SEQ ID NO: 13704 - DNA, 201 bp, Homo sapiens
aatgccttacagctaaacttttatgatttttttctatttcacaaggacaatcaattctttaacttttctacttcaatcccccctttggtgctctgtataaatgatgtttaataaagagcaccacaatttttttttttttttgagtggctacacattttttttgaggcaaggcctggtacttggttaaggccatgatttgag

SEQ ID NO: 13705 - DNA, 201 bp, Homo sapiens
atgtcttacagtttctacagaaaggcagttaacattcttttttaacttttacttcaagggggttcaccaatgccttacagctaaacttttatgatttttttctatttcacaaggacaatcaattctttaacttttctacttcaatcccccctttggtgctctgtataaatgatgtttaataaagagcaccacaattttttt

SEQ ID NO: 13706 - DNA, 201 bp, Homo sapiens
gagctaactgtcaaatatcctaaatatatagcataaataaaatctaatcaacaccttttcacaacagtgaaacggtggctacagggcaagcaaaaaaaaaatatgtgcccactgcttagtggtgacagatactgtgttataccatggagaatccatttcttaaatgtttacagcaatttgtgaaagctttcaaagtaataa

SEQ ID NO: 13707 - DNA, 201 bp, Homo sapiens
taaatggtgtttaaattaattttcactcttagtctctattccaatttggccccatgtatttggtgaacctgaaaaatctgcagaatgatttttttttttttaatgagaagaggagggaaagttgaaatgctttggaaagtctgttttgttctgcttcattaatatgttcagagaaaaaaatggctcaaaacttaaagagca

SEQ ID NO: 13708 - DNA, 201 bp, Homo sapiens
gcgggtggatcacgaggtcaggagttcaagaccagcctggccaagatggtgaaaccccgtctctactaaaagtacaaaaaaaatcagctgggcatgttggygggcacctgtaatcccagctacttgggaagctgaggcagagaattgcttgaactcgggaggcagaggttgcaatgagccaagattgtaccactgcactcc

SEQ ID NO: 13709 - DNA, 201 bp, Homo sapiens
tagggaggtagtttatacttcaggtgtatttttctcccttccttccttccttccttccttccttctttccttccttctgtttttattatttttttttttttaggaatctcactctgttgcccaggctggagggcaatggcacgatcttggctcactgcaacctcgcctcccaggttcaagtgattctcctacctcagcctt

SEQ ID NO: 13710 - DNA, 201 bp, Homo sapiens
ggtccacggcctggggactgaggacctctgttttagaagaggaatagggaggtagtttatacttcaggtgtatttttctcccttccttccttccttccttycttccttctttccttccttctgtttttattatttttttttttttaggaatctcactctgttgcccaggctggagggcaatggcacgatcttggctcactg

SEQ ID NO: 13711 - DNA, 201 bp, Homo sapiens
aggtgggaattgaacaatgagaacacatggacacaggaaggggaacatcacactctggggactgttgtgggatggggggaggggggagggatagcattagkagatatacctaatgctaaatgatgagttaatgggtgcagcacaccagcatggcacatgtatacatatgtaactaacctgcacattatgcacgtgtaccct

SEQ ID NO: 13712 - DNA, 201 bp, Homo sapiens
actgcatgctctcactcataggtgggaattgaacaatgagaacacatggacacaggaaggggaacatcacactctggggactgttgtgggatggggggagkggggagggatagcattaggagatatacctaatgctaaatgatgagttaatgggtgcagcacaccagcatggcacatgtatacatatgtaactaacctgca

SEQ ID NO: 13713 - DNA, 201 bp, Homo sapiens
acaaaaaaaaaaacaaacactgcatgctctcactcataggtgggaattgaacaatgagaacacatggacacaggaaggggaacatcacactctggggactrttgtgggatggggggaggggggagggatagcattaggagatatacctaatgctaaatgatgagttaatgggtgcagcacaccagcatggcacatgtatac

SEQ ID NO: 13714 - DNA, 201 bp, Homo sapiens
actatcgcaaggacaaaaaaaaaaacaaacactgcatgctctcactcataggtgggaattgaacaatgagaacacatggacacaggaaggggaacatcacwctctggggactgttgtgggatggggggaggggggagggatagcattaggagatatacctaatgctaaatgatgagttaatgggtgcagcacaccagcatg

SEQ ID NO: 13715 - DNA, 201 bp, Homo sapiens
aaaaattaattcaagatggattaaagacttaaacgttagacctaaaaccataaaaaccctagaagaaaacctaggcattaccattcaggacataggcatgrgcaaggacttcatatctaaaacaccaaaaagcaatggcaacaaaagccaaaattgacaaatgggatataattaaactcaagagcttctgcacagcaaaag

SEQ ID NO: 13716 - DNA, 201 bp, Homo sapiens
tcaaactatactacaaggctacagtaaccaaaacagcatggtactggtaccaaaacagagatatagatcaatggaacagaacagagccctcagaaatgacrccgcatatctacaactgtctgatctttgacaaacctgagaaaaacaagcaatggggaaaggattccctatttaataaatggtgctgggaaaactggctag

SEQ ID NO: 13717 - DNA, 201 bp, Homo sapiens
gccaaaagaacaaagctggaggcatcacactacctgacttcaaactatactacaaggctacagtaaccaaaacagcatggtactggtaccaaaacagagayatagatcaatggaacagaacagagccctcagaaatgacgccgcatatctacaactgtctgatctttgacaaacctgagaaaaacaagcaatggggaaagg

SEQ ID NO: 13718 - DNA, 201 bp, Homo sapiens
atttggggaggctgaggtgggaggatgacttaagttcagaagttcaaggccagtctgggtaacatagagaggctccatctctaccaaaaataaaaaaaaaagttagccaagcttggtggggcatgcctgtagttccagctcatcaagaggctgaggtgggaggattgcttgaacctgggtcaaggctgcagcgagctgtga

SEQ ID NO: 13719 - DNA, 201 bp, Homo sapiens
ctcttgtgaacaggtgtcactggttgactgttacatcaacgaggtcatgatcaaatataactcactggactccgaggattcagaaattctcagatcactcmtattaagaactgtttgctcataccatccactggaactagagtataattatacttttgttgtgccactaattagcagagatttatcctggtttaatatagt

SEQ ID NO: 13720 - DNA, 201 bp, Homo sapiens
taatgactttttttttcttttccttttttttggagacagattctcactctcttgcccaggctggactgcagtggtgcagtctcagttcactacagcctccmcctctcgggttcaagagattattctgcctcagtctcccaagtagctgggattacaggtgcccgccaccatgcctggctaatttttgtatttttcgtggaa

SEQ ID NO: 13721 - DNA, 201 bp, Homo sapiens
tttttttttttttgttttgacggagtttcactcttattgcccaggttggagtgcaatggcaaatctcggctcaccacaacctctgcctcccaggtccaagmgattctcctgcctcagcctcccgggtagctgggattacaggcatgcaccaccatgcctggctaattttgtatgttttgtagagatggggtttctccatgt

SEQ ID NO: 13722 - DNA, 201 bp, Homo sapiens
gaaagttggagaagaggggagagacgcaatgactggggagtcctcctacctaaattatctgaatgatatgaatccttatgtgcctctacctgtattcctctttttttttttttttttgttttgacggagtttcactcttattgcccaggttggagtgcaatggcaaatctcggctcaccacaacctctgcctcccaggtcc

SEQ ID NO: 13723 - DNA, 201 bp, Homo sapiens
tatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaacaat

SEQ ID NO: 13724 - DNA, 201 bp, Homo sapiens
ttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaacaa

SEQ ID NO: 13725 - DNA, 201 bp, Homo sapiens
gttatacataaatgcattcagttataatctttatacacaattgtagttttatatatatgaatgcttacatttataaaaaactaaatacatacatacagatagacagaagtaaagactataaagtgactgggaaacggaaaatgatcaatatttaaactaatatagacatgccaatcactgtgctaagcagtttccagaaca

SEQ ID NO: 13726 - DNA, 201 bp, Homo sapiens
aaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcaggtg

SEQ ID NO: 13727 - DNA, 201 bp, Homo sapiens
taaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcaggt

SEQ ID NO: 13728 - DNA, 201 bp, Homo sapiens
ctaaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcagg

SEQ ID NO: 13729 - DNA, 201 bp, Homo sapiens
actaaaggcaaaattatcagattgtgatgcactaaaggcatttcctatgctttgcattattcctaaagttgtgtgtgtgtgtgtgtgtgtgtgtgtgtgtgtgtttgtgtcaccaaatgtcaaggcttcccatctggtcttaattcctgagaataccgactaaccatgtgactctgaagctgagcagaaacaactcagcag

SEQ ID NO: 13730 - DNA, 201 bp, Homo sapiens
cagtgcactaaaggcaaaattatcagattgtgatgcactaaaggcatttcctatgctttgcattattcctaaagttgtgtgtgtgtgtgtgtgtgtgtgtrtgtgtgtgtttgtgtcaccaaatgtcaaggcttcccatctggtcttaattcctgagaataccgactaaccatgtgactctgaagctgagcagaaacaact

SEQ ID NO: 13731 - DNA, 201 bp, Homo sapiens
ttcagtgcactaaaggcaaaattatcagattgtgatgcactaaaggcatttcctatgctttgcattattcctaaagttgtgtgtgtgtgtgtgtgtgtgtrtgtgtgtgtgtttgtgtcaccaaatgtcaaggcttcccatctggtcttaattcctgagaataccgactaaccatgtgactctgaagctgagcagaaacaa

SEQ ID NO: 13732 - DNA, 201 bp, Homo sapiens
cttcagtgcactaaaggcaaaattatcagattgtgatgcactaaaggcatttcctatgctttgcattattcctaaagttgtgtgtgtgtgtgtgtgtgtgrgtgtgtgtgtgtttgtgtcaccaaatgtcaaggcttcccatctggtcttaattcctgagaataccgactaaccatgtgactctgaagctgagcagaaaca

SEQ ID NO: 13733 - DNA, 201 bp, Homo sapiens
tttctggacattatattttcagtatacgtcattaatagttcattatttattaaagtcattccctcacacttctcattcttgtaataacttccatgtttctytttttgaattttagcattttcttcccaaaaagagcttagtgaaatctgccaacctaataggaagcatttatatttcaaagagttaatttttgcccttaac

SEQ ID NO: 13734 - DNA, 201 bp, Homo sapiens
tctgtaacatatgcataattcatttatagtttatttcacatctgctatttcacacagttaaatgcagcatagtgacaaggcactagaaccaaaaaaaaaaatcctcttaagaatactgaaactttggccttcattttattttggatactaaaaaaaaaaaaaaaaaaaaaaaaaaaagaagaagttggaagtaattatgga

SEQ ID NO: 13735 - DNA, 201 bp, Homo sapiens
accctggaaagggaaaataaaaattatttttattgaaccataaattaaaaagtgattccaatattagtgtaaagtagaaatttaaaaaatagtacagcttycattttccttgagagtatttggaaattcacattttcttttgaacattctctgaattttttttccaatttgttaatgggttttgaattctgatcttattgc

SEQ ID NO: 13736 - DNA, 201 bp, Homo sapiens
cacaaagctcatattatcaaccctcttactttacttttcctgattacttgcaaataagagcagatagccagatggctttgagtattatgggagggccagakgctaaggaggcgactaatatgacgacatacacttgtttgataggcactatggaacatgtgatagtattgttcatacttgaacttgtgtcccaggctgtct

SEQ ID NO: 13737 - DNA, 201 bp, Homo sapiens
atctaatatcagctgtgaccaccctgtgccagatacgattaatagttgtgctggtgtgtttgtcaggtcctacaagcttaaaattaaaactatttggtctyaactccattaaaacttctaatgatggaattatttcttctcaataagataatgggatagaacctgggccagtaactacttttgtgacaccttaactgatat

SEQ ID NO: 13738 - DNA, 201 bp, Homo sapiens
ctttgattctgatgccttgggtcaaatcatacagcataatggagtcatggaattgcaagtttattatgaatgtgatctgagcagacgcctacacatctacmcaatagcctttaacctctaaagggctagagtcattgttcttcaaaccgttgcactgttaactggtcaagtctggcaacttcgaatagacctcacctccca

SEQ ID NO: 13739 - DNA, 201 bp, Homo sapiens
aattttgttttacattgtatacgtgcttatgaagcattgctgtttcattaactggtctgcatccaaatggagaggattgtatacaaggctttcacagtgcmtaggagtgctcctgctgacccacaatagacattccacaatactgatgtggaaaaggagcatgatatgacttacatcagcattagacaaaacgtgtcattt

SEQ ID NO: 13740 - DNA, 201 bp, Homo sapiens
acaggagacttggaggggacaaaacatccaaaccatatcaatattctattctccttgactaacacaaggccttgttagtccttggatctttagaggaaaamgagattctctgtctctgaatgtacacattcataaagaaattcaacagataaaagaataatactgatctcaagtgtttaaaatgcatacatacatgtactt

SEQ ID NO: 13741 - DNA, 201 bp, Homo sapiens
gtaaactagttcaaccactgtggaagtcagtgtggcgattcctcagggatctagaagtagaaataccatttgacccagccatcccattactgggtgtatamccaaaggactataaatcatgctgctataaagacacatgcacatgtatgtttattgcggcactattcacaatagcaaagacttggaaccaacccaaatgtc

SEQ ID NO: 13742 - DNA, 201 bp, Homo sapiens
ctcacccaatttcatccctataattctcttacctaataataaatgtaaatcacatttacatattagtgtttgtccatttgcatcgctataaaggaataccwgagcttgagtaatttataaagaaaataggttaattttggctcatggttctgcaggctgtataggaagtctgatgccagtatctgtttctggtaagggcct

SEQ ID NO: 13743 - DNA, 201 bp, Homo sapiens
tcccgaatagctgggtttacaggcatgtgccaccaagcccagctaatttttgtatttttagtagagacggggtttcaccatgttgaccaggatggtctccrtctcctgacctcgtgatctgcccgcctcggcctcccaaagtgctgggattataggcatcagccacagcgcccggccaagttcagtttttaacctgtttag

SEQ ID NO: 13744 - DNA, 201 bp, Homo sapiens
aaatcacaatccttaaacgccttattaaagggaaacagactatacttacctgatagagaataaaaagtcatcttgcagagaacagacaattataaaagtayttgttaaagataatacccaaattgatatgataagatctcctaaattccacaatcttatattcaattgtctttggggtatgttcatttaaatggaagaggt

SEQ ID NO: 13745 - DNA, 201 bp, Homo sapiens
atcacagcacgagctttaaggattacatgagttcggctagagttctgattctcctaggacaagtccactatgatatgtgcaaagtacacgttcctctttgmgcatcttcattgattcttttatttttctatttaatataactgtaagcacttaagcagtgttctggggagtctggcttccttaaatggctaagctttgcag

SEQ ID NO: 13746 - DNA, 201 bp, Homo sapiens
tatacacttaaatatcttcaaataaaataataaactgagaaagttacattgtcatagttacattgtcctgtgtaaaaaccaagctcactctcatggatcayagctttaattctgctcttttgattccaatatgcaatttatatttcagaattcacatacttaatggtaaaatgcttttaaaaggattagtacaagccaata

SEQ ID NO: 13747 - DNA, 201 bp, Homo sapiens
gataacaagatcaacaggatgctggctagattaacaacaaccacaacaacagaagttccaaataagcataaacagaaatgacaaagatgtaacattacaaycaatcccagagaaatacaaaagatcctcagagactattatgaacacctcttgatatggtttgcatttgtgtccccaccaaaatctcatgtcaaattataa

SEQ ID NO: 13748 - DNA, 201 bp, Homo sapiens
agtaatagagcccacctccttcatctctcacactgaccccttaccttcatcctcacctctgctgccttggttcgagccctcatctcttttacagggatccrccacagcatcccaactgatctggccttaggtcttcttctccaatccattcttcaaaaggctgccactgtgatcttcccaaaggtgattctgatgctacca

SEQ ID NO: 13749 - DNA, 201 bp, Homo sapiens
tctatgtcttcctctcacccaatttcatccctataattctcttacctaataataaatgtaaatcacatttacatattagtgtttgtccatttgcatcgctrtaaaggaatacctgagcttgagtaatttataaagaaaataggttaattttggctcatggttctgcaggctgtataggaagtctgatgccagtatctgttt

SEQ ID NO: 13750 - DNA, 201 bp, Homo sapiens
acacttgctaccttctgccaaagtctacaaggatcaaacttagtggtagccaactaagctaaataatgcttgtccaagtttctaaaacaagtattcatcaytttccatttatgaaaattagaggtaagaactatactttatcattttgaaccaccacatgatttaaaaagtaaacttaacttttaactttcccatccccct

SEQ ID NO: 13751 - DNA, 201 bp, Homo sapiens
gcatcctagaaagctcacttctgctccttcccagttgatatcccaccttagttttatttttaagtatcttgccataaattggttttgcttgatttgaactycatatactggattcataagtatgtaccctttgtctgacttatttctttaaatatcattttgtgagattcaacaatgttgcagagtgaatcaatagttaat

SEQ ID NO: 13752 - DNA, 201 bp, Homo sapiens
gggtttcaccatgatggccaggctggtctcaaactcccgacctcaggtgatccgccctcctccgcctaccaaaatgctaggattacaggcgtgagccatckcggccggccttattttatttttctacctctcgagtcagtagctgatactgtgttgacagacttggggaaagccaattaaaaggcctagacacagaaaatt

SEQ ID NO: 13753 - DNA, 201 bp, Homo sapiens
gaaaaatgaagactataataagattaagaggaaggaggagatttatttttatttaacaaatacataccatttgctatattatagacacagttttaagtatstttaagtattgactcaataaatcctcgtgacctctaactttatggttagatatcattatgtaatctccattttacagacgagaatatagaggacagagag

SEQ ID NO: 13754 - DNA, 201 bp, Homo sapiens
gctaatcatttcaagcttacatttttccatctactctgtaggactatcataagaaattttgtaaaaaccaatccaaattcaccaaacacataaagttcccwgcatttccagtcaagttaactatttaacaagagatgtcaagttaatacagcatgatttgttcttgcatttttggaagctaattcatcctctattaatcac

SEQ ID NO: 13755 - DNA, 201 bp, Homo sapiens
ctagaaagctcacttctgctccttcccagttgatatcccaccttagttttatttttaagtatcttgccataaattggttttgcttgatttgaacttcatawactggattcataagtatgtaccctttgtctgacttatttctttaaatatcattttgtgagattcaacaatgttgcagagtgaatcaatagttaattaatt

SEQ ID NO: 13756 - DNA, 201 bp, Homo sapiens
gacgcctacacatctacccaatagcctttaacctctaaagggctagagtcattgttcttcaaaccgttgcactgttaactggtcaagtctggcaacttcgratagacctcacctcccacgttgctctctcctggtcagagctgaagcacatggagatagttggggttcacaaagctcatattatcaaccctcttactttac

SEQ ID NO: 13757 - DNA, 201 bp, Homo sapiens
atgttggtcaggctggtctcaaactccctacctcacatgatctgcccaccctggcctcccaaagtgctgggattacaggtgtgagccaccgtgcccagccmactttactcttaattagactcattgacccttaagtcagatcagtcctgagggttgactataagataacgtagataaagcagagagtgcttgtgccacagt

SEQ ID NO: 13758 - DNA, 201 bp, Homo sapiens
ggcactcaccaccatgcccagctaattttttgtatttttagtagagacggggtttcaccgtgttagccaggatggtctcgatttcctgacctcgtgatccrcccgccttggcctcccaaagtgctgggattacaggcgtgagccaccatgcccggcctggctggggcttttatctgcaccctgaagcacctttgagatttt

SEQ ID NO: 13759 - DNA, 201 bp, Homo sapiens
tcaattagttctaacagctgccatgtgaacatgtgaacccattgttgatggatcttttagtttttcaaaagaagcagggaatctaggtgtgtgataaaatwacttgatctagatgtcagcaactgaaaaaaaaaaaatttaaaaactttgtgccagtcaatttatctggggactaaatctagttgaaatggagacctttga

SEQ ID NO: 13760 - DNA, 201 bp, Homo sapiens
cagaatgatttttttttttttaatgagaagaggagggaaagttgaaatgctttggaaagtctgttttgttctgcttcattaatatgttcagagaaaaaaayggctcaaaacttaaagagcacatttaaaatttcgttttttataactatgggcaacacatataagagaatgcattttttaaaattttatatttttatatta

SEQ ID NO: 13761 - DNA, 201 bp, Homo sapiens
gtagactatagagaagaaaaaaaaaatagttcctggaggaagcacaaaaatagccacgtttgttggatgtatttcctatttcttatactctacattcccaygaaaaagcaataagaggtatgaaactacaaagaaagagcccactcttaccttgtagtacctgcttcctgtgtcattctgaaagagggtaatacatttgct

SEQ ID NO: 13762 - DNA, 201 bp, Homo sapiens
taattcataggtttcattatgagtaactattatgaaatttaaaaataaatgacttttttatagaaatattcctctaaaatttcttctttaaaatttatccycaatactgaatctaggttgcattttagcaaatgtatctcattctactaatgaacagagaattcttcctgggataaagtgatcaagaattaccaattacca

SEQ ID NO: 13763 - DNA, 201 bp, Homo sapiens
cattttcttgaatctggcaatttgatactgaaatactcacagagatatctcctggaaatgcatgtaaaacaatatgcacacaaaaagtcagtaagagatgyaatagcaaaacaagtaagtacatgcttacaaatcatcctgcaaaagtggttttaactaaatcatagcaattaggtttttctaagaaaatgtcattagaat

SEQ ID NO: 13764 - DNA, 201 bp, Homo sapiens
gagacaaagaggacattaataaaatcaacatgatctgcttctcagacatagctcactcccgtgactgatatgctgacagttacatacccaattcatgttaytatcacagcataaaggcatgtttatgaaggcaaggtcatttgtaatataaaataaaatggtctcagcatgtccactatgagcaaatgctgaaatattacc

SEQ ID NO: 13765 - DNA, 201 bp, Homo sapiens
aaatgaaatgttccgttttgcgaaaaaaaattgtccgttaaaactgggaattaaaaattatgacatgcttgcatgagaagtaaaaaattatggcaggtatrtaaaaatcggaatttatcaatgatctcaactgagtagactagatagccatgatgactacatttagcaaataactgctctatttccctttggtctgcaaaa

SEQ ID NO: 13766 - DNA, 201 bp, Homo sapiens
tgcagtaaaatatagaaagatgtaaccatgttaaccatgaagctctcttctccaatcctataatgaagaataaatatctcctgtacgcatgctaactctgkattccttccctgcaaaagtatcttccttcaggagaccacagtgcgtggagactggaagtgcaagggccaggttaggaaagatgtcatttactagagtttc

SEQ ID NO: 13767 - DNA, 201 bp, Homo sapiens
ggccggccttattttatttttctacctctcgagtcagtagctgatactgtgttgacagacttggggaaagccaattaaaaggcctagacacagaaaattaraaccccaatatctagtcagttttctgcaattgcagtaaaatatagaaagatgtaaccatgttaaccatgaagctctcttctccaatcctataatgaagaa

SEQ ID NO: 13768 - DNA, 201 bp, Homo sapiens
actttgaagtcttctatcagctcaggtgctttttcccaagaacagaaacaaatcaaaatttgatctgaggacctagcagagctgactgaggaggattttgmcccattggcatttcaacccacatggtcccctctggagaatgaggaggaggaagggggagggcaaaacttgttaggccctactagggcaccagcttctata

SEQ ID NO: 13769 - DNA, 201 bp, Homo sapiens
atctctcctcactgcaacctctgcctcctggagggttcaagtgactctcctgcctcagcttcctgagtagctgggactacagatgtgcaccaccacacccrgctaatttttgtatttttagtagacatggggtttcaccgtgttggccaggctgttctctaactcctgacctcaggtgatccggctgcctcagccacacaa

SEQ ID NO: 13770 - DNA, 201 bp, Homo sapiens
tgatctctcctcactgcaacctctgcctcctggagggttcaagtgactctcctgcctcagcttcctgagtagctgggactacagatgtgcaccaccacacmcagctaatttttgtatttttagtagacatggggtttcaccgtgttggccaggctgttctctaactcctgacctcaggtgatccggctgcctcagccacac

SEQ ID NO: 13771 - DNA, 201 bp, Homo sapiens
cacatgttctttatccagtctaccatttttcaccatttaggttgattctgtatctttcctattgtgagttgtgagttacctctaggcttgtctctaacttytagcctcaactgatccttccactttgagagggattataggtgtgagctgggattataggtgtgagctactgtgcccagccattgttctgtttttaaatga

SEQ ID NO: 13772 - DNA, 201 bp, Homo sapiens
tgtaatttttgacaaatcctattactgtagtacagcttctatatttagatgtcagcacaccaaaaagcataacattccatgatatgctaaataatgtgtgyagacacataatccttcggatgtattatataccagataatggtaactaaagtgagcatgtagggtctactggacaaggttagatgacagaatatcatgtgc

SEQ ID NO: 13773 - DNA, 201 bp, Homo sapiens
ttcaagtatgacccccttcccttcacaccattattgggtttgtgtttaggagaaagagaatattaaaagtgtgaattattaccaaaaaaaaaaaaaaaaamaaacgctggaatctacatgaagctgtttaatggtttataaaaattgaaaaatggagcaaatatctggatttttcttctacttggcatcaaatgtctggaa

SEQ ID NO: 13774 - DNA, 201 bp, Homo sapiens
cccaaatatccaccctttttgccaccctaaaaccatttttataacaagccacactctctcctttctatgttttcatacatactacccttcagcctgaccaygaacgtttatcgggtgtgaatattcagctgtcaggtaacttttattgactctcccagtctgtcttggatgtctctctactctcagagtctttgctataat

SEQ ID NO: 13775 - DNA, 201 bp, Homo sapiens
gtgtgcaaaaagagttttgcccaacttctcaggctttccacagaaatgcagataaatttcatggcagagcaagctactacaggactctctggccatctgtytgttgcatttaagcaatttaattttcaggaaatgaaacatttggccaagtacaggaaaaaatagtgtccattcacacataacagattgatgacatattca

SEQ ID NO: 13776 - DNA, 201 bp, Homo sapiens
acaacatgacctgaggtgcccctgtacagagggtagaactttaatacatgtttatttccagaattggggtattcacagaatgttctaaatcaaaagtaagkgacagattaatgacagtgttcattgtcaactattttgtgccatgttcaccgtcagctctgaagagctctacaaatgttctctaatagcatcttgatgtaa

SEQ ID NO: 13777 - DNA, 201 bp, Homo sapiens
taacaaatgaataaaaatggatagaaaacacttgaaacaaataaaggttttaagggaaaaatggaaggtgacaagatgctacatggaagctagcaatgctkccaactggctttttgctgagagaggcttttatacttgcctgaggaaaaggatcagctgaggctagcaacacattttctggtttgaggtcacagtgaacga

SEQ ID NO: 13778 - DNA, 201 bp, Homo sapiens
ggagccaggtaagcgggggtacccaccactgacctccggaaagacttctctccaatgatccgggcaaaaccaaaatcacaaagtttcacctgttgatgaawggatttgcagaaatactccgttcacaattgtgtgtctgtgtgtcttagttcagattcaccagatacaaccataatattttaaatactttacctttacatt

SEQ ID NO: 13779 - DNA, 201 bp, Homo sapiens
accacatgtctagagagcgattgtagcccttgttccttaggacctcaggagccaggtaagcgggggtacccaccactgacctccggaaagacttctctccratgatccgggcaaaaccaaaatcacaaagtttcacctgttgatgaaaggatttgcagaaatactccgttcacaattgtgtgtctgtgtgtcttagttcag

SEQ ID NO: 13780 - DNA, 201 bp, Homo sapiens
aaagcagagatggggcatcatttgttccactactcctagaaaaaggatttaaagacatgaaggttgtttccccacacccaattcctgtgtaacaggaaagygtttgattggcttcagtggtattacggatttgcattctgataacaggatcaagttattttactggatttctagatgagcaatatcaagcataatggttag

SEQ ID NO: 13781 - DNA, 201 bp, Homo sapiens
gagccataaggaggtactgagtcatttggaaaagtgagggttctatctcccatctgagctggtctccatatcacttcatctgagtggtaggaaatttttartgcttagacatttctatagccaagtaaaatgtgtacttcctagtcaaatataaatgccttttgaattatcctgtataattccctcttgctaaaatgctat

SEQ ID NO: 13782 - DNA, 201 bp, Homo sapiens
atgagtaaaatatttctataggttcctaaatatcaagccataagaaataagcacccttttggtatacaacaatgtatagtgtaaagaatggagacaaattrtaaatgatttccagtctaagcccttgatttcaagatcatgaaacctctctgggttctctctaatgcagagacgaaagcaaatcacttaccagaggattgc

SEQ ID NO: 13783 - DNA, 201 bp, Homo sapiens
aacgaattcacatatgagtgtttagaatagtgcctggctacagggcaaatactgtaaaagtgtgagctattcatatttgttcatattttttctttcaacakttaattaattttactatctccattttactggaaacaccatttgctaagttttcttcaaattttctcttatttttcaaatcataccttattttgcacacaa

SEQ ID NO: 13784 - DNA, 201 bp, Homo sapiens
ggctggagtgcagaggcacttgcaccctctgcctcctgggttcaagcaattctcctgcctcagcctatcgagtagctgggactacaggtgtgcaccactaygcctggctaatttctgttattttcagtagagacggggtttcatgttggccaggctggtcttgaactcctgacctcaggtgatccgcccaccttggcctcc

SEQ ID NO: 13785 - DNA, 201 bp, Homo sapiens
ttttaaatccacagtaaactcagtatgatcgtatttcttatccccaaatcaaatattattttatgttgtgctaacagaaatgtgtactttgtaatgagggwagtagtcgtttcactttactctctcctttttttgtttgtttttttgagacggagttttgctcttgttgcccaggctggagtgcaatggcgtgatcttggc

SEQ ID NO: 13786 - DNA, 201 bp, Homo sapiens
tctcttttacatacatatgaaaaatagttaagagatcttaaactgaagattctgatttggtagttctgaggtggggcctgatagtctgtattttaatggcwgctaggcaatccaatattgctggactttaaaccacattttgagtagcaaggagctagaggtatgagaacattgatagtggttaaaaactggcttaatatt

SEQ ID NO: 13787 - DNA, 201 bp, Homo sapiens
tctatatgacagttctttacatctttggagacagtgattcattccccttaatctcacctctatagttccttcagatctttcagcctgcttagtcctcctgyacacctcgattttaatagtcactagctctactcaatgtccctgttaaaattcagtgatcatcactgaccaacattttcctcactaactgccaatttgaat

SEQ ID NO: 13788 - DNA, 201 bp, Homo sapiens
atttatgaagaaaaagtaatactcatcgttatctagtctgaaaatcatcctagttacccacagtatcatgtgatggagttctcactctccttttctggacrttatattttcagtatacgtcattaatagttcattatttattaaagtcattccctcacacttctcattcttgtaataacttccatgtttctctttttgaat

SEQ ID NO: 13789 - DNA, 201 bp, Homo sapiens
tgataaacttggagcctgaaaaccaacagcccaagaagaaaacactttaattgctttcactttgcttttgctttcaaaaataaccaatgtattggaattayatcagccttcatagactttctagaggaagacaggaaagaagtctatttaacaagaaatgttctctgaggggttagaaccacaatccctctggcctagtac

SEQ ID NO: 13790 - DNA, 201 bp, Homo sapiens
aaaaaaagaagaagttggaagtaattatggaagaagtattagagtctattgtatgatatgaatttcaattggtctactctttaacactttctttaatttaraaattttgtttatatgtacatcatttaaatatgtcttacaatatgggcaggataaaactaatattcaagataaagcatttactaattttgttataaaaca

SEQ ID NO: 13791 - DNA, 201 bp, Homo sapiens
tgattgtagattttaaatgttctcaccacacacacaagaaaagataagtctgtgagatgatggacatgttaattagcttgatttaatcactgcacaatgtwtacatgtaccaaaacattatatatcatagtatatataatttttattagtaaattataccttaataatgctggggagggagaaagaatcttgtaggatcac

SEQ ID NO: 13792 - DNA, 201 bp, Homo sapiens
aattcttacagacaggtcatcatgaagttgctctttggagctctcacctgtgatgctcatggaatttctaaagaggactactccgcttgtaaaaagcaacmtccaagatctctttccactgttattcctgagtgatctagcgtggccatttcttctggctctagccacaggaaggtcagagctttgctgtcatgttctttt

SEQ ID NO: 13793 - DNA, 201 bp, Homo sapiens
gactaacagatatctagtaaattcagacctctagtacagctggagatgtctgctgccttttcattagcaagatactaccagtaactcgtgaaaagagaagkctctatgtaagttgtccattgtactaaagttcaaaagttccaaatacatcaaagaaaagcacctttctagtacattagggaaaactactttactgtatgc

SEQ ID NO: 13794 - DNA, 201 bp, Homo sapiens
tattttctccagtgaaaagaacacaataaagtacaacttgaaactatgatacacagtgtcacccttctgcatctaagtccatgtattttgcctttgtcatkactgtgaagagcactttacgctacagcttcaaagcaggcttttctgtttaactacttgaattaataaaggtattatgtacctccagaatcaatttagtat

SEQ ID NO: 13795 - DNA, 201 bp, Homo sapiens
taatgcctggagtacagttctctttgttgtcagttaaatagagaaccacatgccataacatataagagaactgtaaaaggtagtcttccagaaccaagcayctaaacacatgatatcccctgacagggagagtactattccaacatcctgatgttctccaaaagccattctgaagactcaaaaccctggattaaaaataaa

SEQ ID NO: 13796 - DNA, 201 bp, Homo sapiens
agttgagacattcaagataagcaagagtgagccaagtgaagtggatgggaggtggaggaaaagtggttcagtcaggaataatgagagtatacaccaaggakgtgggaggaggcgggggagtataaggaactgaaaggcaactgtcaaagccagggatggcgaaagaagtgagatgggtagatcagcaaaatcacgcagagc

SEQ ID NO: 13797 - DNA, 201 bp, Homo sapiens
ctgcatatctttgacctcatggaacccagaatctatgagagaagagaatcactatgcaaacatgttgcatgaatatttatacatagtcacaccacctgctrcaaaagaaaaattcagtgagaaatgggagtatataattagggaaggtttctctgaggaagtgatgttaaagttgagacattcaagataagcaagagtgag

SEQ ID NO: 13798 - DNA, 201 bp, Homo sapiens
cttatgaatgtcggtttctaggtttcaggtcagaacacacagactcctgggctccagtgctagttctaattttcagttctaagtgtgctcctagatatgaytctacactaacacattacaatctcctcggcaattactgaaaactgcctgtgaggctatatttaatttctgaatgcattcaccaggcagctagtgagtgct

SEQ ID NO: 13799 - DNA, 201 bp, Homo sapiens
agccttatgaatgtcggtttctaggtttcaggtcagaacacacagactcctgggctccagtgctagttctaattttcagttctaagtgtgctcctagataygactctacactaacacattacaatctcctcggcaattactgaaaactgcctgtgaggctatatttaatttctgaatgcattcaccaggcagctagtgagt

SEQ ID NO: 13800 - DNA, 201 bp, Homo sapiens
ttatttataatagaaagaggtttttttttggttttcaaatctttttagtggcatgtggcattctttttgtcttcactcacatatttgggccaaagctcttyctaccttatttccacttgttaaacgtatggaatcttgctcttaattaaagtcagaaaaaataagtaaatcataccagtcacaaaagttataataagcata

SEQ ID NO: 13801 - DNA, 201 bp, Homo sapiens
gtggaagggtgcagcaaaccaacatggcacatgtatacctatgtaacaaacctgcacgttgtgcatgtgtaccctagaacttaaagtataataataatttwaaaaattactcaaatatcctttcattcatccaacaagaatttatagagcacctattctacggcagacacttaactaggctctgaggatacagaagggagt

SEQ ID NO: 13802 - DNA, 201 bp, Homo sapiens
ggaacaccacacatcagagcctgccggatgtgtggacaaggagagggatagtgttaggagaaatacctaatgtaaatgatgagtggaagggtgcagcaaaycaacatggcacatgtatacctatgtaacaaacctgcacgttgtgcatgtgtaccctagaacttaaagtataataataatttaaaaaattactcaaatatc

SEQ ID NO: 13803 - DNA, 201 bp, Homo sapiens
aaaagcatttttttaaaacaatgaatgcaatttgtatacaatttttactggcaaggttttcaatcagttaaatttttaatgtaaaatatatataacaatayctcaaattgaaaattgggctaaaacatgaaaagaaaagttagttgcactttaccaaacatacaaatgtatactaatgtattaatatttcatgtctaatat

SEQ ID NO: 13804 - DNA, 201 bp, Homo sapiens
aatatcaagagtcatttcctgttattggggttaaaagcatttttttaaaacaatgaatgcaatttgtatacaatttttactggcaaggttttcaatcagtwaaatttttaatgtaaaatatatataacaatacctcaaattgaaaattgggctaaaacatgaaaagaaaagttagttgcactttaccaaacatacaaatgt

SEQ ID NO: 13805 - DNA, 201 bp, Homo sapiens
tttgtacataaatacattttcaaaggtctgcaaggctacagatgaaaatatcaagagtcatttcctgttattggggttaaaagcatttttttaaaacaatraatgcaatttgtatacaatttttactggcaaggttttcaatcagttaaatttttaatgtaaaatatatataacaatacctcaaattgaaaattgggctaa

SEQ ID NO: 13806 - DNA, 201 bp, Homo sapiens
gttatacttgatggacatatcaccaaatactttatctcatgtttgaatttgtaaatgaccattagtctttaggagatgtacctgagatttgccacctaaaytcatagtccagagacccccaagattggaaacaaagacaagtaaaaatgagtaaaacgagaacacaagtcacaattatgaaaacttctgcaatctgtcttt

SEQ ID NO: 13807 - DNA, 201 bp, Homo sapiens
tttccctccccacccaaagaagttattacttcttccataaagtgttcctcataccagaaatcctaaactcccaaaactttctatctcttctcatggagcaygtcttacttatcccttccatagttttatagttttttagcataattttctatttctgtgttattctcccatttccaaatgcaattgatttcagactcctta

SEQ ID NO: 13808 - DNA, 201 bp, Homo sapiens
ggtctctcccgtgctattcttgtgatagtgaatacgtctcacgaaatctggtgggtttatcaggggcttccacgtttgcttcttcctcgttttctcttgcygccaccacgtaagaagtacctttcgcctcccgccatgattctgaggcttccctagacatgtggaactgtaagtccaattaaacctctttttcttcccagt

SEQ ID NO: 13809 - DNA, 201 bp, Homo sapiens
accaaggacatcacccagcaccttgcaccaaatccttctctattatgctcactgacttctgcctcattcctaaaacaccctgtgatatggtttgactatgyccccacccaaatctcaacttgaattgtatttcccagaattcccacatgtgggagggaccgcggtggggcgcgggtaatttaatcctgggggccggtctct

SEQ ID NO: 13810 - DNA, 201 bp, Homo sapiens
gcacacagttgcatcttgttttgagtttttgtttgcaaactgtcagtaagatcagaataaattgcatgatatgcagtccaatatgtatattcttgagcacrtctcaatgtacccaccaaaaaatattcatagctgcaggtgtagaaaaaaaaaggcagaattatggcttgatttgccttgataagcatggtaattttctgt

SEQ ID NO: 13811 - DNA, 201 bp, Homo sapiens
tccaaactaaatcacatcgtgtgtagctcagaaagggacatgaagatactcttcttaatgtaaggcaagataggtgatatatctcctaatggtaaaagctrcaagataagaaagaggtcttgcctgagaaccagctactcagagttgctgcaatcaacccaagaaacactacattgagatatcacgttaattcaaacttga

SEQ ID NO: 13812 - DNA, 201 bp, Homo sapiens
attgcagcaagcaaatggctacacttttctgaaagaatgaaatccaaactaaatcacatcgtgtgtagctcagaaagggacatgaagatactcttcttaawgtaaggcaagataggtgatatatctcctaatggtaaaagctgcaagataagaaagaggtcttgcctgagaaccagctactcagagttgctgcaatcaacc

SEQ ID NO: 13813 - DNA, 201 bp, Homo sapiens
accatgctaatgaaatgagtagttcgtgtgagtaggcagtgggaactacaactgctgagaaactgcagaaccacagtctcaggagcaaaagtttgccaacrcctcctcctcatgctcagtcaaaggcaatgagaaaagcagcctcccctagagagggttctgagaggaagaccagtcacatgagaaggtccaaatttcagg

SEQ ID NO: 13814 - DNA, 201 bp, Homo sapiens
gagttttatcaaactgtctctgctctagacagaagctgttagccattcattgttttagtagaagaataagttcatccaggttgtgatctgggcaaaaatayagctgtaccattgatctactttgtttgtatttttgacatactgttgtggaacttccattttttctcatttgtttgaaacagaggcctgatttttaactga

SEQ ID NO: 13815 - DNA, 201 bp, Homo sapiens
attcacaagctgttatttttaatatttgttattcgcagagcctatgttttccgagaataatgcaaaagaaaaacccattcaaatgcaaatgttaaagtatrtatttaattaataaatataaacaagctcacaattttaaaatatcctgggtcctgaccccattgaattgatagctctaaatgacagaatcattgaatgaat

SEQ ID NO: 13816 - DNA, 201 bp, Homo sapiens
aagtcacattttgaattaaacaggccccaactctaacatttacaggctaagtgaccttagacacgttgtttgattttgcttggactccacctggaaataaytgaatatactatgtgtgaatcaactaagcccagcactgagtacccataggcactcactttctccttggctttccatttgatactgtaaataacaacatca

SEQ ID NO: 13817 - DNA, 201 bp, Homo sapiens
atgagaaggtgaggcatatccgccctaaacacaatggatacagaatcataaggacaccccatattacccctggaaataaggttcattcataccaccaatcyagaggcaatactttctggctactacccgggtggtctgactcagtgaatatttatttaatgcctactatgtgcaggcaccaggctatgtgctaggaaaaga

SEQ ID NO: 13818 - DNA, 201 bp, Homo sapiens
ctactcaggagactgaggcagaagagtcacttgaaccagggagttggaggttgcagtgagccgagatcttgccactgcaatccagcctgggcaacagagcragaccaagagcctccatctcagtaaataaataaataaataacagcttagttgtgtcaatagctcattaaaactcttcttagaagctttttatcagtagtt

SEQ ID NO: 13819 - DNA, 201 bp, Homo sapiens
atggcaacaacactgggtcagcatttgccaggtgtggcaaattactgcatcttcctctttccaagtttcagcctggagtctaacaaaaagcacttaagaamctcccaaggcaggagcgcagtgctggctgactatcaatgtcttcttgctagtggtgccctagttctgttccaacagtctcaagttcttatggattcttag

SEQ ID NO: 13820 - DNA, 201 bp, Homo sapiens
cataggttcttcagattttgagataacgctttagaatgcaaaaaatgagatattcataatgtggagcattaattcagaatttaagattatagctatttggsggacagaggaacaaaacaaaaacttttgttataatatttattcaaattgttgcatattctctggaggcactctggtgtcactcactgcattggatttaga

SEQ ID NO: 13821 - DNA, 201 bp, Homo sapiens
ttatatacagtaactcctcattcaatgtcattggtaggttcttgggaactgcaactttatgtaaaataatgtataacaaaaccaattttaccataagctakttgatataaacaaaacttaagttcctacagcatatttctggttacaaaaacatcaccaaacttctaagtaaagataaaaacactcctaatactaaacatt

SEQ ID NO: 13822 - DNA, 201 bp, Homo sapiens
agccaaaataatccctctttgaaagatactgtaattgcctaaaacatttttcatagtattgtcagattctataactcatccatttcattatatcctatgtrtcaagctttcatttttgacatggattgtgatatttttgaaaataaaccccaaataatccagagtcaaatttagtaaataagccacatgcgttttagaagc

SEQ ID NO: 13823 - DNA, 201 bp, Homo sapiens
gagccaaaataatccctctttgaaagatactgtaattgcctaaaacatttttcatagtattgtcagattctataactcatccatttcattatatcctatgygtcaagctttcatttttgacatggattgtgatatttttgaaaataaaccccaaataatccagagtcaaatttagtaaataagccacatgcgttttagaag

SEQ ID NO: 13824 - DNA, 201 bp, Homo sapiens
taccaaagaaagatctggccttcaagagcaggtttttatatgattcaaggcagcttatgaagtataacaataaagttatatgactgtttttaaatggataytctagaatttatatacttaactgaatgttgtcttttctaacttagacaacatccattgtcagttactgacatttcattatattttgtatgtttctgtaag

SEQ ID NO: 13825 - DNA, 201 bp, Homo sapiens
tacagagaaagagagaactgaatatggaaataaagtatttgttatgatttttcatcactgcataggaagaaatcaaagggcattccaatatgacctcttartaaaaaagagcatctatccacataaaaccataaaacaatcttgatcaatattgaccttcattgaccaatcctgattaacacatttttaaacctgcattca

SEQ ID NO: 13826 - DNA, 201 bp, Homo sapiens
tgagaaaatgaacagttaagctttcaaaattgctgagtatagatagcaattctcaattacactaccaatgacattttccctagcaaaaatgtacactgcayccaaagataatgaacaagtagaaagtgagaactagaaaaatggccatggatgattgcacataatttgatatcgactgaatcataaagtgtatgtgtctgt

SEQ ID NO: 13827 - DNA, 201 bp, Homo sapiens
tttcaaactcaaatttcaaagagtatgtgtgtgcacatattagggcaaagaggacattccaataacttttcacaatctaaatcataaagtaggtatgtttytaataaaatatatttcaatacttaactaaatttaattgcatctctgataaaaaaatgcattttaacatatatatgcaggtctaaattaataaaccgtgat

SEQ ID NO: 13828 - DNA, 201 bp, Homo sapiens
tatagtattctttccttttcttgtacagtctttttcagcttttgatagtaaaattctggaatgtttgaataatttattagacaagtttttttaaattgtaygcattctgaaacagtttctgcttgtgtttgacagaaacttcacctaagatttcctgaaacaatgctctttgggtgggaggggcaggtgggaactgggtac

SEQ ID NO: 13829 - DNA, 201 bp, Homo sapiens
aaattatagtcaaaatgaagcgtttttgacctttaagtgaaagattagattttcttcacaataattcatattctcaatgggaaaagaaagaaaaaggtcaycaaagtaatcaaatgatacaaagttgttatctgcttgcaagcaagaataagctaatgaataatcagtagcagtcagtggtttccaaacctagaaagtcca

SEQ ID NO: 13830 - DNA, 201 bp, Homo sapiens
ggactgtgaaaagttaaacataacaggacaaaagcaaggaaaacctgagggctttctgtgggtcaatgtgttgaattttgagctaaactctgacctgattrttctcataaagtcagtacagacaattgtctgatgtcagcgtaatatgctggtttgaaaaagacagtgaagcaaatttctagcgccaggtagcattagtac

SEQ ID NO: 13831 - DNA, 201 bp, Homo sapiens
gatagcaattcgaatcataatgctgacagaaataattggaactgtttgcatgaaatgtattatacaaagtaaagagatttcattatatatcaagtttatawgttataacaactttgtatgtttattatacataaataaaactcaaattcttcattaacttactacattttcttggcttacttgtatatttaattacaatgt

SEQ ID NO: 13832 - DNA, 201 bp, Homo sapiens
aaattcagaaattaatagttttaaaggaaatgatacttttaaaaaactcactgatctttgcattttaagataatttcaagaggaaactagatagcaattcraatcataatgctgacagaaataattggaactgtttgcatgaaatgtattatacaaagtaaagagatttcattatatatcaagtttataagttataacaac

SEQ ID NO: 13833 - DNA, 201 bp, Homo sapiens
aattattatgtgaagttttatgtgaaggcatgtacaacataaagcataattacagtatgtttttgtttgatatatcaagctacagagcaggcaaaaattcmgaaattaatagttttaaaggaaatgatacttttaaaaaactcactgatctttgcattttaagataatttcaagaggaaactagatagcaattcgaatcat

SEQ ID NO: 13834 - DNA, 201 bp, Homo sapiens
ctcttccttcttcttcttttaggtacagtatatatttcttctagagaagaaagttctagagcaaagatagtcattcttcagcttcttagcaacaaaaataytcaactgaaagtatctgtgatcttttacagccattttcctttccagaggaattggaaaactggtatcaggctaaaggtataaagaccactatctgcagaa

SEQ ID NO: 13835 - DNA, 201 bp, Homo sapiens
cacatgccacagaaagtgggacgatcgccaagctttcaattttggcagctaattcatgaatctccaagccagaaacaagtgtgacaatgttttcctggagmgctcttccttcttcttcttttaggtacagtatatatttcttctagagaagaaagttctagagcaaagatagtcattcttcagcttcttagcaacaaaaat

SEQ ID NO: 13836 - DNA, 201 bp, Homo sapiens
caaagtaatcaacaacatcaaaaactgttctgtatccccttagttatagttatccagtacacactgacattccctgagcctgaacaaagtcaacaccacaygccacagaaagtgggacgatcgccaagctttcaattttggcagctaattcatgaatctccaagccagaaacaagtgtgacaatgttttcctggagagctc

SEQ ID NO: 13837 - DNA, 201 bp, Homo sapiens
gtgtgatcatagctcactgcagccttgaattcccaggctcaagtgatcctcctgcctcagccacccaagtagctgagactacaggtgcacactaccaaccracttaattttttattaaacaatacagatttattaccttacagtctggggattagaaaacaaacacgggtcttactggactaaaagcaaagggttggcagg

SEQ ID NO: 13838 - DNA, 201 bp, Homo sapiens
gttaataagtaaaaggctatgtttacttctaagacgtgagtgacctggatacagtacatacacaacattttccaaattttcttgatgaaaaaatgtgtttycacctcttctgtgaaggggttcaaaagactagcgttctttgaaaaatatgctgggaaataatgatttttaaaatgctttatataggagttaatttagtcc

SEQ ID NO: 13839 - DNA, 201 bp, Homo sapiens
ataccagataatggtaactaaagtgagcatgtagggtctactggacaaggttagatgacagaatatcatgtgcaaaaagtcaaatggtaataccttacatmtgtataaggttctgtggcaaaatgagtttaactaacatattcttaaaattaaacaagttttcaattatgggatttctcagaattgttaataagtaaaagg

SEQ ID NO: 13840 - DNA, 201 bp, Homo sapiens
acttttctcccctttttcttgttgccaaccctaaggtattttcaggatactatataacttacttatgaagatgttttactataataacataattatttgcyatcatggggtaccttgctgtgttttcagacctcagtgatgacagaggtgcttctactctaaggtcaattaagggaaaggctgtgtgttatatcacatgaa

SEQ ID NO: 13841 - DNA, 201 bp, Homo sapiens
ttacttttctcccctttttcttgttgccaaccctaaggtattttcaggatactatataacttacttatgaagatgttttactataataacataattatttsctatcatggggtaccttgctgtgttttcagacctcagtgatgacagaggtgcttctactctaaggtcaattaagggaaaggctgtgtgttatatcacatg

SEQ ID NO: 13842 - DNA, 201 bp, Homo sapiens
caattgtctttggggtatgttcatttaaatggaagaggtccaacaatgacatcagcgtctctccacccaaacttattcttctagtatttcttcgcttggcraatggcgaatcacctaggtcagaaaccttgagctcatcctaaatgctaacttctctttcacttccaacaacccactggtctctaaaagtaatagagccca

SEQ ID NO: 13843 - DNA, 201 bp, Homo sapiens
caacctatctttgcaataggtctttaggagcagtgcagtcttaatatggggacctctgactaattttctgtcaaagaacaaactgatttagttcataatgrgatagaaaaactaaatataaaagtgatgagcctaggatctaaattctaaatggtatgcagatcagaaggaagaatattccatcacacaatggaatgggtg

SEQ ID NO: 13844 - DNA, 201 bp, Homo sapiens
aaagtaacagaattattaataattttaaaatggcaagaagactgcaacatcaatcatggcatagtagtgtgcaaaaagagttttgcccaacttctcaggcwttccacagaaatgcagataaatttcatggcagagcaagctactacaggactctctggccatctgtctgttgcatttaagcaatttaattttcaggaaatg

SEQ ID NO: 13845 - DNA, 201 bp, Homo sapiens
tatatggttgagacaaggccatcatagatacttacttaggaactgtattttttcttgcattgaaacaaatggccaaacttgtttttatatttgatagtaasaaaagaaaacaaaacagactacatagatcatgccttatttagtcaaacttcttatactgcactgataagaatatgccgttagcctagagaatatattaga

SEQ ID NO: 13846 - DNA, 201 bp, Homo sapiens
gttctgtcctctacttttgtattacctactgtgtatgtatattgtgatttcccaacaagtgtttcctgagcctttgctatctagtcctccggtgtctattrctagtgataattaaaagttcataatttataactattcatttctggcatgaataggttttgtcttaataggctatagttacatagcaagtcaaattttcat

SEQ ID NO: 13847 - DNA, 201 bp, Homo sapiens
cctgaacttggaggccctggttttccacctaggtaacaattaaaggaaatatattatcattttatccaacatcacataactcgtctccccaactaacattmaagttctttgaagcacatctgatgttctgtcctctacttttgtattacctactgtgtatgtatattgtgatttcccaacaagtgtttcctgagcctttgc

SEQ ID NO: 13848 - DNA, 201 bp, Homo sapiens
tctccttttgtgcaactgtttgtaaatatataattcatgctggaatgtttcatttgtaggcatgcatttttatatagttatgtatgcataactatatatawgatgtatgtatgtactctgttacatattgcttataatgtattttataacaatttattacttaactattgtaagttatacataaatgcattcagttataat

SEQ ID NO: 13849 - DNA, 201 bp, Homo sapiens
agagagccaacaatgagggaaaaaagagcccaactggggtctggagtccagttccaaaactaacatcaaaattcagaatttagatctagagtgaatgtggyaggacatgcctttggaactgcaggagagtagtggagagggacaatgtgggagacatacaaaattgggccattctatgaattcctctcaaaaacaaagtaa

SEQ ID NO: 13850 - DNA, 201 bp, Homo sapiens
tgtttcatatgatgtcagtttctgcaatctatgagttacccttctccttccactctaacagcgctgaatctttcatcacgcatcctcaagtgacagtgtckgcaccaaagccatcctatttgtctaacctttgcaaatacatactgtttataagatagcatggatcaaagagtgggcaattaatgtttgcagtcaagcaat

SEQ ID NO: 13851 - DNA, 201 bp, Homo sapiens
cttcaatcaattattcatacaggctctctctcacggatactactgaggaacaaccatcagcataatgcctggagtacagttctctttgttgtcagttaaayagagaaccacatgccataacatataagagaactgtaaaaggtagtcttccagaaccaagcacctaaacacatgatatcccctgacagggagagtactatt

SEQ ID NO: 13852 - DNA, 201 bp, Homo sapiens
aagattcttctttgccatatagatatccaattggtcacagagatgtttgctgaaaagaccattcttttctcacagcagtttttcccttgtcataaatcagytggtctgtgtatgcacatagtttccggactctatttcatcggttaatttttctgtctttgtgtaacagcacattgccttaatactttatacttaactttg

SEQ ID NO: 13853 - DNA, 201 bp, Homo sapiens
caaaatataaaacaatacttcacatctggaggctatacaaggataaggaagctcttaaaaatatatttaaaaaatagttaaacataatctactacatatawattccacatctgtaatacataatatacagttccaaaatataatcctgttacattattaaacttgaaaagaaatttaaattttaaaagtacaggcagggca

SEQ ID NO: 13854 - DNA, 201 bp, Homo sapiens
gcctatttaatttagtgtattagagcaactcctctccattaatccatcctcactctatgtttacttttgctccttatccttctcaaagaattgaaaaaaargcaaagatcatgcaagatgtagtttttcattcttcaaaaatgtatggaagccactgggtttatgtaaatattgttaagatctacatcctagttgacattc

SEQ ID NO: 13855 - DNA, 201 bp, Homo sapiens
ttagaacagagtttgacacatacaaactcaatatacatctatataggacaataacttgagtcttctatttgtaaaccagtattctcttgccacactatcayaccactctcacagggctctaagcatgtcttggagcaaaatgcatgggaattatgatttatcaattttctagccaggcatggtgacacacacctggaatcc

SEQ ID NO: 13856 - DNA, 201 bp, Homo sapiens
ttataggcatgacccactgcacccagcagaaacttattttctaaaataagtctataaagaagaaagtattatttctgattaatgtatctcataattaattyggttcatgaatttatactttaaagtcattacatcagtagctaacatttattgagtgatatgatacttgccaggcacagagttaagtgctctacgtggatg

SEQ ID NO: 13857 - DNA, 201 bp, Homo sapiens
tcaaaagagacaaagaaggtcattacataatggtaaagggatcaattcaacaagaagagctaactatcctaaatatatatgaacccaatacgggagcaccyagattcataaagcaagtccttagagacctacaaagagacttagactcccacacagtaataatgggagactttaccaccccactgtcaatattagacagat

SEQ ID NO: 13858 - DNA, 201 bp, Homo sapiens
gtatgcctcccatttgcttcagagggagaaacatactatatcttccaaggctattcactattcaaacattctcaaaatgatagtctggaacaaaaacagtsagtgtccctgcttgtaaaacatgcagcaatgcgagacccatggagaattatctcactatatgtggttccatttatatgtcatttttggaaaggcaaaacc

SEQ ID NO: 13859 - DNA, 201 bp, Homo sapiens
gtgtcaggagttcaagaccagcctggctaacatggtgaaacccgtctctactaaaaatacaaaaattagctgggtgtggtggtgctcgcctgtaatcccarctactcggtatgctgaagcaggagaattgcttgaacctgggagacagaggttgtggtgagccaatatcgtgccactgcactacagcctgggtaacaagag

SEQ ID NO: 13860 - DNA, 201 bp, Homo sapiens
aaataagcgataatttttgtaacagtgaggtagaatcacaacacttttgaaatgcatttaggcagacatggctatttttaaattttaacctattctttaargcactcaatacatgttaatgtaataacatagccaagtgaatagtttaagtgaggacaactagagattggttttaaaatggtctttttttttttttttcca

SEQ ID NO: 13861 - DNA, 201 bp, Homo sapiens
agacattccaagtggagatgttgagttagaggaagctggatatgagagtctggagctaaggagagacatttttaaactggaaagagttttgagttcatctytagggaaatatcagaaaagaggaagagtgccagccaaggcaaactggaaagtgctattgcagattttaaaaaggagaaagaacgagagaaaatgatagat

SEQ ID NO: 13862 - DNA, 201 bp, Homo sapiens
ctggctaatttttgtattttttgtagagacagggtttccccatgttgcccaggctggactagaactcttggctcaagtcctccacctaccttggcctcccwaagagctgggtttagaggtgtgagccactgagcccggccagattacttcttcttttataaccaatagctctagaggtctgtaattgcctaatacatagtg

SEQ ID NO: 13863 - DNA, 201 bp, Homo sapiens
acagtccacacatactcttctaacacagatctgtctaagaatatcctgtggtctgaaaattttccatccccaagtttgctttcatgatgatttttctccarttttctaaaaggaaggcatggatgtcatacattccaaatattactagggtgctttgccatggggagaaaaatactttcttccatggggagaacaataatg

SEQ ID NO: 13864 - DNA, 201 bp, Homo sapiens
ctattaagaactgtttgctcataccatccactggaactagagtataattatacttttgttgtgccactaattagcagagatttatcctggtttaatatagwtcaaaattttgtagaaacaatagtaagttgaagcatctccattaactgctaatgacaacagatatattgtgccctcatatcaagaaagggagtcaacctt

SEQ ID NO: 13865 - DNA, 201 bp, Homo sapiens
tttgcaggcacatggatgaagctggaaaccatcattctcagcaaaatatcacagggacagaaaaccaaacactgcatgttctcactcataagtgggagctsaacaacgagaacacatgaacacagggaggggaacaccacacatcagagcctgccggatgtgtggacaaggagagggatagtgttaggagaaatacctaat

SEQ ID NO: 13866 - DNA, 201 bp, Homo sapiens
aatggtctctcatctttgtactagtagccactcatcctttatacctggctatgtggataacagcatttggtatcgagtccgactaatctctttatcattcytgccaaagtaaaacactaatttacaacacattactatcctactttgaatgacaagaaatttattttctgattggagaactacactctaaggaatccttca

SEQ ID NO: 13867 - DNA, 201 bp, Homo sapiens
gcttgcttctccttcaccttccagtattactgtaagtttcctgaggcctccgcagccatgcagaactgtgagtcaattaaacctttttcctttataaattrcccagtcttgggtatttatagcagtgtgaaaatggactaatatgtaagtgttccatagatgttactgactcccataacaatcctaaatgtctactgcaca

SEQ ID NO: 13868 - DNA, 201 bp, Homo sapiens
ccccactcactccataccagcctggcagcctcgctgctgtcctgcaagcactttaggacttttgcactgactgttctttctgcctaaggcacactctccamcgacatgtccacacggctgctccttcacctcatttgagtctttactcaaatgtcacgttctcaaggaagccagccctgaccaccctatgtaacactgtaa

SEQ ID NO: 13869 - DNA, 201 bp, Homo sapiens
caaataaacacatgcgaaagtgcttcacttgattaataatcagggaaatacaaaataaaactacaattaatgaacacacccacctgaatactttagtatcragcctgagaacaagacatgctgttgagaactgaaaaacagtcactctcctacccttctggtacaaatataaatgggtaaaaaccatttcagaaacatttg

SEQ ID NO: 13870 - DNA, 201 bp, Homo sapiens
ctctccatgtaacacgccccttggtagcttctgagacacctggaattcaccctccatttaaaatcccactaccaaacctcttgaactaggcatcagtctcyccattctgaactccaggaggaagtggggggcggggtggagggagaattcaagctggtcaaaacaaagtctatcaatattactttgacccaatttgaatat

SEQ ID NO: 13871 - DNA, 201 bp, Homo sapiens
tggagctgtgagaagaaggccaccatcctccagaccccagaatggtaaatccattgacagcttgcactgtgcacctggaaaagccacacacactcaatgtyggcccatgaaaacagccaggagggaagctgtaccctgcaaagccatagggacggagctgcccaagaccatgggaacccatatcttatatcagcatgacct

SEQ ID NO: 13872 - DNA, 201 bp, Homo sapiens
caaactgggtggaggccaccaaagctcaaggaggcctccctgcctctgtagactccatctctgggggcagggcatagctgaataaaaggcagcagaacctsctgcaaacttaaatgtccctgtctaacagctttgaagagagtagtagttctcccagcatggagtttgagatctgagaacagccagaccgcctcctcaagt

SEQ ID NO: 13873 - DNA, 201 bp, Homo sapiens
atgctcccttaagtgtgttcctccctaaattctaaccatgatctcctaacactctgaaaaggacatagccactttttgtaatgataagaactccctggtcyaacccaagaggccctaccagaacacaagcctaccaccatttctgaacaatgtgaggagttagaagggagggggggaaatgttcatgtttaattgataaaa

SEQ ID NO: 13874 - DNA, 201 bp, Homo sapiens
tcctccagggctgaaaaattcagcacctttagagacctctgtctccactcctgaaacgctggctgtttacactaagaagactggcgccatggccccctctscctcacgtctgtatcacccccttccatgcaacatccatctggatggctccagaggcaacctgaaaatccaagttgcaactgtaaacagtggtgggtgggc

SEQ ID NO: 13875 - DNA, 201 bp, Homo sapiens
gaaattgtgtattttccattactagaacaatttggtaatattctagataattactcagtggattggcacttgggagccgtacaggggttagataagatttytaacatcctgtattttgaagtattattctttgttgttatggaagaaagcaaacttacagaatatttttgttgatcctctattcagacatctccacacata

SEQ ID NO: 13876 - DNA, 201 bp, Homo sapiens
ctctttctcatttgtgtatctgcaataccagtgagttgtatactttcatatgttttcatgtggtagatatcatccttttgcttccagatataggactaccktagtatttcttgcagagctggtctaacggtgatgaattccctcagtttttgcttgtctgaaaaataatttatttctcctatatttttgaaggagagtttt

SEQ ID NO: 13877 - DNA, 201 bp, Homo sapiens
gtcagaggttgatagcattttacaataaatgtaaaatggaaatttttggaatatcagaggttgagagcatttaggcgaaaaaatactaattagctgatccrtttgagccagataaaatcactttttcttaggagtgagtgagtcttacattagtcttcttttgcaatttctgaaagataaagcaataactagcatataaag

SEQ ID NO: 13878 - DNA, 201 bp, Homo sapiens
tgtctttctagctgagacccaaggcatcatggaatagagattaaaaagcaccctgtggcttgtcttaattcctgatctccaaaaatccatgagcaaaattwaaaaataagttgtttaatgtcactaagttttagggtgatttgttacatagcagtagatactggaataaggtccacaattaaaagaaataaaatccattat

SEQ ID NO: 13879 - DNA, 201 bp, Homo sapiens
taaaagcatatttgaatttggatgagcatatttgcttacagaaaaaaataagatatccaccaaaatattaactatatttaactctgagtagtatgatccaytttggggcttatctgaatttctcaccttttctgcaatgagtgtgacatattagtttcttactgttcctgtaacaatttaccataaacttagtggctttac

SEQ ID NO: 13880 - DNA, 201 bp, Homo sapiens
ggccatagatacagcaggtaaaatagacaaaagggtctgggtcacaggaggaggtagaaaaggccttattactttttggctacttgccatagggataaaayataacaaataaagcaaacatttgacagactgtaaaatatttcataatatgtctgatctacaattttcaaaaactgagctgcaaggatggagttacgtggc

SEQ ID NO: 13881 - DNA, 201 bp, Homo sapiens
tcaactcctcaactaagagtggaggaaaataagaggcaaagcctcttggaaatggggcatcaccttcaggagagtcaggatgcaaggaagacataaagacygggaaaaagaaaggaacatcaggcatttgatcacaatagactcagggcctaaaaaggctaagggaaaagagataagagatatgggtaagaaacagggttg

SEQ ID NO: 13882 - DNA, 201 bp, Homo sapiens
cttaaggaggcggaacacagaagataatgctttctggcccaccgcacacctcctgttgttcggcccagttcctaacaggccacgtacaggtacaggtccayggcctggggactgaggacctctgttttagaagaggaatagggaggtagtttatacttcaggtgtatttttctcccttccttccttccttccttccttcct

SEQ ID NO: 13883 - DNA, 201 bp, Homo sapiens
gacattaagttggtagtcatcagtctataaatcatatttaatgtcatgagactgaatgagatccccaacaataactgcaaatagataagcagactaagtgytcatctttcagggattccaaaattaaaaggtctgaaaaatgtggaggaacaagtgagtcacaggcctctaggaagatacatgtctctaatgctctggata

SEQ ID NO: 13884 - DNA, 201 bp, Homo sapiens
tcctgcggatttgaacttttacctggatggccttactagtggaagatgaccaaaattaaagtctcagactgacaaagattaggggatctaataggagatcmccctggtagaagaaaatatagattctttttggaatcccaacataaactcaggtacaagtgaaatagaatgaattggcggcccattactaaaacccccaaa

SEQ ID NO: 13885 - DNA, 201 bp, Homo sapiens
gttgttgggaagagtataaggaaatggaaactctcatacactattttcagtagagttaaaaatgtaaacttttacacttttgaataactattttttttttwaaaaaagcagtataacctatttggattctaataatgttatctactaactcattcagtaaataatttttatttttactttatttattattattttttgaga

SEQ ID NO: 13886 - DNA, 201 bp, Homo sapiens
gagagaagaaactactagaataaatacaaaaggaaaggattccccttataaatcagtcaccaatcagggctgatgattttccctttccagtatttctcccrgtctctcccccaagtcttgactcatgttccaactagctcatgactgaacttcggtgctctttctgccataacatttttggcattctaaaacctccataca

SEQ ID NO: 13887 - DNA, 201 bp, Homo sapiens
cccaactctttcctgcttttgacaatggtgaaaaagctacggctgtttggtcaagtggtcataacctctagtgttactgttctgaggatctaacagcactraccaatctctaaataactgcgactcttggtcacccatgttcttacttgcagatttccatattagagacacagaccaagccttccaaggatgctaaatgca

SEQ ID NO: 13888 - DNA, 201 bp, Homo sapiens
tcatcggttaatttttctgtctttgtgtaacagcacattgccttaatactttatacttaactttgtataatactaccttgcctttactgcgcctttataakatgtttggcaagtctctggtttgttctacatcaggggtgctcaacctcagcactattgacattttgggttggatacttcttcattgtaggaggctgccct

SEQ ID NO: 13889 - DNA, 201 bp, Homo sapiens
agagctaaagaaagatcactatctatacaaaatgctttgtacataacagatattcaacatgcatttgtgaactcaataaatagctttcagtgcaaaaggtyctttgtatacattaaacaaatatttaaagtgtctaaatatgtaagatgcattttagttatttttttcatcagtagtttacacaagttggggggcacccat

SEQ ID NO: 13890 - DNA, 201 bp, Homo sapiens
cagaatgtgactgtatttggaggcagggcccttaaagaggcaattaaggtaaatgggtaagccctaatccaatatgaatggtgtctttataataagaagakgttatgccacagaagcacacaaaggaaagaccatgtgaagatacagagagaagatggctatctacaaaccaaagagagaggtcctcagaagaaaccaacc

SEQ ID NO: 13891 - DNA, 201 bp, Homo sapiens
aatcacaatgctaagcaatagagtgggagaggagctgggagagtactgctgtcgatggttataggtaagcgcaggagatctaaacataattgagtgtgcgygtgtgtgtgtgtgtgtgtgtgtaattgatatactaactgaacaatttaaagggtcaatgactttgggaaaatggcactatgtcgttcaaaactagaatta

SEQ ID NO: 13892 - DNA, 201 bp, Homo sapiens
cgggaaagacctgaccccatgattcaatcacttcctaccaggtccctcccacaacacgtgggaattcaagatgacatttgggtggggacacagccaaaccrtatcaggggtagtgctgaccaagaccacaggaacccacctcttgcatcagcatgacctggatgtgagacatggagtcaaagaggatcattttggagcttt

SEQ ID NO: 13893 - DNA, 201 bp, Homo sapiens
caagtgaattcacaagctgttatttttaatatttgttattcgcagagcctatgttttccgagaataatgcaaaagaaaaacccattcaaatgcaaatgttraagtatatatttaattaataaatataaacaagctcacaattttaaaatatcctgggtcctgaccccattgaattgatagctctaaatgacagaatcattg

SEQ ID NO: 13894 - DNA, 201 bp, Homo sapiens
tcaccttgttcagtaaatctcagtaaccaaaaatgaacaggaatctcataaataaggtcatacagaaaagaatacatagtactttttgtaaagctgttagwtataaagaatttgacaccacaagagaattagataaaagtataaatatatttaaaaatcaaacagcaaatatttcttggggactttactgtgtgccaagca

SEQ ID NO: 13895 - DNA, 201 bp, Homo sapiens
gggcaaggacttcatatctaaaacaccaaaaagcaatggcaacaaaagccaaaattgacaaatgggatataattaaactcaagagcttctgcacagcaaamgaaactaccatcagagtgaacaggcaacctacaaaatgggagaaaattttcgcaacctattcatctgacaaagggctaatatccagaatctacaatgaac

SEQ ID NO: 13896 - DNA, 201 bp, Homo sapiens
gagatcacactgcactccagtctgggggacagagcaacactccatctctaaataaataaataagaaaagcaaacactgaatggcacttttcttttcttttyttttttttgagacggagtcttgctctgtcgcccaggctggagtgcagtggcgtgatctcggctaactgcaagctccgcctcccgggttcacgccatccag

SEQ ID NO: 13897 - DNA, 201 bp, Homo sapiens
tcagttatgctcaaacaggtatcaaagcaactacaatcctctgaaatatcagctagcccgtttaagattcatgcttccattgcctttcacaaaggcctcaytaaattcagattcctatgctatgttcttgaaggggcaggaagtgtctctaagatattgtagccaatccatagatcttgaactccactttctatttaaagc

SEQ ID NO: 13898 - DNA, 201 bp, Homo sapiens
tcttctcagttaaaggcaactattttttcatttaaaaaagatttgtcttccaaacacaaatgacaaaaacagcagggaaggaaatgctattttcaagtttytaggaggttatcataaacaatgaagagagaaaaacaaattaaagttgtaaaaaaaaatggcatttgacagtatttcttctaccttgctgcctatgacaat

SEQ ID NO: 13899 - DNA, 201 bp, Homo sapiens
gaagaataaatatctcctgtacgcatgctaactctgtattccttccctgcaaaagtatcttccttcaggagaccacagtgcgtggagactggaagtgcaarggccaggttaggaaagatgtcatttactagagtttcagatgtcatctgcacctcaatgttgccagttgtttgtaactgattagcagatactaagacatga

SEQ ID NO: 13900 - DNA, 201 bp, Homo sapiens
aaaatgtatggaagccactgggtttatgtaaatattgttaagatctacatcctagttgacattccacattagtagatgaaattaacatctgtcacaaaggytgctctgaagttaatcagttatttctgagtactcgtaatttggtaaaggaaagctaggcatgcgtgattcgctttaccactcaagcaacaactgacgccc

SEQ ID NO: 13901 - DNA, 201 bp, Homo sapiens
aaagaaatttctttaggaatttatctcatgattgacagcacaagaatttatctaaccttcactatgaagtttaactagttctctcaaattcatatttggcygtttactttatgccactttaatgtagttttcagaaatataataaggatgaatagagtttcatgaagttaattttcttaaacaaatttttagaaagtgtaa

SEQ ID NO: 13902 - DNA, 201 bp, Homo sapiens
gttccaaatacatcaaagaaaagcacctttctagtacattagggaaaactactttactgtatgctatgcagtactcattcagggcaggaaccgttagaatygaactgaattgtgaatgtgctttaggtcaagtcatctctctttatatatagacacacttacatctacatttttgtaaagtttgaggaaagtacaattagt

SEQ ID NO: 13903 - DNA, 201 bp, Homo sapiens
caaatatttattcaggccctaccataaaatgttctcagaaaggaaggctttcactatctttaaatctttgacccagttagttgagaggactatcaaatccycagaagcgacccaaatctccggggcttctgtttgtttcctccagcaacgtccaatattctccctagctacatcttatctcacaaaatccttttaaaaatt

SEQ ID NO: 13904 - DNA, 201 bp, Homo sapiens
gcagggggatcaagaggtcaggagattgagaccatcctggctaacacggtgaaaccccgtctctattaaaaaatacaaaaaattagccgggcgtggtggcrggcgccagtagtcccagctactccggaggctgaggcaggagaacggcgtgaacccggaaggcggagcttgcagtgagccaagatcgcgccactgcactcc

SEQ ID NO: 13905 - DNA, 201 bp, Homo sapiens
ctttctgccataacatttttggcattctaaaacctccatacagcaaatccatctttcagatgtccttggtatgatgtcgctatgaaaagattactgaggcktctagcaatttgagtttaattcaaggccttttcataactgtacttcccttaaatacccaggccaccacctgcaggcctgctgcattccataggtgcttgc

SEQ ID NO: 13906 - DNA, 201 bp, Homo sapiens
cataatctattttgtacaatacaccttatacattgggaggttgttcatataaagtaagaatttggccaggcacggtggctcacacctgtaatctcagcacyttcagaggccgaggtgcacagatcacttaaggcccggagttcaagaacagcctggtcaacatggtaaaaccccatctctactaaaaatacaaaaattggc

SEQ ID NO: 13907 - DNA, 201 bp, Homo sapiens
atacatactggtgtggagaggtgcaaagggccatggtgcgtaatatcctcagacagttcaggaattaaaaaaagtctgagacagaaagagagagagcacayaaataataaagcaaatgggggccgggcgcggtggctcatgcctgtaatcccagcactttgggaggccgaggcaggcggatcacgaggtcaggagatcgag

SEQ ID NO: 13908 - DNA, 201 bp, Homo sapiens
tagaatagtgcctggctacagggcaaatactgtaaaagtgtgagctattcatatttgttcatattttttctttcaacagttaattaattttactatctccrttttactggaaacaccatttgctaagttttcttcaaattttctcttatttttcaaatcataccttattttgcacacaaaacatctatttttataaaggac

SEQ ID NO: 13909 - DNA, 201 bp, Homo sapiens
tttaaggattcattctttcactcaataaatagatattgattgcatgtgatataccagatcctaaagtttcaaatattaaaataaatcgttcctatttcaaraaatgtgtagtgcagtggggtggaggtggggtaagaggattgagtactttacatttggcaaccatcttgtgaaatgctttatatttattctcatgaattc

SEQ ID NO: 13910 - DNA, 201 bp, Homo sapiens
cacatatatatacacatatatatatacatatatatatacacatatatatacatatatacacatatatatacacatatatatacacatatatatatatatayatatatacacacatatatatatatatatatatatatatatatatgatggaatactactcagccataaaaagaaatgaattagtggcattcacagcaactt

SEQ ID NO: 13911 - DNA, 201 bp, Homo sapiens
gcagaggtagagtatgaaaaagagaaagcaaagatgactccaaagctgtagatcgagcaacagaaagcatgaatgggccatttgctgagatgggaagagcstaagagctgcaggtctggaagaaactatgagcagtttggttttgggtattttgcctttgcaaagcttcctagacattccaagtggagatgttgagttaga

SEQ ID NO: 13912 - DNA, 201 bp, Homo sapiens
cccttttctttcttgccctttagaatatttctacctggtggttgctgtggaacaaatcaatctacaaaaggagtcaaaacagaaacatattcaagaaaatkcaggctattgacatatacatctgtatttagaagctgttatttacttgagatcaaagagccatttgtcagtttccctttgacacttgattacattttacat

SEQ ID NO: 13913 - DNA, 201 bp, Homo sapiens
tggctcatgcctgtaattctaacattttgggaggctgaggcaggaggattgcttgaggacaggagttcaagaccagtctaggcacatagtgagacccccayctctacaaaaaattaaaaaattagcccggcgtagtggtgtgcagctatagtcccagctattcgagaggctgaggtgagaggattgattgagtctgggagg

SEQ ID NO: 13914 - DNA, 201 bp, Homo sapiens
gttgagctacagtatatgggaaatgcctcccagaaaagacgatatctaaatggatacttgaaaatactggggtgtggataagctcatgggagaatcaaccrcaaaaacaaacaccttctctgcactgaaagtataaatgtgcagggcaatgacaaaagacaggaagctagtgtggcacctgctggagagaatgagatgcac

SEQ ID NO: 13915 - DNA, 201 bp, Homo sapiens
ttatttgcataataaaataaaataacgacagatcttccaagattttcagtacttttttaaaaaactggtaattttggcaatgggagaagcataaactcttkctggctatgacaagttgagactgatataatgagaggaaatgcttaagcaatctataaggtagttattatgccaaaccccattttacagatgagaaaactg

SEQ ID NO: 13916 - DNA, 201 bp, Homo sapiens
gtttttttgacagggagtctcgctctgttgcccaggctagagtgcagtggtgcgatctcggctcactgccagctctgcctcctgggttcatgccattctcmtacctcagcctcctgagtagctgggactacaggcactcaccaccatgcccagctaattttttgtatttttagtagagacggggtttcaccgtgttagcca

SEQ ID NO: 13917 - DNA, 201 bp, Homo sapiens
gtaaactagttcaaccattgtggaagacagtgtggcgattcttcaaggatctagaactagaaacaccatttgacccagccatcccattactgggtatatamccaaaggattataaatcatgctgctgtaaagacacatgcacacgtacgtttattgtggcactagtcacaatagcaaagacttggaacgaacccaaatgtc

SEQ ID NO: 13918 - DNA, 201 bp, Homo sapiens
tacttttactctttcagattgatctcaattctgaatctaaaggcccaaatgaattcatgtatttatcaaatgagccaatcatccaactcttcccagcccakggactacaaggcttaatggttttaacttcacagtctcacaggatattcttgtgaaaactgtcaaatagtacatacctgttttaaaaaggtttataagtct

SEQ ID NO: 13919 - DNA, 201 bp, Homo sapiens
cttcaaatctaaatttatactttaatcaacttacatttgcatctatatcaacagtaatcaatagtacaacagcaacagcaatagtagaaaatgtcatactytgtcagtcaataatattaccttctttttatcactatgctgggcccttttcaaaaatactcactcaagccgtatttattttgatccttacaacaaactctg

SEQ ID NO: 13920 - DNA, 201 bp, Homo sapiens
aattattgcttaataggtacacaatttctgattggggtgatgaaaaagttctggaattagataatcatgatggtgagaatatatttaatattactaaattktacacttaaaatgattaaaatggtaaatttatactatgtatctctcattacaatagaaaattttaataaaatacatgaaaatttaaaaccacctaaaacc

SEQ ID NO: 13921 - DNA, 201 bp, Homo sapiens
cctttggcacacgaccctttaatataacttggttcaggactatatttttaaaaatctgggagaagggacagaatgtatgttcttcaatcaattattcatasaggctctctctcacggatactactgaggaacaaccatcagcataatgcctggagtacagttctctttgttgtcagttaaatagagaaccacatgccataa

SEQ ID NO: 13922 - DNA, 201 bp, Homo sapiens
tataagggtgaagacaaatgaaaagtgggaacagaatttaaaatccacgttataatgccctatattcctgccctttgggccccaaatttggctctcagctytagggcagtcaacacaagatggaaaaacgttaataacacacttcacgctgtcaataagattaaaaacataggaatggctcaagagacgaacaactattct

SEQ ID NO: 13923 - DNA, 201 bp, Homo sapiens
agtgagccgagattgcaccactgcactccagcctgggcaacagagcgagactccatctcaaaaaaaaaaaaaaagaaaaagtaaagaaaaacagaaaaatrtaaagcagagtttctctttgggattgtgagatatgtgatgaggcctcattttttgcagtctataacacaaaatataaaacaatacttcacatctggaggc

SEQ ID NO: 13924 - DNA, 201 bp, Homo sapiens
tcacggaatttttataaagataaaaggataataaaagataaaaggaaaacaggtaaagtgctgggtacttggtaggtgcctagttattttttaaagctatsatgtagaggtgcatctatgaaagactgacttactcacttggcagaaactggttgcttccatacaatctcatagtattttgaaaacttttcttttcaaaag

SEQ ID NO: 13925 - DNA, 201 bp, Homo sapiens
tatacacatatatatatacatatatatatacacatatatatacatatatacacatatatatacacatatatatacacatatatatatatatatatatatayacacatatatatatatatatatatatatatatatatgatggaatactactcagccataaaaagaaatgaattagtggcattcacagcaacttggatggga

SEQ ID NO: 13926 - DNA, 201 bp, Homo sapiens
ttgggattaaaatttaacagagaattttcccccaggttcctcaaaagaacactgtataacaaataatgtattggccttccctaagacctcagttgcacagragcatactatccaaccagcctcgaaacgggctaatggcatcaccacaaatcattctgcatttcattaatgcaatacctttggcacacgaccctttaatat

SEQ ID NO: 13927 - DNA, 201 bp, Homo sapiens
tgtcataatgagtatccactatctgcaatgcttgccaaacctttaccttaaacttaagtagctgcttattttctccacatttttggtgccccagtccttgsgtggctctatatgtgacagtaactctaggtaagaagtcaacatcatgtacttaggctgttttttcacacagtattcttacatactctgcctatttgggtc

SEQ ID NO: 13928 - DNA, 201 bp, Homo sapiens
ctgagaaaatggtttagtgtggcacaaagaaattaaaaccaggttgatatggttaggcttcgtgtccccacccgaatcttatcttgaattgtaatccccaygtgtcgaggcagggaagtggttaaattatggaggtggtttcccccatgctgttctcgtgatagtgagtgaattctcacaagatctgatggttttatagat

SEQ ID NO: 13929 - DNA, 201 bp, Homo sapiens
gatcaagaggtcaggagattgagaccatcctggctaacacggtgaaaccccgtctctattaaaaaatacaaaaaattagccgggcgtggtggcgggcgccwgtagtcccagctactccggaggctgaggcaggagaacggcgtgaacccggaaggcggagcttgcagtgagccaagatcgcgccactgcactccagcctgt

SEQ ID NO: 13930 - DNA, 201 bp, Homo sapiens
aggtacaaagcttcagaattctttttgagttcaaatgaagaaaaatgtttgaagatcactcttttaaaataatccaaagtttgctgctcagcttttaaaamctgtttatgttgctgaggtggttgctcggcctaatggccctttccactgtttctctggctatgaaaagcttatgaatcttcccaggttttgccaatgccg

SEQ ID NO: 13931 - DNA, 201 bp, Homo sapiens
attagatgaaacaacaaaaatataagccaacatctcaatacacactgaaagagaaagcacccacattttgcacgttttcctctagagaaataattgacttmtttgtgatttaaaaagaagtctccagtttccaaaaattttcattttcttgtgcacacttagcaacattattctctggttttctgtcataattatctcctc

SEQ ID NO: 13932 - DNA, 201 bp, Homo sapiens
gggaagagcctaagagctgcaggtctggaagaaactatgagcagtttggttttgggtattttgcctttgcaaagcttcctagacattccaagtggagatgytgagttagaggaagctggatatgagagtctggagctaaggagagacatttttaaactggaaagagttttgagttcatctctagggaaatatcagaaaaga

SEQ ID NO: 13933 - DNA, 201 bp, Homo sapiens
aggaaagtacaattagtctacgagggaagttacgtgttggcattagccctggacacagacaatgtgaaaggatgcaaggcaattcacaattcaattcaacygctgaagtggaaagaaaacttctacttagctggtgattgatcatgtacaagtgggagtaagtttaccttcaggtggcttcactcataattgacaaaaaat

SEQ ID NO: 13934 - DNA, 201 bp, Homo sapiens
catgtgctggcctcacaaagtcttttataaaactggctggggcttctgtttttttgacagggagtctcgctctgttgcccaggctagagtgcagtggtgcratctcggctcactgccagctctgcctcctgggttcatgccattctcctacctcagcctcctgagtagctgggactacaggcactcaccaccatgcccagc

SEQ ID NO: 13935 - DNA, 201 bp, Homo sapiens
gatttttaaatggccacaaactttttgacactcccttagggagaggtgaggtttgtatcactttccgtgaaatctggacaggcttataattgcttcagccratagaatgcagtggaaatagtggtatgtaaaatttcctagctagtccttaagtgacaatagaactttctcttggattttttggagtgctccctcttggga

SEQ ID NO: 13936 - DNA, 201 bp, Homo sapiens
acttcctttcattcacccataaacacacattattggtggaatgatcactactcacaatcagtttattgcatttgtgaatatctcaaattattagaaagttstttttattgaggccccaatacacttctgtaacttttacttagtaatcataatgctaaaagcaagcctttaaaaataaggcatttttatgcatttaaatga

SEQ ID NO: 13937 - DNA, 201 bp, Homo sapiens
gaaaaggctctgtatttttggtatggccaaaactgacagtttaaaaacttttattaacactttaacctaacagattaatcttaataattaatgaaaagtgytttgattcttaagaaagtttgaaatttacatcaacataaatgtcggtgaataaatttcaagcaaaaattcctagtcaaaagtcaacttaaaccatttaca

SEQ ID NO: 13938 - DNA, 201 bp, Homo sapiens
atttcagtggggtcgaagatgtaaagtagataacttgccacttcatcaaagatgatttacaagtttataccaaggtatgaacctaatccacaaagggatcrttatttaaaaaaatgtaaagaggatagtgacatggtttcaactgcattttagtcctcttagttagaattgaattttaagacctagactgtttatcaactg

SEQ ID NO: 13939 - DNA, 201 bp, Homo sapiens
ctataaagacacatgcacatgtatgtttattgcggcactattcacaatagcaaagacttggaaccaacccaaatgtccaacaatgatagactggattaagraaatgtggcacagatacaccacagccatactatgactagaatactatgcagccataaaaatgatgagttcatgtcctttgtagggacatggatgaaattg

SEQ ID NO: 13940 - DNA, 201 bp, Homo sapiens
ccaagcaaatggaaaacaaaaaaaagcaggggttgcaatcctagcctctgataaaacagactttaaaccaacaaagatcaaaagagacaaagaaggtcatyacataatggtaaagggatcaattcaacaagaagagctaactatcctaaatatatatgaacccaatacgggagcacccagattcataaagcaagtccttag

SEQ ID NO: 13941 - DNA, 201 bp, Homo sapiens
tcatggggtaccttgctgtgttttcagacctcagtgatgacagaggtgcttctactctaaggtcaattaagggaaaggctgtgtgttatatcacatgaaarttctcctgctctaaagtgagaacagagatcatttggttattgcctatgaacatgtccccgtttcatcttcagttggcaaaaagtttgcaattaaaacagg

SEQ ID NO: 13942 - DNA, 201 bp, Homo sapiens
tatttaaagcatacacacacatgcatgcatgcgtgttctctctctctctctccccccccaccaacctttcactctctctaggattggcagaagatggtgcrgcaagaagcataggaattgtctccccatctagacaacaattacactggcagaataggtcttacataattattttggaactctgatgtctattgaaggctt

SEQ ID NO: 13943 - DNA, 201 bp, Homo sapiens
cagctcctacattttaaaaaaaggaataaaattatttctgagccctgtctcacttgagtaataagtaatattcactcaccaatttatgaactaaatttaaktcgatttcattaaataatgtatttccagtaatattttaatttttgttatacaagcataaagatttacagaatatttatcttactgaataatatctatata

SEQ ID NO: 13944 - DNA, 201 bp, Homo sapiens
aacaggtatcgccatccctgtttaacaagattattaagatgcagaaacttcatatccagaagttaggaggctgccaaggattccaaagctctttgactttrtacctccaaagcttagaacagagtttgacacatacaaactcaatatacatctatataggacaataacttgagtcttctatttgtaaaccagtattctctt

SEQ ID NO: 13945 - DNA, 201 bp, Homo sapiens
tatacacacatatatatacatatatacacatatatatatacatatatatacacatatatatacacatatatatatacatatatatatacacatatatatayatatatacacatatatatacacatatatatacacatatatatatatatatatatatacacacatatatatatatatatatatatatatatatatgatgga

SEQ ID NO: 13946 - DNA, 201 bp, Homo sapiens
gtataagcaaagggagcattttgataaacaacttagtcatatcaggccgggcgcggtggctcacacctgtaatcccatcactttgggaggccgaggtgggyggatcacaaagtcaggagatcgagaccatcctggccaacatggtgaaaccccatctctactaaaaatacaaaaattagctgggtgtcgtggcacatgcct

SEQ ID NO: 13947 - DNA, 201 bp, Homo sapiens
agactggcgccatggccccctctgcctcacgtctgtatcacccccttccatgcaacatccatctggatggctccagaggcaacctgaaaatccaagttgcwactgtaaacagtggtgggtgggctgagtctcctctgggggtggcctggccccggataatgacccttctaacctgccttcagtggccgctgtccagagccc

SEQ ID NO: 13948 - DNA, 201 bp, Homo sapiens
tatatatatacatatatatatacacatatatatacatatatacacatatatatacacatatatatacacatatatatatatatatatatatacacacatayatatatatatatatatatatatatatatgatggaatactactcagccataaaaagaaatgaattagtggcattcacagcaacttggatgggattggagac

SEQ ID NO: 13949 - DNA, 201 bp, Homo sapiens
aatgtgagcagaggcaaatgtagccatttctcagggactgagttaactagcgtcacatggcatgacctgaccttctctaactcctgggctctggcttcctycttggtcttggcttacctcatagctactggacttttgaccttagtaagtcaaaggcttcttagccctggtgctatttcttggcttccacacattctgtac

SEQ ID NO: 13950 - DNA, 201 bp, Homo sapiens
aaacctgagggctttctgtgggtcaatgtgttgaattttgagctaaactctgacctgattgttctcataaagtcagtacagacaattgtctgatgtcagcrtaatatgctggtttgaaaaagacagtgaagcaaatttctagcgccaggtagcattagtacctacctcaaagccaggactcacaggagactgaaacatgaa

SEQ ID NO: 13951 - DNA, 201 bp, Homo sapiens
aggcacagtacttgactaacagatatctagtaaattcagacctctagtacagctggagatgtctgctgccttttcattagcaagatactaccagtaactcrtgaaaagagaagtctctatgtaagttgtccattgtactaaagttcaaaagttccaaatacatcaaagaaaagcacctttctagtacattagggaaaacta

SEQ ID NO: 13952 - DNA, 201 bp, Homo sapiens
aaaaaacacactagagaaattagaaggtaaacttgagcaggcagatgaatcagcaaacttgaagatagaacactggaaatatctattctgaggaaaggaawgagaaaagactgaagaaaagtgaacagagccaaagggacctgtggaacaccatcaagtgaactaacaagtgcattgtgggagtaccagaaggaggagaga

SEQ ID NO: 13953 - DNA, 201 bp, Homo sapiens
ttttaaaaaagtaagtcatctacattgctgtaggcatgcatagttcattacgtttttgttttttttttttttttttttgctgagttgtatttcattttgtwaagattccactgctcatccattcaccagctgaattctttcagcggcatcagtttactcattcacctgggaattagggtagacggtcagctaggatttgtg

SEQ ID NO: 13954 - DNA, 201 bp, Homo sapiens
catatctttttcaggtttttatcatatgaaactcaataaatggcagttaaatgaaactataaatgaagaaatgaaatgttccgttttgcgaaaaaaaattrtccgttaaaactgggaattaaaaattatgacatgcttgcatgagaagtaaaaaattatggcaggtatataaaaatcggaatttatcaatgatctcaactg

SEQ ID NO: 13955 - DNA, 201 bp, Homo sapiens
caagggcactgaacattttatatttcaaaactgacatagaagtatcaaataaaaagagcaaataaaagcatatttgaatttggatgagcatatttgcttayagaaaaaaataagatatccaccaaaatattaactatatttaactctgagtagtatgatccactttggggcttatctgaatttctcaccttttctgcaatg

SEQ ID NO: 13956 - DNA, 201 bp, Homo sapiens
tggctccaatattttctcacttaataaatatctgatttgatcataattttacaagcattcttgacaaagtctaattttaaaaatgtgtacttataaaatakattttaagcattttacaaaaaaattttaattcaccatttaatttcaacattttatgtaacgtatcaaataattcaaataatttagtggttatttaatttg

SEQ ID NO: 13957 - DNA, 201 bp, Homo sapiens
cagttagaatggcaatcattaaaaagtcaggaaacaacagctgctggagaggatgtggagaaataggaacactttcacactgttggtgggactgtaaactrgttcaaccactgtggaagtcagtgtggcgattcctcagggatctagaagtagaaataccatttgacccagccatcccattactgggtgtatacccaaagg

SEQ ID NO: 13958 - DNA, 201 bp, Homo sapiens
agaaaaccacatacttcatgttctcacttacaagtgggagctaaacactgggtacacatgaacataaagataggaacaacagacactggagactacaaggygggaaatgatggagagaaacaagggtttaaaaactacctagtgggtactatgttcactgccctagtgacaggttaaatcatgccacaaacctcagcatca

SEQ ID NO: 13959 - DNA, 201 bp, Homo sapiens
aagccactgggtttatgtaaatattgttaagatctacatcctagttgacattccacattagtagatgaaattaacatctgtcacaaaggttgctctgaagytaatcagttatttctgagtactcgtaatttggtaaaggaaagctaggcatgcgtgattcgctttaccactcaagcaacaactgacgccctgtgtccaact

SEQ ID NO: 13960 - DNA, 201 bp, Homo sapiens
tttaaatgacattcctaagggcactggataataagttgactcaaatttaggttatttgactccaggagcaactgacattccactaaaccaactttccagcytttcccagatctttatcttccccaattatgggttaattccgtaattagtttaaaaattccacacttactaaaagaatataccagtccaattttcgaacct

SEQ ID NO: 13961 - DNA, 201 bp, Homo sapiens
tactatattgccacttcttttgtgctacaaatacaaatacaaaacactctttaatggagcactgtcctcattatacaaccgaccactgacataaaaggcawgaaggttaagcccacttttgaaaagctcttaagtaacaggtcagaggacagaaacgttaggatgagaccattataagttgttgatagaagaggaaagata

SEQ ID NO: 13962 - DNA, 201 bp, Homo sapiens
cttgtctgcctgctccttgcccctacttcaacatgaaaatctgtgcagaactcttctgctaccaaactcaaacacttaataggctgttcatattaatgggkggccctcagcatcaaggatgcaatgaggaatggttgagactatagtaatttggagaggacagcgtcactgtaaaacagatagctacagctcaattagttc

SEQ ID NO: 13963 - DNA, 201 bp, Homo sapiens
gtacgttatcttaaaataagtattttttgttgaattaccatcacaatgtttcaagtacaatcgtgtctgctacataattagagaacaactatactctaaaytctaaataataacaataataatttacaggtgagtttctcagggaaacttatgcagccttgtacacctcagttgctcatcccaaaggaaatgtcctgtgat

SEQ ID NO: 13964 - DNA, 201 bp, Homo sapiens
tttctaaaaaatcagtgttacagacattctgttcttcaagtatgacccccttcccttcacaccattattgggtttgtgtttaggagaaagagaatattaaragtgtgaattattaccaaaaaaaaaaaaaaaaacaaacgctggaatctacatgaagctgtttaatggtttataaaaattgaaaaatggagcaaatatctg

SEQ ID NO: 13965 - DNA, 201 bp, Homo sapiens
aggaaagcaggccgggcacagtggctcacgcctgtaatctcagcactttgagaggccaaggcgggttcgagaccagcctggtcaacagagtaaaaccctayctctacaaaaaatacaaaaattagctaggcgtggtggcacatgcctgtaatcccagctactcaggaggctgaggcagaagaattgcttgaaccggcaggt

SEQ ID NO: 13966 - DNA, 201 bp, Homo sapiens
aaaattatggttgggggacctgtccatgttaatacatgtatgtacatccaggtcattatttttaatttctagttatatctatcctactaacataccatatyattatttatttaagttgtttttgctttcctcacaaacaaacaatgctacagtggatatattagcacacatctccttaggcttatctgcagaagtttctga

SEQ ID NO: 13967 - DNA, 201 bp, Homo sapiens
ttttttgacagggagtctcgctctgttgcccaggctagagtgcagtggtgcgatctcggctcactgccagctctgcctcctgggttcatgccattctcctrcctcagcctcctgagtagctgggactacaggcactcaccaccatgcccagctaattttttgtatttttagtagagacggggtttcaccgtgttagccagg

SEQ ID NO: 13968 - DNA, 201 bp, Homo sapiens
aaccatgaagctctcttctccaatcctataatgaagaataaatatctcctgtacgcatgctaactctgtattccttccctgcaaaagtatcttccttcagragaccacagtgcgtggagactggaagtgcaagggccaggttaggaaagatgtcatttactagagtttcagatgtcatctgcacctcaatgttgccagttg

SEQ ID NO: 13969 - DNA, 201 bp, Homo sapiens
agttaccaaaaatgacatggttaatatacatgatttgatgactctttctatgaaatgtaagttttacctttctccttaaatgtacaggttttttggccaaraggtaataaaatgtgtgccctaagtcaggtttttctttctgtttttctttactgtttgtttttgttagtgaatatacaatttaaaagaattccaggacaa

SEQ ID NO: 13970 - DNA, 201 bp, Homo sapiens
tgaaaaaataaaaacagtctccctcctccaaaaaccgagagacaaatatgaagacaagtgtactcagaagtgggtaatattgtatacaaggcaggaaagcrttatgcaaatctgggaagtgatgaccttcactcaagcgcttattatgagaagaagatgaaggataagtacagagatgtgtcatgtcatccacaataatcc

SEQ ID NO: 13971 - DNA, 201 bp, Homo sapiens
taagaagactggcgccatggccccctctgcctcacgtctgtatcacccccttccatgcaacatccatctggatggctccagaggcaacctgaaaatccaarttgcaactgtaaacagtggtgggtgggctgagtctcctctgggggtggcctggccccggataatgacccttctaacctgccttcagtggccgctgtccag

SEQ ID NO: 13972 - DNA, 201 bp, Homo sapiens
ggttcgagaccagcctggtcaacagagtaaaaccctatctctacaaaaaatacaaaaattagctaggcgtggtggcacatgcctgtaatcccagctactcrggaggctgaggcagaagaattgcttgaaccggcaggtggaggttacagtgagctgagatcacactgcactccagtctgggggacagagcaacactccatc

SEQ ID NO: 13973 - DNA, 201 bp, Homo sapiens
gaattaaaaatccaatcaagtgatcaatcaaggaaggaatttgagacttgttaggacaaagaggtaatatataaatggaatccagggatgtgggatacackattccccctttcttgaagtgatagaatcactgatagaaatagggttctgtggagttgatctatacttgtcacaaaaatccaatctttgtcccagctaaaa

SEQ ID NO: 13974 - DNA, 201 bp, Homo sapiens
aattttggacacagtttcacaaagccctagagactgccaacattcaatcacatacttaatatctataagaattaatgtagccttaagagaaagaaagattrtgaaagtgtagtatttcatcaacttcaatagtctttcatgtagataaaaaagagatttgcctatcttaagagctaacggaattaaaaatccaatcaagtg

SEQ ID NO: 13975 - DNA, 201 bp, Homo sapiens
ccagacgcgccgccttaagagctgtgacactcaccgcgaaggtctgcagcttcactcatgaagccagcaagaccacgagcccaccagaaggaataaactcygaacacgtccgaacatcagaaggaacaaactctggacacaccacctttaagaactgtaacactcaacgcgagggtccgtggcttcattgttgaagtcagc

SEQ ID NO: 13976 - DNA, 201 bp, Homo sapiens
ccagtgagaccatgaacctactgggaggaatgaacaactccggatgggaggaacgaacaactccagacgcgccgccttaagagctgtgacactcaccgcgmaggtctgcagcttcactcatgaagccagcaagaccacgagcccaccagaaggaataaactctgaacacgtccgaacatcagaaggaacaaactctggaca

SEQ ID NO: 13977 - DNA, 201 bp, Homo sapiens
tggattaaaaataaatcttaatacttacctttaaaataatctgaggagaaagggataaaggggtgacaactgaggaacaaaaaatgattaatgaaaaaagmctgtctatatttagatgtttattaaggctgggtactgaagatggtataggaagtccatcatttaaagtgaaaataaagcctaagcttgtacagtctagct

SEQ ID NO: 13978 - DNA, 201 bp, Homo sapiens
ccaggttcctcaaaagaacactgtataacaaataatgtattggccttccctaagacctcagttgcacaggagcatactatccaaccagcctcgaaacgggmtaatggcatcaccacaaatcattctgcatttcattaatgcaatacctttggcacacgaccctttaatataacttggttcaggactatatttttaaaaatc

SEQ ID NO: 13979 - DNA, 201 bp, Homo sapiens
atcattcatgatttattgtataaattaatttactggttttcaaaccttgtcaaaaaaacacataatctattttgtacaatacaccttatacattgggaggktgttcatataaagtaagaatttggccaggcacggtggctcacacctgtaatctcagcactttcagaggccgaggtgcacagatcacttaaggcccggagt

SEQ ID NO: 13980 - DNA, 201 bp, Homo sapiens
tatctaataataaaaaatttataattttttcatattttataaaaaatgaaaatatctatgatcctactagccagataaaaccacttacaattttagataawaagagtatctttctagatttctatgtatctatacaaatttttaattgactcattttataagtctattttataagcttattttactcaaccatatatcgtg

SEQ ID NO: 13981 - DNA, 201 bp, Homo sapiens
ttccattttctttaaagaactcaagttttccaaatatattagccaaatggttgaggaagtttctctttgtatcaagaacaatattctgtgcctttttccastaaatgtgaaatcatttcatggccacccatacaaaaaaaaaaaaaaaacagcattacacatcatctctttcagaagtttgttttgcagtttccatgttga

SEQ ID NO: 13982 - DNA, 201 bp, Homo sapiens
cctaaagatgataatgaattaactatatggcacatccctgccgctactgctctcttttcctctggcacaaagatggtcaagtctagaggtgtgacaggtamacaagagggagtcaacacaaagcatgccctctatattgcatgaagattttatctgtattatatgtgtgtgtattcagtgtgtccatattactgatgcaat

SEQ ID NO: 13983 - DNA, 201 bp, Homo sapiens
ataaaataaaaaataaaaaaataaacacttttttctgtaacaatggttgcaatatatttatagaatacctgagctataagaaaatactctccggtatccayacaaagccccttcacgtagcagtgatacgtgtccaggaggaactttagaacaggcattaaatgacggaaggaggaaagagacttgccctccactcagaca

SEQ ID NO: 13984 - DNA, 201 bp, Homo sapiens
aaaaaaaaaaaaatagccaggcgtggtggcacgcacctactcaggaagctgaggcaggagaattgcttgaacctaggaggtggaggttgcagggagctaasatcgtaccaccatgctccagcctgggtgacagcaagactcggtctcaaataaaataaaaaataaaaaaataaacacttttttctgtaacaatggttgcaa

SEQ ID NO: 13985 - DNA, 201 bp, Homo sapiens
agtttgagactagcctggccaacatggtgaaaccccatctttactaaaaaaaaaaaaaaaaaaaaaaaaaatagccaggcgtggtggcacgcacctactcrggaagctgaggcaggagaattgcttgaacctaggaggtggaggttgcagggagctaagatcgtaccaccatgctccagcctgggtgacagcaagactcgg

SEQ ID NO: 13986 - DNA, 201 bp, Homo sapiens
acaattatgaaaacttctgcaatctgtctttacttgctgctctcagatgcatcactgtcagcatctgaccctgttaggtggctgataagaggattttgaargccagcagattttatttttaacctccccatatggttgaccttctaatttcaatgagagcatcatctgcagagatgatcatcaaatggcaactcctaccct

SEQ ID NO: 13987 - DNA, 201 bp, Homo sapiens
ttagcataacatcctcaagattcatcaatagtctatcatgtatcatgtattacttcttttttaaggttgaacaatattccactgtgtgtgtgtgtgtgcaygtgtataccacgttttgtttagccattcgtccatcaatggaacttgggttgcttcgaccctttggctactgtattacgttgttctagcattgctataaag

SEQ ID NO: 13988 - DNA, 201 bp, Homo sapiens
ggggctgaagggaggacaggaatggggaattattgcttaataggtacacaatttctgattggggtgatgaaaaagttctggaattagataatcatgatggkgagaatatatttaatattactaaattgtacacttaaaatgattaaaatggtaaatttatactatgtatctctcattacaatagaaaattttaataaaata

SEQ ID NO: 13989 - DNA, 201 bp, Homo sapiens
agtattattcaaccataaaaaggaatgaagttctgatacatgctacaacatggatgagccttgaaaacattacactaggtgaaataaactagacacaaaasaatgaacattgtatgattccacttatatgaaatatttaagatagccaaattcatggagacagaaagaaggttagaggttgccaggggctgaagggaggac

SEQ ID NO: 13990 - DNA, 201 bp, Homo sapiens
tcttctgtgggaacatggatgtagctggaggccattatccttggcaaactaacctaggaacaaaaaccaaatacttcatgttctcacttataagtgggagytaaatgatgagaacacatggacacaaacagatgaacaacagacactggagcctacttaagggtggagggtggacagagggagaggatcagaaaaaataac

SEQ ID NO: 13991 - DNA, 201 bp, Homo sapiens
agacacatgcaagtgaatgttcactgcagcactatacacaatagcaatgacagggaatcaacctaaatgttcataaatggccgattggatgaggaacatgwggtacatatacaccatggaatattattgcagccataagaagaatgagatcctgtcttctgtgggaacatggatgtagctggaggccattatccttggcaa

SEQ ID NO: 13992 - DNA, 201 bp, Homo sapiens
attctatcataaagacacatgcaagtgaatgttcactgcagcactatacacaatagcaatgacagggaatcaacctaaatgttcataaatggccgattggmtgaggaacatgaggtacatatacaccatggaatattattgcagccataagaagaatgagatcctgtcttctgtgggaacatggatgtagctggaggccat

SEQ ID NO: 13993 - DNA, 201 bp, Homo sapiens
ggaatataaatcattctatcataaagacacatgcaagtgaatgttcactgcagcactatacacaatagcaatgacagggaatcaacctaaatgttcataawtggccgattggatgaggaacatgaggtacatatacaccatggaatattattgcagccataagaagaatgagatcctgtcttctgtgggaacatggatgta

SEQ ID NO: 13994 - DNA, 201 bp, Homo sapiens
aggaatataaatcattctatcataaagacacatgcaagtgaatgttcactgcagcactatacacaatagcaatgacagggaatcaacctaaatgttcataratggccgattggatgaggaacatgaggtacatatacaccatggaatattattgcagccataagaagaatgagatcctgtcttctgtgggaacatggatgt

SEQ ID NO: 13995 - DNA, 201 bp, Homo sapiens
ctaccattcaacccagcaatcccattactgggtatatacccaaaggaatataaatcattctatcataaagacacatgcaagtgaatgttcactgcagcacwatacacaatagcaatgacagggaatcaacctaaatgttcataaatggccgattggatgaggaacatgaggtacatatacaccatggaatattattgcagc

SEQ ID NO: 13996 - DNA, 201 bp, Homo sapiens
ctaaaatgggcttgcaaaaaaaaaagccaatttcatatataaggccaaactctagtatctattttataaaaactccaactctacagcaaaaacaaacaaamaaaaaaaaacaaaaaaaagcacccaatcaaaaaccaggcaaaggacttgaataaatatttctccatagaaaatacacaaatagacaacacatgaaaagat

SEQ ID NO: 13997 - DNA, 201 bp, Homo sapiens
tcataaaacaaaattagctttgactttgataaagacagcaacattctaataatctgaattattttgccactctttatagagaatttcttactgaatggctrtagcatagttcaaggtttcctttcaatcacctcacaagtgggaaatacacatatattaagtaaaactggcagaaaagagtcagtttaggagtcaaaaatt

SEQ ID NO: 13998 - DNA, 201 bp, Homo sapiens
gggagggcttcctgattagactcacccctgatctcagtttggttttcttctaagcacctatcaccatctgacctcataattcattgaccatcttccctacyagaacataaactctatgagggtacaaactggtttttacactactgttgtcctcacctataatagtgtatggcaaattgtacatgctcagtaaatatttgt

SEQ ID NO: 13999 - DNA, 201 bp, Homo sapiens
ccttatcagtaattactctgaatgtaagtagatcaaactctccaatcaaaaataccaagatcagtagaatggatcaaaacatatgatccaactatattccrtctacatgagactcactttagattgaaaaacacaagtaaactgaatgtgaaaggatgaaaaaagatagttcatataaatcataaccaaaaaagagcagaa

SEQ ID NO: 14000 - DNA, 201 bp, Homo sapiens
agattcaagtgtctgattctcaacaaaaaatcacaatccatacaaagaaacagaaaactataatccatccaaacaaaaattaattaacagaaactgtctgyaaaaaacacctgatgacagatctacctgacaaaaacttcaaaacgactgtcttaaagatgctcaaagaactgaaggaagatgtagataaagtcaataaaa

SEQ ID NO: 14001 - DNA, 201 bp, Homo sapiens
tactatacatacatgttatacccaaccagtactgcatttttcaacatctaagtagtgatagttcctgctcatatttattcattcaatatcaaactaaaatmaacatttactgatgttaggcattcttctaggccctgaggatacaggtataaacaagaaaaatccctgatttatggagcttacattttactgtgagaaact

SEQ ID NO: 14002 - DNA, 201 bp, Homo sapiens
ctttgtccatcagatatccgttctggtcagaaagatggaggaaaagagaaagaagaaaggcacccctttgctgttaagataattttccataatgaccatayaacatttctggctacaacataacctcctgtagcacagcaaggaaatacagtctttacatgtgtgcagcatgccaatctaacttgttattattgctgtctt

SEQ ID NO: 14003 - DNA, 201 bp, Homo sapiens
ccatgtgaagatacagagagaagatggctatctacaaaccaaagagagaggtcctcagaagaaaccaaccctgctgacatcttgatcttgtacttctaggytccaggagcatgagaaaataaacttctattgtttaagtcacccattctgtgggacttttttatggcagctccagaaaataaatatggaagataagtgcaa

SEQ ID NO: 14004 - DNA, 201 bp, Homo sapiens
agcataccaagcatgaaaatagtctttcctttgaaccgctttttctgaaagactcctgggagtatggaccaggcagagggttaaatgtggggagcgggtayagcagggaagagagaatggctggcaactcaaactttggagcaaaaggtcatgaaaaagacagtatccaaaagtgaaatggtaaacaaaaactcaaacaaa

SEQ ID NO: 14005 - DNA, 201 bp, Homo sapiens
acgagatctaatggttttaaaaacggaagtttccctgcacaagctctctctttgcccgctgccatccatgtaagatgtgacttgctccttcttgccttccrccatgattatgaggcctccccagccatggggaactataagtccattaaacctctgtttcttcctggtctcgggtatgtctttatcagcagcatgaaaaga

SEQ ID NO: 14006 - DNA, 201 bp, Homo sapiens
ttttaatagtatcctttattatacagagactttactggtggtataaaatttatctaccttttcttatttagctcaataaaatcaaatttatgtaaccataygtttttcatccaaaatgcttataaatggacacccttatttgtaacctcctcagagaaaactgaggagaacacgaattagactagttccctttttgcattg

SEQ ID NO: 14007 - DNA, 201 bp, Homo sapiens
tcatgcatgcatttctccattgacatgtttgcatttctcttattgatttataagacttttctgtttgtctgttatgtatgttgttttccttcagacaaaarttggcctttagtttttttaatagtatcctttattatacagagactttactggtggtataaaatttatctaccttttcttatttagctcaataaaatcaaa

SEQ ID NO: 14008 - DNA, 201 bp, Homo sapiens
cttatttagggaagagtgtcacagcgtgcttttcgtttttactctttttaatctttttgatgatgtgctttttaaaccataagtattttaaatgaaatttytaatgcagaggggaagaaaaggtttctttgtatgttcatttgtttctagctactcttgatgtaataagagaccttcttttaaataattacccttaggcag

SEQ ID NO: 14009 - DNA, 201 bp, Homo sapiens
tatatatgatggaatatatatatacatatatatgatggaatatatatatacatatatatgatggaatatatatatacatatatgatggaatatatatatayatatatatgatggaatatatatacatatatatgatggaatatatgtatacatatatatgatggaatatatgtatacatatatatgatggaatatatatat

SEQ ID NO: 14010 - DNA, 201 bp, Homo sapiens
catatatatgatggaatatatatatacatatatatgatggaatatatatatacatatatatgatggaatatatatatacatatatgatggaatatatatayacatatatatgatggaatatatatacatatatatgatggaatatatgtatacatatatatgatggaatatatgtatacatatatatgatggaatatatat

SEQ ID NO: 14011 - DNA, 201 bp, Homo sapiens
gcacaattcacaactgcaaaaatgtggaaccaacctaaatgcccatcaatcaatgagtggataaagaaactgcgtggtatgtgtgtgtgtgtctctctctmtatatatatatggatgtacatatatacacacacatatatatgatggaatatatatatacatatatatgatggaatatatatatacatatatatgatggaa

SEQ ID NO: 14012 - DNA, 201 bp, Homo sapiens
tttctgttctatctgaataacatactgacttttaagtttgaatagagacagagttcaagttaagttctcattctattcactctctccttacacactgaatmgcaaaattaaacaaaggactttattttaaaaggaagcataatcagggacacactggaatttttatagacattcagggcttataaagcaacataaaggaaa

SEQ ID NO: 14013 - DNA, 201 bp, Homo sapiens
gtaaaatcaactaataacacaagagaatggcaggaagtcaaccaagtaaaggtgttttcattgaataataagcagatcagtatggttgggaacacagcatytcctgggaatatggataatggggaagacaaaccaattagggccagatgctgaatggccttgtataacacgctaaggaaccacaagacaatcctgtggagg

SEQ ID NO: 14014 - DNA, 201 bp, Homo sapiens
gttaaggtactttatcaatgacaaatttattgatattgatcattgcactgtggttatataaaacaatacctgatccttaggaaatacatactggtgtggakaggtgcaaagggccatggtgcgtaatatcctcagacagttcaggaattaaaaaaagtctgagacagaaagagagagagcacacaaataataaagcaaatg

SEQ ID NO: 14015 - DNA, 201 bp, Homo sapiens
aaactgaaatataaatggtaggttaaggtactttatcaatgacaaatttattgatattgatcattgcactgtggttatataaaacaatacctgatccttakgaaatacatactggtgtggagaggtgcaaagggccatggtgcgtaatatcctcagacagttcaggaattaaaaaaagtctgagacagaaagagagagagc

SEQ ID NO: 14016 - DNA, 201 bp, Homo sapiens
ataacactatgcttatcagaatgggctacataatttgcagggccccttgttcataaagcagaggaaaagtgccattaaaggtactaaaatatcaagtgttytcctttcttccgcagcttcccctcaacctgccatggtgttatttgctacttgacatccttcaggcacagggatatctgcacaataaatgcagaccttcca

SEQ ID NO: 14017 - DNA, 201 bp, Homo sapiens
aaagaaatgactttatttgttcatccataagaagccactagtcatccattcaagtttaatcattagattgcagcaattcggtcctactttcaggctctacytttttttttttttttttttttttttttttttttttttttttgagatgggagttttgctcttgtcgcccaggttggagtacaatagtgttgtctcagctca

SEQ ID NO: 14018 - DNA, 201 bp, Homo sapiens
tcaaaagaaatgactttatttgttcatccataagaagccactagtcatccattcaagtttaatcattagattgcagcaattcggtcctactttcaggctcyacttttttttttttttttttttttttttttttttttttttttttgagatgggagttttgctcttgtcgcccaggttggagtacaatagtgttgtctcagc

SEQ ID NO: 14019 - DNA, 201 bp, Homo sapiens
tcaaatcctgccactgctttatcaactaagtttatgtaaaaccctaaatcctttgttgtcatttaaataatgttaacggaatcttcaccaggagtagattytagattctatcaaaagaaatgactttatttgttcatccataagaagccactagtcatccattcaagtttaatcattagattgcagcaattcggtcctact

SEQ ID NO: 14020 - DNA, 201 bp, Homo sapiens
atcgtctccagtggtctcttgacaggggatgatttcagggtgaaactgttccacctcagatcatcaggctcttatgagaatctgatgccgctgatctgacrgaaggcaagaaagcagagctcagacggtaatgctcactggctcactgctcaactcctattgtgtctatggtttgaggtttggggattcttgatgtaagcc

SEQ ID NO: 14021 - DNA, 201 bp, Homo sapiens
gctactggggaggctgaggcaggagaattgcttgaactcagaaggcgaaggttgcaatgagccgagatcaggccattatactccagtatgggcaacaagarcgaaactaaaaaaaaaaaaaaaaatgtatgcaaaaggcaagagaacaatctaacaacattgttatacaagattcccaagagtaaactgttcaaaaagcaa
